United States Patent 8,344,211 (PLANT NUCLEOTIDE SEQUENCES AND CORRESPONDING POLYPEPTIDES) - sequence listing, part 8

SEQ ID NO: 30014 - DNA, 690 bp, Zea mays
  misc_feature: Ceres CLONE 1405372-F
  misc_feature (577)..(577): n is a, c, t, g, unknown, or other
  misc_feature (581)..(581): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (658)..(658): n is a, c, t, g, unknown, or other
  misc_feature (659)..(659): n is a, c, t, g, unknown, or other
aaagctggagctccccgcggtggcggccgctctagaactagtggatcccccgggctgcaggaattcgcacgagaccattacctagaacatcctaatcgaaaagattttcttcacccgtccacctcgtcttgcgctcctctgtctcggcgacgactgtgctaccgccgccgccgccgcaagacttcgtcgggcactttgccggcgacgatttcccaccagcccaacaggatcagaggaggtgatggcgaggagtgacagctgcctggcgcgcgtgggtgccggaattgctatcggtggcgcggtcggcggagccgtcggtaaccttcgtccctaaacccctaaacactaggcttgcagcatcaatccgtccgtgcgagccgcttcacccgtcggtgtttttttttttggttggaagtagattagtgtgcgatttcaggaatcttctcgagctagctagtagctacatccctggcttgtgtggttagctagcggcagatgtaataactaggtggcttttgttaagagttactagtgcttaggtagcatcatctggaggtggaagatatcgatgctcgangtgnagttagtttgcccccactgcttgtgctctaagggctgtgctgattcgtctgccgggnnnttggtaacttctgctggnngctaaaacttggaatgcaaatgtaagatttt

SEQ ID NO: 30015 - DNA, 693 bp, Zea mays
  misc_feature: Ceres CLONE 1405375-F
  misc_feature (523)..(523): n is a, c, t, g, unknown, or other
tggagctccccgcggtggcggccgctctagaactagtggatcccccgggctgcaggaattcgcacgagaccattacctagaacatcctaatcgaaaaagaaaggtccccgtagaaattcgaaaccacaccaccacctggaaacccagacaaagcacgagccacgcacggcccccgctgcctcccttccgccgccgccgccgccggcggcgcgccaccgtcgctgctctcccgccttcaccgcgcccaactccaatccttgcctcccccgcgcgcttcagcctcttcactccccatcgttttcgcctggccagatccaggtttccttgaccgagacctcgcctgccttacgcctccggtcggattcttcgccgtccttgtccccactgggcaccgctggggtggagcgtagatcggatccgccgggagctgattccttctctcgcagtctagtttgacgcggattcatttgctgatcggcatagcatgatcctacggtgattccggatagcttgtgcaagctgntgacttgggaggtgtctttttatctgggctaaagtatcctgagacggtagcgtcacatggatgctagtacagaggctactgatgctatgggtgcggtggacttcgacatgacgccgcggggaaagtgccgcccagtgatactgtagagggcacgcagaagaacacgatgt

SEQ ID NO: 30016 - DNA, 729 bp, Zea mays
  misc_feature: Ceres CLONE 1405376-F
  misc_feature: Encodes the peptide sequence at SEQ ID NO. 30017
  misc_feature (432)..(432): n is a, c, t, g, unknown, or other
  misc_feature (435)..(435): n is a, c, t, g, unknown, or other
aaagctggagctcaccgcggtggcggccgctctagaactagtggatcccccgggctgcaggaattcgcacgagaccattacctagaacatcctaatcgaaaactcttcgtcgtcctatcttataatcgcatttcgaaatccccaaacggaggcctcgccactcttccgaacctgaacaatcaccaccgttattaagaagatgatgcgctgcgctgcaacgggcggcgggtgcgtcgcttcgtggagcggcgattggagattgccggcggtcaacccctgcagcgtgcggatgccgacgggcaacgatgggtggtgcgccggcctgaggtcgcgggcggcggatctcgccggcctcgagatggccaaccctgcgcgcggcgtcgggggggctcttccgcgcgagcccgcgctacgggcgcttgcaagccacgncgncagttgaccctgaagaaattccattggagaaggtccaagtaaaatcctcagaacatgttctggcataagttggcgtttcttggtggggggctattctgtttggttaccatcttgggggggccaagggggccatttgaaattctccccaaggaatttgggaaatggtaaaaagggtttctttgcggggggggggggataaaaactccttggggggggaaaacctaggttttttatcgggggggttcttggaaaaaaaatttgggggaaaaaaaattttcccggggggggcccccc

SEQ ID NO: 30017 - protein, 80 aa, Zea mays
  misc_feature: Ceres CLONE 1405376-F
  misc_feature (78)..(78): Xaa is any aa, unknown, or other
  misc_feature (79)..(79): Xaa is any aa, unknown, or other
MMRCAATGGGCVASWSGDWRLPAVNPCSVRMPTGNDGWCAGLRSRAADLAGLEMANPARGVGGALPREPALRALASHXXS

SEQ ID NO: 30018 - DNA, 678 bp, Zea mays
  misc_feature: Ceres CLONE 1405377-F
  misc_feature: Encodes the peptide sequence at SEQ ID NO. 30019
  misc_feature (579)..(579): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
tggagctccccgcggtggcggccgctctagaactagtggatcccccgggctgcaggaattcgcacgagaccattacctagaacatcctaatcgaaaaataaacaatggaaaatcgagagagcgagagagaggaagctagcgagaaggtcaagccgcgaagagaagagacgcacgtcacagatccctctccactgtctcaccctttctctctcctcgaccctcccgacgcggcaaagcaaaaacacaaggaggagaggagggagagaaggaagaaggcgaggccaaaaatcccctccccctccccaaatcctagcccaataatctctcaatcaggggattcttaggtctgatcaagtcggaggattcggcagggcgcagccatgaacgagaaggcgtccgtctccaaggagctcaacgccaagcacaagaagatattggaaggggtctctacgcatcctgagaatagagaatgcgcagactgcaagtcaaagggtcctcgatgggcaagtgtgaaatctagtatctttatatgcatgacatgttctggcattcatagaagcctgggggtgcacatatctnaggtaagatctgccaccctggatacatgcctgccagaggcagttgcatttatccatcaatggaaaaagcggnnnnnnnnnnnnnnnnnnnnnnnnnnnn

SEQ ID NO: 30019 - protein, 90 aa, Zea mays
  misc_feature: Ceres CLONE 1405377-F
  misc_feature (16)..(99): Pfam Name: ArfGap Pfam Description: Putative GTPase activating protein for Arf
  misc_feature (67)..(67): Xaa is any aa, unknown, or other
MNEKASVSKELNAKHKKILEGVSTHPENRECADCKSKGPRWASVKSSIFICMTCSGIHRSLGVHISXVRSATLDTCLPEAVAFIHQWKKR

SEQ ID NO: 30020 - DNA, 712 bp, Zea mays
  misc_feature: Ceres CLONE 1405379-F
  misc_feature: Translation starting site: 336
  misc_feature: Pfam Name: DUF579 Pfam Description: Protein of unknown function (DUF579)
  misc_feature (497)..(497): n is a, c, t, g, unknown, or other
  misc_feature (508)..(508): n is a, c, t, g, unknown, or other
  misc_feature (625)..(625): n is a, c, t, g, unknown, or other
  misc_feature (688)..(688): n is a, c, t, g, unknown, or other
  misc_feature (710)..(710): n is a, c, t, g, unknown, or other
aagctggagctccccgcggtggcggccgctctagaactagtggatcccccgggctgcaggaattcgcacgagaccattacctagaacatcctaatcgaaaactccttactctacctgaccagctcggcagctccccagccgcgacagagtccacgacgacgatctttcttcccagttccccccgtctgcctccggatccgagctcccctgcccgctcggtcgactccctcgtcgccgagtccagctccgactccgagaaaaaaatcaaatcgaccgagtccgcccgtgaagccgccgacagaaggagagagcacacagcgggcgaggcaggcagcatgaagtccatgggcagccgcgacaagctcgcggcggcgtcgagccaccgccgcgtcctcttggtggtcttcgccttctgcttcgccttcgccaccttcctcaccttcctctacaccacctcccacttcacgaccgcgcccggctccggctccggctccggntccatcgcggnctctaccaccagcaccacagcagcgactccgggtctgcgggcggcggcggccaaggccaagcagggccggaggtcgtgtccaagcggctgcccgtccccggtgtcgaggcgctggtncacttcgcgtccatctcgaacgcgacgcaccgcatgtcggacacgaacatcgggccatgtcgntcgtgctcggcgcgcggcgccntg

SEQ ID NO: 30021 - DNA, 678 bp, Zea mays
  misc_feature: Ceres CLONE 1405380-F
  misc_feature: Encodes the peptide sequence at SEQ ID NO. 30022
aaagctggagctccccgcggtggcggccgctctagaactagtggatcccccgggctgcaggaattcgcacgagaccattacctagaacatcctaatcgaaaaaaccaaacgagctgctagcccttctaaccttgctcgacccttgcccgccgcctgaactcgcctcccccgcggccggtcccctgcatctgttcgccgcgccgcaacccggaggagactacgactacgagcaccaccaggtagcagcaactgttttgctgcaatctgacaaagtggagggtttaagagtcgctgcttcttttatgtctgaacaatctttgctttatttgggattgctgggagagtattcttgcgcgacgaggaaaagcacaagtttctgctccactgcatgcatcaagagcccatccggtttccttgttctgaggtgtcattcgctagtgctcagagccggcttggttttctcgaaagatcagcagccactcttgattcaggactttgtcacacctgaaagcatctagttaaaacatctttattccaagatggaactgcaaaacattggtgcttcaaacaggaatgatgcctttcaacgggaaccagaatgccagaattgatacccaaaaataaaggccctggtaaatggaattacagaacaaatatgggggaaatgggttggcaaaa

SEQ ID NO: 30022 - protein, 71 aa, Zea mays
  misc_feature: Ceres CLONE 1405380-F
MSEQSLLYLGLLGEYSCATRKSTSFCSTACIKSPSGFLVLRCHSLVLRAGLVFSKDQQPLLIQDFVTPESI

SEQ ID NO: 30023 - DNA, 729 bp, Zea mays
  misc_feature: Ceres CLONE 1405381-F
  misc_feature (394)..(394): n is a, c, t, g, unknown, or other
  misc_feature (402)..(402): n is a, c, t, g, unknown, or other
  misc_feature (446)..(446): n is a, c, t, g, unknown, or other
  misc_feature (459)..(459): n is a, c, t, g, unknown, or other
  misc_feature (479)..(479): n is a, c, t, g, unknown, or other
  misc_feature (514)..(514): n is a, c, t, g, unknown, or other
  misc_feature (648)..(648): n is a, c, t, g, unknown, or other
ggagctccccgcggtggcggccgctctagaactagtggatcccccgggctgcaggaattcgcacgagaccattacctagaacatcctaatcgaaaaaagctttgtctgctgtccgcttgcaccagtcctcacggcccacgtcgagggagacgaagggataggaggcggaggttgcaaaaatggcagggagcatgtaggcggtggacccagcgagccggataagcgcgttgctcgcgttgcgccagctcctcgccatgctctagccgctggccctgctccgccctttcattggcgcgcgtggccggggcgtccgatgttgcggcctccgtgttggggctagcgggaaaaggggaaggcggcggcgtcagtggttctacgggtgcccggcgtctcngccatggntcgcagtcgccacacgaaagaagatagccacgcgccggacgcangaggccgggcggntgtacgagctgatccccagntagtaaacatggtccatctcttgctattctatccntctctgctagttggtaggcctattgtttatgaccttgtcgtcagtcatcagggttctatgggaaggggtctacttctacactggacattttctacctttttttatgtccaactaaggtggttccaggtgccccnaacttattaactaaaaaaccccttttggttaaaaacctttccggaacgttttgctttgattttcccagcggggtttgtttt

SEQ ID NO: 30024 - DNA, 684 bp, Zea mays
  misc_feature: Ceres CLONE 1405382-F
  misc_feature (266)..(266): n is a, c, t, g, unknown, or other
  misc_feature (353)..(353): n is a, c, t, g, unknown, or other
  misc_feature (359)..(359): n is a, c, t, g, unknown, or other
  misc_feature (360)..(360): n is a, c, t, g, unknown, or other
aagctggagctccccgcggtggcggccgctctagaactagtggatcccccgggctgcaggaattcgcacgagaccattacctagaacatcctaatcgaaaaagtgtttcgcactttgctattcagcttcgttcttcaccggttcaccctagccgccaccccaacccccagcgacagggaccttcgccgccaggccgcccccaaatcctagcgactgcgagcaccgtcgccagggcgcgtgcagcgagcgtcgccgcctggcgaagntccgcgactcctggcctgcagcgagcgccgctgtcccgcaccaccgtgcgaacggttggcgatgcccaaagccctgcaaggagtttngccgtnntccgcctcctctccctggggaccctcgcggttccaaattgacaaaatggttctggaacttgggttgcggcgcccaaccaagacttcttttcccaaagaccctaaacggaagaacctaaaccttgtggaggtcttgttcatggggcttttgggcttcccccctttttataacccgcccttaagagattggggacttgtggataaagggtggggagaaataaaaaggccctttttttgaaattggggaaaaggggaaaatttgcccttatttgaaaaaaaaaaaggaccttttttaaaaggatttttaccaaattatttttggggg

SEQ ID NO: 30025 - DNA, 723 bp, Zea mays
  misc_feature: Ceres CLONE 1405383-F
  misc_feature: Encodes the peptide sequence at SEQ ID NO. 30026
  misc_feature (275)..(275): n is a, c, t, g, unknown, or other
  misc_feature (336)..(336): n is a, c, t, g, unknown, or other
  misc_feature (337)..(337): n is a, c, t, g, unknown, or other
  misc_feature (456)..(456): n is a, c, t, g, unknown, or other
aaagctggagctccccgcggtggcggccgctctagaactagtggatcccccgggctgcaggaattcgcacgagaccattacctagaacatcctaatcgaaaagtgtgtctggaaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccaggaagcccggnggagccccgtacccgcagccgcacctctcggcggaggcgcggcgcaagctctacgcgcccnngtgtcagacctgctccgcgctgctccagaggctgatgaaagcacagcacagctgggtggtcaacactcccgtagacgcgagcgcgctgggactgcacgactaccatacgatcatcaccnagcccatggacctcgggacggtcaagtcaaggctagcggctggacagtacaggtccgcccgggagttttgcagggatgggcggctcacgttccggaaagccatgacgaacacccccaggggcgggacggcccttcatggccaacaattgctaaaactgttcaagaaaaagggttggaaattggggttgattaatttatttttgccaaggctccgaaacattctctgggggccccggggagcccgggaaaataaattctgggttttaa

SEQ ID NO: 30026 - protein, 117 aa, Zea mays
  misc_feature: Ceres CLONE 1405383-F
  misc_feature (1)..(77): Pfam Name: Bromodomain Pfam Description: Bromodomain
  misc_feature: SWISSPROT Homolog: EC 2.3.1.48 Histone acetyltransferase
  misc_feature (29)..(29): Xaa is any aa, unknown, or other
MKAQHSWVVNTPVDASALGLHDYHTIITXPMDLGTVKSRLAAGQYRSAREFCRDGRLTFRKAMTNTPRGGTALHGQQLLKLFKKKGWKLGLINLFLPRLRNILWGPRGARENKFWVL

SEQ ID NO: 30027 - DNA, 731 bp, Zea mays
  misc_feature: Ceres CLONE 1405384-F
  misc_feature (354)..(354): n is a, c, t, g, unknown, or other
  misc_feature (395)..(395): n is a, c, t, g, unknown, or other
  misc_feature (430)..(430): n is a, c, t, g, unknown, or other
  misc_feature (579)..(579): n is a, c, t, g, unknown, or other
acagctggagctccccgcggtggcggccgctctagaactagtggatcccccgggctgcaggaattcgcacgagaccattacctagaacatcctaatcgaaaaaagcaaattgcatttcaagtcttttgggtttatacagcacagataaaggcggcagcggcagcagcagagcagcctaccttttcccctctccacctcccgcaagcaaactcacggtcacggcaccgcccccgcacccactgccctctagcttcttcctccccgctttcatggcaggaaaggctgaggcgatgatgcccataggccatccagtttgatccatgccatcctgaacctctatacatactgccccangccgggcactcgcgatctctacttctctaccgccgctgtgnctgtgctagctcctctctctgcttctgcttctgcntttggctcactcagcctgctgcaagcttttgctttggttaaggggctccttttgcatccctttaacggtccccccccactttccgtccccttggccaggacaagaaaaggtcctggctttaacttttccggaccttaactccccccccnaaaggggaattgggggggagctgggcttgaaagtgtttttgcccccccccgggtttttttgtccacaatggggggggtcccccggcggcctccgggggggaaaattcggagggtttttgtgttggggggccccagccccccgcccccccctc

SEQ ID NO: 30028 - DNA, 677 bp, Zea mays
  misc_feature: Ceres CLONE 1405386-F
  misc_feature: Encodes the peptide sequence at SEQ ID NO. 30029
  misc_feature (319)..(319): n is a, c, t, g, unknown, or other
aaagctggagctcaccgcggtggcggccgctctagaactagtggatcccccgggctgcaggaattcgcacgagaccattacctagaacatcctaatcgaaaaataccactccacaatcacacatttgacaccgccaatccatggccttggcgacgccgctgcggctccgccgccacctcctcctccccgccgggccgtccccggcgacccaccgcgccctgtcgctgcggcggggccgcctcctccccgcaagcctgtcgtccgccgcggcgggcgggcggccgacggtgctggtgacggagacgctgcgttccgcggngctggacctgctgcgcgccttcgccaacgtggactgctcctacgagctgacggcggaggagctccgcgccaaggtgtcgctcgtgaacgcgctggtggtgcgcagcggcacgcaggtgacgcgggaggtgttcgaggccgcgcgcgacaggctccgtgtcgtcggccgcgccggggtcggcatcgacaatgtggacctccaggcggccaccgaaagcggctgcctcgtcgtcaacgcgcccaccgacaacaccgtcgccgacggcgagcacgccgtcgcgctcctcgtcgccgtgtcgcgaagtatcgcggcggccgacgcgtcgctcaaggccggcaaatgcagcggggcagtatgt

SEQ ID NO: 30029 - protein, 179 aa, Zea mays
  misc_feature: Ceres CLONE 1405386-F
  misc_feature (50)..(179): Pfam Name: 2-Hacid_dh Pfam Description: D-isomer specific 2-hydroxyacid dehydrogenase, catalytic domain
  misc_feature: SWISSPROT Homolog: EC 1.1.1.95 Phosphoglycerate dehydrogenase
  misc_feature (60)..(60): Xaa is any aa, unknown, or other
MALATPLRLRRHLLLPAGPSPATHRALSLRRGRLLPASLSSAAAGGRPTVLVTETLRSAXLDLLRAFANVDCSYELTAEELRAKVSLVNALVVRSGTQVTREVFEAARDRLRVVGRAGVGIDNVDLQAATESGCLVVNAPTDNTVADGEHAVALLVAVSRSIAAADASLKAGKCSGAVC

SEQ ID NO: 30030 - DNA, 682 bp, Zea mays
  misc_feature: Ceres CLONE 1405387-F
  misc_feature: Encodes the peptide sequence at SEQ ID NO. 30031
  misc_feature (492)..(492): n is a, c, t, g, unknown, or other
  misc_feature (564)..(564): n is a, c, t, g, unknown, or other
  misc_feature (577)..(577): n is a, c, t, g, unknown, or other
  misc_feature (578)..(578): n is a, c, t, g, unknown, or other
  misc_feature (638)..(638): n is a, c, t, g, unknown, or other
tggagctccccgcggtggcggccgctctagaactagtggatcccccgggctgcaggaattcgcacgagaccattacctagaacatcctaatcaaaaaagccgcatcccttctttcattcgccgccgccgcctgctctctgctgccgtcgccatggggagaaggcctgcgagatgctatcgccagatcaagaacaagccataccccaagtccaggtactgccgtggtgtccctgaccccaagatcaggatctacgatgttggcatgaagagaaagggtgttgatgagttcccctactgtgtgcaccttgtctcttgggagaaggagaatgtctccagtgaggctcttgaggctgcccgtattgcctgcaacaagtacatgaccaagtctgcaggaaaggatgccttccaccttcgggtccgggttcaccccttccatgtccttcgtatcaacaagatgctttcgtgtgctggggctgataggctccagactgnaatgaggggtgcctttggcaagcctcagggcacctgtgctagggtggacattggtcaggtcctcctttctgntcgatgcaagganncacatgctgcacatgccagtgaagctctgcgtcgcgccaagttcaagttcccctggccgnccaaagatattgaaagcagaaagtggggcttcaccaagtccagc

SEQ ID NO: 30031 - protein, 177 aa, Zea mays
  misc_feature: Ceres CLONE 1405387-F
  misc_feature (5)..(167): Pfam Name: Ribosomal_L16 Pfam Description: Ribosomal protein L16
  misc_feature (114)..(114): Xaa is any aa, unknown, or other
  misc_feature (138)..(138): Xaa is any aa, unknown, or other
  misc_feature (142)..(142): Xaa is any aa, unknown, or other
  misc_feature (143)..(143): Xaa is any aa, unknown, or other
  misc_feature (163)..(163): Xaa is any aa, unknown, or other
MGRRPARCYRQIKNKPYPKSRYCRGVPDPKIRIYDVGMKRKGVDEFPYCVHLVSWEKENVSSEALEAARIACNKYMTKSAGKDAFHLRVRVHPFHVLRINKMLSCAGADRLQTXMRGAFGKPQGTCARVDIGQVLLSXRCKXXHAAHASEALRRAKFKFPWPXKDIESRKWGFTKSS

SEQ ID NO: 30032 - DNA, 727 bp, Zea mays
  misc_feature: Ceres CLONE 1405388-F
  misc_feature: Encodes the peptide sequence at SEQ ID NO. 30033
  misc_feature (140)..(140): n is a, c, t, g, unknown, or other
  misc_feature (270)..(270): n is a, c, t, g, unknown, or other
  misc_feature (349)..(349): n is a, c, t, g, unknown, or other
  misc_feature (355)..(355): n is a, c, t, g, unknown, or other
  misc_feature (380)..(380): n is a, c, t, g, unknown, or other
aaagctggagctccccgcggtggcggccgctctagaactagtggatcccccgggctgcaggaattcgcacgagaccattacctagaacatcctaatcgaaaagcccacactccaccacccgcgccccgccgcccgccccngccgcctcctcctacttcgcctcggccgcctcggatccggaccgagcgccggccatggcactcgccttcgacgagttcgggcgccccttcatcatcctgcgggagcaggagaagaagacgcgcctgcggnggctcgacgcgcagaaggccaacatcggcgcgggcaagggcgtcgcgcggatcctccgcacctcgctcggcccaaaggncgcggnacagatgctccagtcccccgacggngacgtcatcatcacaaatgatggggcgaccatcctggagcagatgaatggtgacaaccagatcgcaaagctgatggtggagctgtcccgtagtcaagactaccaaattcgggatgggacccacgggtgtggtattcatgtcagggggggttccttgagcaagccgggaagctttttaaagcggggattccccccccttgggttgcttgagggttttgaaaaactcaaaaggggttttttgtcccctaaaacaacctccaaaagtttgggtcggggaaaaaattggccccgcgggaaaaaatgggagaacattttccccaaaaatttaacccgggggggggttttaga

SEQ ID NO: 30033 - protein, 177 aa, Zea mays
  misc_feature: Ceres CLONE 1405388-F
  misc_feature (26)..(26): Xaa is any aa, unknown, or other
  misc_feature (52)..(52): Xaa is any aa, unknown, or other
  misc_feature (54)..(54): Xaa is any aa, unknown, or other
MALAFDEFGRPFIILREQEKKTRLRXLDAQKANIGAGKGVARILRTSLGPKXAXQMLQSPDGDVIITNDGATILEQMNGDNQIAKLMVELSRSQDYQIRDGTHGCGIHVRGGSLSKPGSFLKRGFPPLGLLEGFEKLKRGFLSPKTTSKSLGRGKNWPRGKKWENIFPKNLTRGGVL

SEQ ID NO: 30034 - DNA, 708 bp, Zea mays
  misc_feature: Ceres CLONE 1405389-F
  misc_feature: Encodes the peptide sequence at SEQ ID NO. 30035
aaagctggagctccccgcggtggcggccgctctagaactagtggatcccccgggctgcaggaattcgcacgagaccattacctagaacatcctaatcgaaaagtgtcgtcttcctctccgccgcttctcctgtccaccctcgactgcttgcgcgtgacctgagccgccgccgcctacatccgctcatccccgcgcccgcctcaaccacgccgccaccgaccacgtataatcctgcctccccttcgcgcggttacgaggctcgtttcctttgggatcgttcgtctgtcccgaccgcgtgggcgcttcttcttcgggatctcgctggaccgagcggcccagggctagggattcaggcccatggcgtgccggcgcgtcctcacccagagtgcaaggcatcgaccagcaaaacgaatctacaatgaactagctgcttcctcccctttgggtgttcttcgaagtgacatcacttcaggtgccaggattagacatttacatgagaggaaccagccaagttacattggtagccctgcaccgccgggtccgagactaagaatcaccaagcggaccttctctgcttaaagagacttacagaagggacccggagcgcggcatacaataattggaagccaaccctcattaacattctaatcctgccacactttccgagaaagcaaaaccccttgtaagggttgatacggcggatgaaaa

SEQ ID NO: 30035 - protein, 73 aa, Zea mays
  misc_feature: Ceres CLONE 1405389-F
MACRRVLTQSARHRPAKRIYNELAASSPLGVLRSDITSGARIRHLHERNQPSYIGSPAPPGPRLRITKRTFSA

SEQ ID NO: 30036 - DNA, 727 bp, Zea mays
  misc_feature: Ceres CLONE 1405392-F
  misc_feature: Encodes the peptide sequence at SEQ ID NO. 30037
  misc_feature (519)..(519): n is a, c, t, g, unknown, or other
  misc_feature (547)..(547): n is a, c, t, g, unknown, or other
  misc_feature (552)..(552): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (567)..(567): n is a, c, t, g, unknown, or other
  misc_feature (668)..(668): n is a, c, t, g, unknown, or other
caaagctggagctccccgcggtggcggccgctctagaactagtggatcccccgggctgcaggaattcgcacgagaccattacctagaacatcctaatcgaaaagccatgctcgccgcaagtcccctgcgccaagtgccgccgccgggcatcccatccacctcccgtcctactccctgaaggcatgaacccccgttccaagcgccctataccgccgccatctcccgttcccctttcctttgttctctttcgtctgctgggcaaaccaacgccgccagccactggtcgatcacttccagccaaggagtggcggacgcgcagggcttggagtgtggcggacaggcggatcctgtagcggcagagacaggtacggacgagagaggtgagttctccgcacgatcggctgggacaggggaacgacgcgcgcaactgtgtggcctgggggggcattaaacgcttaaacggcgatcaatcgtcgcttaatcgattgctgtcgggtactcctggcactcagaagaggntgaactaagatagggatattcaatgacnggtgnatcgnnntgtggtgntgatagacaatggggggtggtcttctcaaggctggcttttgggggggacaatgatcccaattgctgttgtccccaactgtatggccaaaccccctggtggncatgccagctcgaagaaatggcttgtggctgaccagctgcaggcagaaaatgtcgatgt

SEQ ID NO: 30037 - protein, 36 aa, Zea mays
  misc_feature: Ceres CLONE 1405392-F
MIPIAVVPNCMAKPPGGHASSKKWLVADQLQAENVD

SEQ ID NO: 30038 - DNA, 674 bp, Zea mays
  misc_feature: Ceres CLONE 1405397-F
  misc_feature: Encodes the peptide sequence at SEQ ID NO. 30039
  misc_feature (280)..(280): n is a, c, t, g, unknown, or other
  misc_feature (332)..(332): n is a, c, t, g, unknown, or other
  misc_feature (333)..(333): n is a, c, t, g, unknown, or other
  misc_feature (357)..(357): n is a, c, t, g, unknown, or other
  misc_feature (388)..(388): n is a, c, t, g, unknown, or other
aaagctggagctccccgcggtggcggccgctctagaactagtggatcccccgggctgcaggaattcgcacgagaccattacctagaacatcctaatcgaaaaagttaagtctcgttcactgcctgtgctgctcagagctctgatcacacatcctcgtcgccaatggcggctcccgtccgggacatcccgctcccgtcgcccgtcctgtacccccgcatgtccttatggggccgcagcagctgcagccggcgacgtgcccccggagttcgcgcagcagtgnaaggtggggggagggagcttccccgatgacggagaccgtgcaggtggaccgnngaagcaggcggaaagaggccgggntcgaattctgccagggcccaggggcgctggnctccaccccaatccggtttttgacaggaacgggggagggataactccaaaagggcggggtttaccaaaagggtgtgggaaatggtgccattttccaaaaaattgggaacccccccctaaaattcttaatccccgcccccccccgcgtttttcctttttttcaatggggaggacaaggagggggacccaattatcccggaaagggaaaaaataaaacgggacgcaaaaatttggggggaaaaggggcccgcaaaaaaaaaattttttaaacccccttcacacttcta

SEQ ID NO: 30039 - protein, 48 aa, Zea mays
  misc_feature: Ceres CLONE 1405397-F
  misc_feature (40)..(40): Xaa is any aa, unknown, or other
MAAPVRDIPLPSPVLYPRMSLWGRSSCSRRRAPGVRAAVXGGGRELPR

SEQ ID NO: 30040 - DNA, 743 bp, Zea mays
  misc_feature: Ceres CLONE 1405398-F
  misc_feature: Encodes the peptide sequence at SEQ ID NO. 30041
  misc_feature (385)..(385): n is a, c, t, g, unknown, or other
  misc_feature (451)..(451): n is a, c, t, g, unknown, or other
  misc_feature (705)..(705): n is a, c, t, g, unknown, or other
  misc_feature (730)..(730): n is a, c, t, g, unknown, or other
aagctggagctccccgcggtggcggccgctctagaactagtggatcccccgggctgcaggaattcgcacgagaccattacctagaacatcctaaaaaaaatcgatcagtcgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggncggaacctcgcgtccggcgagagcgtggccatcaaggtcatcgacaaggagaaggtgatgcgcgtncgcatgatcgaccagatcaagcgcgagatctccgtcatgcgcctcgtccgccacccaacgtcgtgcagctgcacgaggtgatggccagcaagagcaagatatacttcgccatggagtacgtccggggcggcgagctctttcgccggcgtcgcccgcgccccgctcaagggagacgccgcgagaaggtacttccaacagctcgtcggcgccgtcgacttctgccacagcgcggtgtctaccacgacctcaggccngagaactcctcgtcgagagcacggnaacctcaaggtcc

SEQ ID NO: 30041 - protein, 77 aa, Zea mays
  misc_feature: Ceres CLONE 1405398-F
  misc_feature: SWISSPROT Homolog: EC 2.7.11.1 Non-specific serine/threonine protein kinase
MEKKPTILMNRYELGRTLGQGTFAKVYHGRNLASGESVAIKVIDKEKVMRVRMIDQIKREISVMRLVRHPTSCSCTR

SEQ ID NO: 30042 - DNA, 728 bp, Zea mays
  misc_feature: Ceres CLONE 1405399-F
  misc_feature: Encodes the peptide sequence at SEQ ID NO. 30043
  misc_feature (209)..(209): n is a, c, t, g, unknown, or other
  misc_feature (211)..(211): n is a, c, t, g, unknown, or other
  misc_feature (213)..(213): n is a, c, t, g, unknown, or other
  misc_feature (285)..(285): n is a, c, t, g, unknown, or other
  misc_feature (332)..(332): n is a, c, t, g, unknown, or other
  misc_feature (728)..(728): n is a, c, t, g, unknown, or other
ggagctccccgcggtggcggccgctctagaactagtggatcccccgggctgcaggaattcgcacgagaccattacctagaacatcctaatcgaaaaattgaatccattctaccgctgctcctcctccttgctctgccgagaagccggcgatgaggggccgcaagaggcagcaggtgagcgccagctcggccgccgcgctggtgaagggnangnagagcaccaagcagaaggagaaagaagctagggaagagaacgaggcgaggggagcccgcagggagcccgcgncgaaggagaggcagatgaggcgcaaggccgtaaaggacaagagacgnatacggggcgaacatggtaaagagccactcaacaaaaggaggccggggaagagccaaggagaacgacaagtcctaggaaaggggaatacgagggccaacggttgccccagttcttcaaggtcttcttccccaagcagtccatcgagtggttgaaaatccaaccatgttcaactagagctcttggaggagcagccacccggaacagtttccctgaaagccccaagggaaaccgaaggcgagaaaaggtcttttcccaggccaaacccggagccctcggggggctcccagcagggtttgaaaggggttcgaaccgggaccccccccctcaggatagggccatttccggggccttcaccccccggacggtcccgccccagtttcccccgggtggggttn

SEQ ID NO: 30043 - protein, 111 aa, Zea mays
  misc_feature: Ceres CLONE 1405399-F
  misc_feature (21)..(21): Xaa is any aa, unknown, or other
  misc_feature (22)..(22): Xaa is any aa, unknown, or other
  misc_feature (46)..(46): Xaa is any aa, unknown, or other
MRGRKRQQVSASSAAALVKGXXSTKQKEKEAREENEARGARREPAXKERQMRRKAVKDKRRIRGEHGKEPLNKRRPGKSQGERQVLGKGNTRANGCPSSSRSSSPSSPSSG

SEQ ID NO: 30044 - DNA, 665 bp, Zea mays
  misc_feature: Ceres CLONE 1405402-F
  misc_feature: Translation starting site: 180
  misc_feature: SWISSPROT Homolog: EC 2.1.2.1 Glycine hydroxymethyltransferase
  misc_feature (394)..(394): n is a, c, t, g, unknown, or other
  misc_feature (421)..(421): n is a, c, t, g, unknown, or other
  misc_feature (427)..(427): n is a, c, t, g, unknown, or other
aaagctggagctccccgcggtggcggccgctctagaactagtggatcccccgggctgcaggaattcgcacgagaccattacctagaacatcctaatcgaaaaactacctcccaaactcgcgagcgagtcgaggctccaaccccggcacatcacaggaggaggaggacgacgcgcccaccatggccatggcgacggccctccgcaagctctccgccaacgctctgcgccgccagccgctctcccgcatcacgccgctctactacatggcgtcccttccggcgacggaggagagatccggaatcacctggactaagcagttgaacgcgccgctggaagaagtcgaccccgagattgctgacatcatcgagcacgagaaggcccgccaatggaaggntctggagctcatccccgtcgagaattncacgtncgtgtcagtgatgcaggcagtgggttccgtcatgacccaacagtacagcgaggggtaccctggcgcagatactacgggggaaatgagttttatgatatggcagagtccttgtgtcagaaacgtgcttttgaagttttccgtttggacccgcgaaatggggaagtgaatgtgcaactctattcgggtcgcccgcaactttcatgaataccctgcactcttgaagcacatgaaaggatct

SEQ ID NO: 30045 - DNA, 620 bp, Zea mays
  misc_feature: Ceres CLONE 1405404-F
  misc_feature (178)..(178): n is a, c, t, g, unknown, or other
  misc_feature (179)..(179): n is a, c, t, g, unknown, or other
  misc_feature (203)..(203): n is a, c, t, g, unknown, or other
  misc_feature (253)..(253): n is a, c, t, g, unknown, or other
  misc_feature (264)..(264): n is a, c, t, g, unknown, or other
  misc_feature (266)..(266): n is a, c, t, g, unknown, or other
  misc_feature (288)..(288): n is a, c, t, g, unknown, or other
  misc_feature (306)..(306): n is a, c, t, g, unknown, or other
aaagctggagctccccgcggtggcggccgctctagaactagtggatcccccgggctgcaggaattcgcacgagaccattacctagaacatcctaatcgaaaagttcccctttccctcctgcgcacccgtcttctcctccccgcgtcaaaccccagcacaaaaagcaaccggccgccgnnctctcgctccctctccgaatcagncgtcgcggtggctaatccgggcgatcccccctccccgatcgcggtgccgncgcaaaagcgncngctccggggctcccccgatggnatagcactccaggagcangcgatcgagtacgtcaagcagggggtcaaggaagaaaatggcgggaattaagtcaagggggtcccttcttaaagtgaacgcggttggggaaatttcaaacccccctccaggtccaaaaaaaccccccaattagggggggcctttcccggcaaggttcccaggaaacctcccccccgcccaaagaaaaccggggggcccccccaaaaaggggggggaaaggcctgggcccacaagggggggagaaaatttttgtcccccggccccccaaaaaaaaggaaaaaaagggggcaaagggaacccaggggggggattcc

SEQ ID NO: 30046 - DNA, 745 bp, Zea mays
  misc_feature: Ceres CLONE 1405405-F
  misc_feature: Translation starting site: 232
  misc_feature: Pfam Name: ABC_tran Pfam Description: ABC transporter
  misc_feature (361)..(361): n is a, c, t, g, unknown, or other
  misc_feature (380)..(380): n is a, c, t, g, unknown, or other
  misc_feature (408)..(408): n is a, c, t, g, unknown, or other
  misc_feature (462)..(462): n is a, c, t, g, unknown, or other
  misc_feature (468)..(468): n is a, c, t, g, unknown, or other
  misc_feature (469)..(469): n is a, c, t, g, unknown, or other
  misc_feature (637)..(637): n is a, c, t, g, unknown, or other
  misc_feature (642)..(642): n is a, c, t, g, unknown, or other
aagctggagctccccgcggtggcggccgctctagaactagtggatcccccgggctgcaggaattcgcacgagaccattacctaaaacatcctaatcgaaaaagaggctaaacccccgtctaaccctgctgccgtgccgcttgccactactccgcttcgttctccgccgcctccccggacgtccggaaacttctagattgaagggggatagccattggcgtcaacgtgtgtgatggaggtcaggggactggggcagctcctggcggcgctggccgcggcgttcttcgtccgcgccatcgcgggacccggccccgccctccttccgccggcggaggacacggaggccgacgaggccgacgcgnaggctggcgagggaggtgnttggtggtgtgccgcccgtgaccatccnggtgggctcgcatcacctgcgcactgaagaaacagcgcggggaagtggcagggnttctgnntgtcaatgtgtcaggggaggcgaaaccggggaggctgcttgcactaatggggccatcgggctctggcaaaacacttttgctcatgtgctagcagggcagctcgccgcatcgtcttccttgcaccttttcgggtttctgtatatcaatgtcggcctatctcgaaggcgnatatnagattgctttttgtcagcaggaagacctggtcttctcacagctcacgggtgcggagacgctctcactggctgctgagctcagctttctgacttgggggctctg

SEQ ID NO: 30047 - DNA, 759 bp, Zea mays
  misc_feature: Ceres CLONE 1405406-F
  misc_feature: Encodes the peptide sequence at SEQ ID NO. 30048
aagctggagctcaccgcggtggcggccgctctagaactagtggatcccccgggctgcaggaattcgcacgagaccattacctagaacatcctaatcgaaaaacctcatggctcacgcgaatacaacaccgacaccataccacacctaacggtgtacatgcattcacgactcgccttccgctgattgcctccaactccccccgcgtagtatcgtgcttacgaatcaccagatagacggtagatgcccaaaggtccatggtattctccgacgccgggtcgcctctcgtagccaccgccgctgagtctgcttcctcttgcgtcgcccacctcccctgctgctgtcccgttagttgttgccgatagtgttaaagacgcgtacctagacgggtcgggacttactccacgaacagtctgtaagggttaacctatggatctctcccgtccaaaattcaaaaaacatctcgctcgggctgcaaaataaggcccagcccacgatcgagaggatgacgaaccctcgccggtgtgccagtttccaagaaaaaaaccgaaacaccacctggccaggggaagccgacccgtaaaaagacaaaaaagacgggggtaaccaaaacttctcccctcctggggcactccctctacccaaagccccccaaacgaaaggtaaaaaacaggggcgcacgggcctgcaaaataaaaaactccggtcctggcccaagagctgggccccacccaaagtaaagaggggttggaaaaaaaaaac

SEQ ID NO: 30048 - protein, 35 aa, Zea mays
  misc_feature: Ceres CLONE 1405406-F
MVFSDAGSPLVATAAESASSCVAHLPCCCPVSCCR

SEQ ID NO: 30049 - DNA, 736 bp, Zea mays
  misc_feature: Ceres CLONE 1405411-F
  misc_feature: Encodes the peptide sequence at SEQ ID NO. 30050
  misc_feature (257)..(257): n is a, c, t, g, unknown, or other
  misc_feature (349)..(349): n is a, c, t, g, unknown, or other
  misc_feature (358)..(358): n is a, c, t, g, unknown, or other
tggagctccccgcggtggcggccgctctagaactagtggatcccccgggctgcaggaattcgcacgagaccattacctagaacatcctaatcgaaaaatgtaaaccacactccactccagcactgaacacttgattgattcagtaggtagctagctagctgaatcacaatggatcctaccaagttccgtccgtccagtagccacgacacgacggtgacgacgacgaacgctggcgctcctgtgtggaacgacaacgnagcgctgactgtggggcctcgcggtcccatccctgctggagactaccacctgatcgagaaggtggcgcacttcgcgcgggagcgcatcccgnagcgcgtgntgcacgcgcgcggggcctccgccaaggtcttcttcgagtgcacccacgacgtgacgtcgctgacgtgcgccgacttcctgcgcgcgcccggggtgcgggacccccgtgatcgtgggcttctcgacgtaatccacagcgggggtccccggagaagatcccggacccgccgggtttccccgggaatttaaccccgcgaagggaaattggacctggtgggaaaaaattcccccggttttttattcgggaagggataaagttccccgagggatcccgcgtttaaacccaaccgggggtccaatggaaaaaaatggggggggttaaaattcctgtgcacctcccagaaaatgggaaacttttttttctccttttaaggggggg

SEQ ID NO: 30050 - protein, 125 aa, Zea mays
  misc_feature: Ceres CLONE 1405411-F
  misc_feature (18)..(126): Pfam Name: Catalase Pfam Description: Catalase
  misc_feature: SWISSPROT Homolog: EC 1.11.1.6 Catalase
  misc_feature (30)..(30): Xaa is any aa, unknown, or other
  misc_feature (61)..(61): Xaa is any aa, unknown, or other
  misc_feature (64)..(64): Xaa is any aa, unknown, or other
MDPTKFRPSSSHDTTVTTTNAGAPVWNDNXALTVGPRGPIPAGDYHLIEKVAHFARERIPXRVXHARGASAKVFFECTHDVTSLTCADFLRAPGVRDPRDRGLLDVIHSGGPRRRSRTRRVSPGI

SEQ ID NO: 30051 - DNA, 728 bp, Zea mays
  misc_feature: Ceres CLONE 1405412-F
  misc_feature: Encodes the peptide sequence at SEQ ID NO. 30052
  misc_feature (347)..(347): n is a, c, t, g, unknown, or other
  misc_feature (469)..(469): n is a, c, t, g, unknown, or other
  misc_feature (618)..(618): n is a, c, t, g, unknown, or other
  misc_feature (626)..(626): n is a, c, t, g, unknown, or other
aaagctggagctccccgcggtggcggccgctctagaactagtggatcccccgggctgcaggaattcgcacgagaccattacctagaacatcctaatcaaaagcctttttctctcctcccaatctcccattaccccagcggcccagcgtgcggagacgggagacgcgctccccagtccccacccccctctcgtgtcgtggcgacgactggggggctgtcgctgccgctgccgccctacgtcaggtggccaggtcgtattagggcacttcgccggcgacgagtaccacaaggcagtggacactttctctggtatcagaggatcaatgtccaattattatgatgactacnatgacattgacgagatggaggatgattatgatatggatgatcccattgatgacatggtagacgagcagcaagggattagggattctgatgcggaaagatatgattatgggacaccaaatgantagatcccagatacttcatcagcagatgcaagaaaaagaagggacattcaaggaataccctgggagcagataaacataacccgtaaaaatacagacagtccagattagaacagtacaaaattatgagaatgtacctaactctggagaangagctatngaagattgcaacccacagagaaaggtggatatactatgagtttagacgaatactagatcggtaaatcactattctacttttcagcttagaaatgggtatggg

SEQ ID NO: 30052 - protein, 48 aa, Zea mays
  misc_feature: Ceres CLONE 1405412-F
  misc_feature (9)..(9): Xaa is any aa, unknown, or other
MSNYYDDYXDIDEMEDDYDMDDPIDDMVDEQQGIRDSDAERYDYGTPN

SEQ ID NO: 30053 - DNA, 728 bp, Zea mays
  misc_feature: Ceres CLONE 1405413-F
  misc_feature: Translation starting site: 299
  misc_feature (329)..(329): n is a, c, t, g, unknown, or other
  misc_feature (356)..(356): n is a, c, t, g, unknown, or other
  misc_feature (404)..(404): n is a, c, t, g, unknown, or other
  misc_feature (435)..(435): n is a, c, t, g, unknown, or other
  misc_feature (453)..(453): n is a, c, t, g, unknown, or other
  misc_feature (500)..(500): n is a, c, t, g, unknown, or other
aagctggagctccccgcggtggcggccggctctagaactagtggatcccccgggctgcaggaattcgcacgagaccattacctagaacatcctaatcgaaaaaacccagaaacatagaaggcgtgtacaccaagaagaagccggccaaccaaccgactcccccgaccctcctgatcgatcgagggccccttgttctagccagttgtccccttccctctcgccggcgttgctcctgcctgctccaatggccgctgcctctgccgccgcccccacgaagacggcgaacatccccgcgacgatgcgggccgtgcagtacgactcctgcggcnggggcgccgctggactcaagcatgtgnaaagtcccgtcccttcggccaaaaagatgagcttctgctgaagctggnagcagcaagcatcaacccagtggactggaangtgcaaaaggcatgctgnagcctttcctgcctcggaaattactttttatcccaggactgatgggncaggaatctgggctgatgttggtccagaaatcaggggttccaggccggaaacaaggtgttgttttgcctcaccatttaaaggagtggcgtttggaaaaatatttggcattaaaaaatttaccccaaaaagccccctgggttttttgtccaaagggcagggttcccttcgcccgggattgccccccagggtttagaacccttgggccatttcagggtttggaagggcta

SEQ ID NO: 30054 - DNA, 673 bp, Zea mays
  misc_feature: Ceres CLONE 1405414-F
  misc_feature: Encodes the peptide sequence at SEQ ID NO. 30055
tggagctccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaatcaatttcttcgtccgccttcgcccctgcttacgtccccgctactaaccctaggatcattctgtcttttctcgtttcttatccgactcttcttcgttttatgcctatcagttatgaggttgaacgccttcagaagcttctctactagattagtgtaaatagtagacttgttcgagtttagcttggctggaagaattagtctctggtccgtgtttatatctgctagcaataatggctgcgatgaacggagaggtattgggtgaatgtggaaggaacataaatagtctcaagagaaagcgggagagccccgctgcatatgctgctggcgtattctgcacctctgaattgcatcagcatactg

SEQ ID NO: 30055 - protein, 43 aa, Zea mays
  misc_feature: Ceres CLONE 1405414-F
MAAMNGEVLGECGRNINSLKRKRESPAAYAAGVFCTSELHQHT

SEQ ID NO: 30056 - DNA, 720 bp, Zea mays
  misc_feature: Ceres CLONE 1405415-F
  misc_feature: Encodes the peptide sequence at SEQ ID NO. 30057
  misc_feature (476)..(476): n is a, c, t, g, unknown, or other
aaagctggagctccccgcggtggcggccgctctagaactagtggatcccccgggctgcaggaattcgcacgagaccattacctagaacatcctaatcgaaaaaacgatcggtcgggactccggactcgggagtcggcactcgggtctcgacgtctcgtctcgtctcgtctcgcctgcccgcagccccttggcttcgttccatccggcttctcggcggcggcggagaggagggggatggcgcaccggctgctgcgggacgcgcaggcggacgggtgtgagcggtcggacttccccatcatctgcgagtcatgcctcggcgacaacccctacgtccggatgttaagagctgaatatgacaaagaatgcaaaatttgtgcacgtccttttactgtattccggtggcgtcctgtgcgagatgcaaggtacaagaagactgagatctgccagacatgttgcaagctatagaatgtctgccnagtctgcctgctggatcttgaatatggtctgcctgttcaggtccgagatacagcactctctatcaattcgatgatgcaatcccaaggagtgatgtcaatcgcgaatattttgcagaagagcatgataggaggggcagagctggcatagactatgattcatcctatgggaaggctcgtccaaatgataccatctgaagctttcaaggacagcacatattacgagaggacagagctcatgtttgca

SEQ ID NO: 30057 - protein, 76 aa, Zea mays
  misc_feature: Ceres CLONE 1405415-F
MAHRLLRDAQADGCERSDFPIICESCLGDNPYVRMLRAEYDKECKICARPFTVFRWRPVRDARYKKTEICQTCCKL

SEQ ID NO: 30058 - DNA, 627 bp, Zea mays
  misc_feature: Ceres CLONE 1405417-F
  misc_feature: Encodes the peptide sequence at SEQ ID NO. 30059
cccccgggctgcaggaatccccacgaaccattacctagaacatcctaatcgaaaaaatcagtgctcgctagccctccacgccctgaacctagcccggacaccagccagaacaggccatgtccatgggctccccggtgcagctcaggcggctgaagcctctgtaccagttcgtggtgaacaacatcctggccatcgtggccgtgccgctcgccaccgcggtcctgctcaaggcgtcgtcgctcgggcccgaggagatcctggcgctccggccggcgcacctgttcctggccgcgttcctgcctgccgcggccacggtgctgtacctgatgctccggccgcgcacggtgtacctggtggactacgcgtgcttccgcaccagccccaactgccgcgtcccgttcgcgacgttcctggagcactcccgcgtgtggccgggcttcgacgagcgcagcgtccgggtcatgacgcccctgctggaacggtcgaggctccgggaggagacgggcctgccggacgcgcaagaattacttccgccgtcccgcgaacaggaaatcctcccgcgacgaggccgaggtcgacatcttctcgggccatcggacacctggtccccaaaacgggggtttcccg

SEQ ID NO: 30059 - protein, 170 aa, Zea mays
  misc_feature: Ceres CLONE 1405417-F
  misc_feature: SWISSPROT Homolog: EC 2.3.1.119 Icosanoyl-CoA synthase
MSMGSPVQLRRLKPLYQFVVNNILAIVAVPLATAVLLKASSLGPEEILALRPAHLFLAAFLPAAATVLYLMLRPRTVYLVDYACFRTSPNCRVPFATFLEHSRVWPGFDERSVRVMTPLLERSRLREETGLPDAQELLPPSREQEILPRRGRGRHLLGPSDTWSPKRGFP

SEQ ID NO: 30060 - DNA, 577 bp, Zea mays
  misc_feature: Ceres CLONE 1405424-F
  misc_feature: Encodes the peptide sequence at SEQ ID NO. 30061
  misc_feature (52)..(52): n is a, c, t, g, unknown, or other
aaagctggagctccccgcggtggcggccgctctagaactagtggatcccccngggctggcaggaattcgcacgagaccattacctagaacatcctaatcgaaaaaacacaacgcttataatacttacaacaaaagataagcccacgaatcagtagatcgaggtcccgcccagtccagcaaaagcacacacggagatgtcccagctgagctctgctggccacatggctgcgacgttcctcctcatcctcctcgcctccgcagcagcaacggtgtcagctgaccaacaagtctctgcctgccagaatgacatagacgcactgtggcgcagctgcaagcagttcgtccagaaaggagggggccccaaaaaggctccgccgaggattgttaaaaccttagggcttaaaaggaccgggcctgaattgggaaaaaatgggttcccggggcgagaaaaaattaacctgggaagggggttttttttacaaaaaggggggggccccccccccaggggggggggttaaagggggtggaaaggggtgtgtttttgaggggaaaattgttataacacccccgggggtca

SEQ ID NO: 30061 - protein, 107 aa, Zea mays
  misc_feature: Ceres CLONE 1405424-F
MSQLSSAGHMAATFLLILLASAAATVSADQQVSACQNDIDALWRSCKQFVQKGGGPKKAPPRIVKTLGLKRTGPELGKNGFPGREKINLGRGFFLQKGGGPPPRGGG

SEQ ID NO: 30062 - DNA, 668 bp, Zea mays
  misc_feature: Ceres CLONE 1405432-F
tggagctccccgcggtggcggccgctctagaactagtggatcccccgggctgcaggaattcgcacgagaccattacctagaacatcctaatcgaaaaaataattctagtattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaatcaatttcttcgtccgccttcgcccctgcttacgtccccgctactaaccctaggatcattctgtcttttctcgtttcttatccgactcttcttcgttttatgcctatcagttatgaggttgaacgccttcagaagcttctctactagattagtgtaaatagtagacttgttcgagtttagcttggctggaagaattagtctctggtccgtgtttatatctgctagcaataatggctgcgatgaacggagaggtattgggtgaatgtggaaggaaacataatagtctcaagagaaagcgggagagccccgctgcatatgctgctggcgtattctgcacctctg

SEQ ID NO: 30063 - DNA, 690 bp, Zea mays
  misc_feature: Ceres CLONE 1405435-F
  misc_feature: Encodes the peptide sequence at SEQ ID NO. 30064
caaagctggagctccccgcggtggcggccgctctagaactagtggatcccccgggctgcaggaattcgcacgagaccattacctagaacatcctaatcgaaaaagctaggttcctatgcccaaagtcacacagcttcttctccttctacttctccttcctcctctcctcaccggcaccttgatctaatctcttccatcctagcttgctcgccgctgccagtctctcctccgcctgcaacgactcccatgtctcagtcttctcctctcttctccgtcgcccgagcgcacgccggagcaggagggcgagccgtggcagccgctctcctgctccgtcgtcgccccattgcacagctgccgcacagcatccatggcctacggtgtctctctccagccagagcgacaccttccaagacgctcctcagcctcccccgcgccacgctgtcctccttcgccgaccccgacggcgacggcggctccagcgcgaaagccagcgacggcggcgccaaggccggcgccggcggggaggagcaggtcggggaatgcgagatgtcggagatggccagggcgttccacatctcgccacgggtggcgacgtccatctccgtgacgatcgcgttcgccgccctcaccgtgccgctggcgatgcgctcgctggtctgccacgggaccttcaggatgaacgcgctggcg

SEQ ID NO: 30064 - protein, 48 aa, Zea mays
  misc_feature: Ceres CLONE 1405435-F
MSEMARAFHISPRVATSISVTIAFAALTVPLAMRSLVCHGTFRMNALA

SEQ ID NO: 30065 - DNA, 676 bp, Zea mays
  misc_feature: Ceres CLONE 1405437-F
  misc_feature: Encodes the peptide sequence at SEQ ID NO. 30066
aaagctggagctccccgcggtggcggccgctctagaactagtggatcccccgggctgcaggaattcgcacgagaccattacctagaacatcctaatcgaaaaaaacacgcaaaacgtgcttctgtccctctcctgttataatttcgtcttcttccctctcccaccggtgtcctcgcctcgcctatccgatctgccacctcgccgtctcgcacgttcctttccccaactccccagcgcctctccgcgccgcgatccagatccaggttgttcagcatgggtctggtgaaggaaggcgtcgacatggaggagggaaccctagagatcggcatggagtacaggactgtatctggtgtggccgggcctctggttatcttggataaagtaaagggcccaaagtaccaagaaattgtaaacatccgacttggagatggcaccactcgccgtggtcaagtccttgaagttgatggagaaaaagctgttgtgcaggtttttgaaggaacttctggaatagacaacaaatacacaaccgtgcagtttacaggcgaggttttgaaaactcctgtctcactcgatatgcttgggcgcatttttaatggttctgggaaacctattgacaatggccccccgatattacctgaagcctacttggatatctctggaaagtctattaatccca

SEQ ID NO: 30066 - protein, 134 aa, Zea mays
  misc_feature: Ceres CLONE 1405437-F
  misc_feature (24)..(90): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MGLVKEGVDMEEGTLEIGMEYRTVSGVAGPLVILDKVKGPKYQEIVNIRLGDGTTRRGQVLEVDGEKAVVQVFEGTSGIDNKYTTVQFTGEVLKTPVSLDMLGRIFNGSGKPIDNGPPILPEAYLDISGKSINP

SEQ ID NO: 30067 - DNA, 663 bp, Zea mays
  misc_feature: Ceres CLONE 1405441-F
  misc_feature: Encodes the peptide sequence at SEQ ID NO. 30068
  misc_feature (281)..(281): n is a, c, t, g, unknown, or other
  misc_feature (282)..(282): n is a, c, t, g, unknown, or other
  misc_feature (284)..(284): n is a, c, t, g, unknown, or other
  misc_feature (289)..(289): n is a, c, t, g, unknown, or other
  misc_feature (290)..(290): n is a, c, t, g, unknown, or other
  misc_feature (313)..(313): n is a, c, t, g, unknown, or other
  misc_feature (316)..(316): n is a, c, t, g, unknown, or other
  misc_feature (322)..(322): n is a, c, t, g, unknown, or other
  misc_feature (331)..(331): n is a, c, t, g, unknown, or other
  misc_feature (463)..(463): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (484)..(484): n is a, c, t, g, unknown, or other
  misc_feature (513)..(513): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (611)..(611): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
aaagctggagctccccgcggtggcggccgctctagaactagtggatcccccgggctgcaggaattcgcacgagaccattacctagaacatcctaatcgaaaaataacgcaaagattcggctgacaatggggaaggggttcccgtcgtacttggcgatgaagacggggccggagggcggcgacggcgcggcggcggcggcgcagcaggcgctcatcgacgcggacctgcggaacctcggcgtcgccgcgcgaaagctcgccaaccacgccttcgtccctcgnngncgggnntggggttcggcacttcccttccntcnagtggnctggccttncctcgccgcagtggtatctctttgataattggaacccgcccccaaaaactgggggagaaaaaaacccccacatattttgtgggggtggggaaaacacccgcccccccctccctttggggggggggggtcccncccccccttcttctcnnnaantttttatatttttttttccttcccccccncccccaannnnccccccccccgaccgcggggaggggggnnnnnacccggcggggggggtcttcggtggcggtcttnnntttttgtgggttttctttgnaaacagccgggnnnnccgcccggnnncccggggggggggnnntgggaggggg

SEQ ID NO: 30068 - protein, 76 aa, Zea mays
  misc_feature: Ceres CLONE 1405441-F
  misc_feature (53)..(53): Xaa is any aa, unknown, or other
  misc_feature (55)..(55): Xaa is any aa, unknown, or other
  misc_feature (63)..(63): Xaa is any aa, unknown, or other
  misc_feature (64)..(64): Xaa is any aa, unknown, or other
  misc_feature (66)..(66): Xaa is any aa, unknown, or other
  misc_feature (69)..(69): Xaa is any aa, unknown, or other
MGKGFPSYLAMKTGPEGGDGAAAAAQQALIDADLRNLGVAARKLANHAFVPRXRXWGSALPFXXVXWPXLAAVVSL

SEQ ID NO: 30069 - DNA, 749 bp, Zea mays
  misc_feature: Ceres CLONE 1405443-F
  misc_feature: Encodes the peptide sequence at SEQ ID NO. 30070
  misc_feature (472)..(472): n is a, c, t, g, unknown, or other
  misc_feature (733)..(733): n is a, c, t, g, unknown, or other
caaagctggagctccccgcggtggcggccgctctagaactagtggatcccccgggctgcaggaattcgcacgagaccattacctagaacatcctaatcaaaaattccctccctagcccagccagggaaccagtctcagtgaatcccgcgcccggatcaatctcgcccaaggaagcagctcttcacgacttgcttccagatccatccatccatccatccgaggttgggccgtgggggtgtcggtgcggtgggaaatggggaaggggatcagcggcgacgcccgcctcgcctcggcgccttacgaccagtgggtgctgctgagccccgccgggggctcgccgcgcccgcccgcgcgctacaagcatgctgcccaagtggttcaagacaagctgtacgttgtcggagggagtcgcaacggccgttctctatcggacgtccaggtttttgattttaagacatcctcttggtcagcngtaagccctgctagaggctcaaaacatccccacccatgaaatgatgccacagggtggatcgttcccagcattagcaggccacagtatggtcaagtggaaaactatctcctgggcgtagctgggagcacaaggtcgtcatcatcattaaataaggtttcagtttggcttattgatgtgcaagccaatagctgggctgctgttgaaacttatggaaaagtccaacagctcgagatggccatcagtatccatacttgttctcgnatactgatgtttgggg

SEQ ID NO: 30070 - protein, 85 aa, Zea mays
  misc_feature: Ceres CLONE 1405443-F
  misc_feature (33)..(78): Pfam Name: Kelch_1 Pfam Description: Kelch motif
MGKGISGDARLASAPYDQWVLLSPAGGSPRPPARYKHAAQVVQDKLYVVGGSRNGRSLSDVQVFDFKTSSWSAVSPARGSKHPHP

SEQ ID NO: 30071 - DNA, 756 bp, Zea mays
  misc_feature: Ceres CLONE 1405446-F
  misc_feature (555)..(555): n is a, c, t, g, unknown, or other
  misc_feature (556)..(556): n is a, c, t, g, unknown, or other
aaagctggagctccccgcggtggcggccgctctagaactagtggatcccccgggctgcaggaattcgcacgagaccattacctagaacatcctaatcgaaaaattgttttgggtccggaaaataaaatccaattttctcagtctcgagcgcccgcgtccctcgccccgtcccagcctcccagccgtcccggctccccgcgaccccgccctccggcagtccggcgcgggggctcctctccgatccggtgagccgaacgaggatcccaactccccgaagaaagcggccacagccagagccagggtggctcggctctcctctcacagactgcgccgcagcgcctagcgctcggctggcagccgctccggccggtcggccccgcgcccccgcccctgctgcctacatccgcctgcagccagaagatctgcctccagcgaccgccctgcctgccccttgtggcttctgtggttctgcacaccagcacacgcacttgtccccaaacaacggcggcggcgatgagtatctcagaagagcttcccggcgaaggatctgacggnngaggaggaggtcttcatcaacgaggaggacatcatccacgagataacccatcgacgaagaagatctccccgaccgcgacgacaaaaatgacgacgtcgtccacggggatggttgatttccgaagacgtcgatgattctacttacgcatttcaggcccaccaagatggagtcttcattgggcgcctgcagtcctacagatt

SEQ ID NO: 30072 - DNA, 752 bp, Zea mays
  misc_feature: Ceres CLONE 1405447-F
  misc_feature (1)..(1): n is a, c, t, g, unknown, or other
  misc_feature (729)..(729): n is a, c, t, g, unknown, or other
nccaaagctggagctccccgcggtggcggccgctctagaactagtggatcccccgggctgcaggaattcgcacgagaccattacctaaacattctaatcgaaaaaacaacccttgtagcctcagtcaatctgaagattgagactactatgaggctgtcaccgctcgtactcctcctccccgccggccgtggttagaactagggatacggagcatgcggtggtggccgtgttggtgtcttctccgatgctggattcgtccacttcgtacgacatcccctgagaagaggtgggacccagactcagggtggatctcctctacgagaagggactgtaccgcatcgactactggtagcgctgcacccgctcccgcatgcgcagccgcgagcgccagagcatgttgcttagatcggcttgaaggcagaggatccggagctggcgccagagctggatgagccttgtgtgttctgagtttccgccatcagcgaagggagttggcaccagcaaggttggcgatgatgaagatctcagaagagcttcccggagaaggatctgaaggagatgagtagtacttcctcgaggaggactaatcgtccgggaagagtcatgggagaagaaaacctccccgaccgagacaacgaagactgtcaatgtcggcagcgggatggtttatttctcgaaaaaatatgggatctggcctaggaaatagtctagtcaacatgggggaaaagngggggggggcgctgggggtttag

SEQ ID NO: 30073 - DNA, 768 bp, Zea mays
  misc_feature: Ceres CLONE 1405449-F
  misc_feature (433)..(433): n is a, c, t, g, unknown, or other
  misc_feature (434)..(434): n is a, c, t, g, unknown, or other
  misc_feature (542)..(542): n is a, c, t, g, unknown, or other
  misc_feature (546)..(546): n is a, c, t, g, unknown, or other
  misc_feature (656)..(656): n is a, c, t, g, unknown, or other
  misc_feature (693)..(693): n is a, c, t, g, unknown, or other
  misc_feature (702)..(702): n is a, c, t, g, unknown, or other
  misc_feature (708)..(708): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (716)..(716): n is a, c, t, g, unknown, or other
  misc_feature (724)..(724): n is a, c, t, g, unknown, or other
  misc_feature (725)..(725): n is a, c, t, g, unknown, or other
  misc_feature (727)..(727): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (738)..(738): n is a, c, t, g, unknown, or other
  misc_feature (739)..(739): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (748)..(748): n is a, c, t, g, unknown, or other
  misc_feature (755)..(755): n is a, c, t, g, unknown, or other
  misc_feature (756)..(756): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (765)..(765): n is a, c, t, g, unknown, or other
aaagctggagctcaccgcggtggcggccgctctagaactagtggatcccccgggctgcaggaattcgcacgagaccattacctagaacatcctaatcgaaaaatgaacagcaaagcagcggccgaatagtataggcctgttccctcactccccagattccccttttcatagctctatatacctctccttctcgtcgtctctctatcccgcatctgctgttctttatttctatacatacatatatactatcaccggttatttgcttctctattctgtccgagtactttacggtgttccgcacatagatctcgtgggccggcggttttgcgctttcgcttgcgtttcttggccctgctggtgtttgaccggaccgaacgggggcagatcgatgctttgggtttgaagcggagctcctatcattccaatgaagggnncgttccgaagggctggttccgctgctcgttcatggttcccactatcctatctcatcatgtgtatatatgtaatccattggggggagggtttctctcgtctttgagatnaggnttgtggtttgcatgaccgaggagctgcaccgcccccttgctggccgctctttggattgaagggagctctgcatcctgatccacccctccattttttttttgttggtgggnccttcctggggactgaaatctggaggttcgggggggntcattggancctcgntannnngntttttttnncntctcctnnncnncnnnggggnaatttgnngnnnncccnaaa

SEQ ID NO: 30074 - DNA, 733 bp, Zea mays
  misc_feature: Ceres CLONE 1405452-F
  misc_feature: Encodes the peptide sequence at SEQ ID NO. 30075
tggagctccccgcggtggcggccgctctagaactagtggatcccccgggctgcaggaattcgcacgagaccattacctagaacatcctaatcgaaaaaatctgaagcaaaatgtaccgggaatgttgaagagcgggactcttaagcagtatgagatgcggcggtggtggtcgccggcgttggcggctgtggagccgcggtccgcggagctcctgctcctgggcgcccctctccgcgcagcttctttgtacgccgggaccctcttcggctcctccgcgtcccctgcgctcgcactgcccccttcgcgcccccgatcggccgattccttcagggccaaagttaccgatgctccagtgcttaccaacggagtttctcggacgtaccgggcaagatcagtgacagttccagatcacggagttgatgtgtgtcctttggaatacaatgagtatgtcccctgccatgatggagcctatataagcagcttgaagagcctggatacatctaggcatgaggatcttgaaagtatttgtcctccatgggagaagcggttgttttgtttggtgccccctcccaatgactaccagataccaataagatggccaaccagccgagactacgtatggcgtagtaatgtcaaccattcacatcttgctgaggtcaaaggaggacagaactgggtgcatgagaagggccaactttggtgggttccctggaggtggcactcacctcaacat

SEQ ID NO: 30075 - protein, 193 aa, Zea mays
  misc_feature: Ceres CLONE 1405452-F
MRRWWSPALAAVEPRSAELLLLGAPLRAASLYAGTLFGSSASPALALPPSRPRSADSFRAKVTDAPVLTNGVSRTYRARSVTVPDHGVDVCPLEYNEYVPCHDGAYISSLKSLDTSRHEDLESICPPWEKRLFCLVPPPNDYQIPIRWPTSRDYVWRSNVNHSHLAEVKGGQNWVHEKGQLWWVPWRWHSPQH

SEQ ID NO: 30076 - DNA, 740 bp, Zea mays
  misc_feature: Ceres CLONE 1405455-F
  misc_feature: Encodes the peptide sequence at SEQ ID NO. 30077
  misc_feature (322)..(322): n is a, c, t, g, unknown, or other
  misc_feature (418)..(418): n is a, c, t, g, unknown, or other
  misc_feature (426)..(426): n is a, c, t, g, unknown, or other
tggagctccccgcggtggcggccgctctagaactagtggatcccccgggctgcaggaattcgcacgagaccattacctagaacatcctaatcgaaaaatctgtctatcttgatctcatctcctatcttcttcctcctagattctttcttccgcgcgccctctctctctctctccttcctgccttctgcctgcgggcggcccatgtccgtggcgcccctcctgccctgcgagctgcttctccagcgaaaaggttgctgcgccttgacgcaccaccgatccaccgccgcccaacccgagcgttctgtccggcagctaggtacgnagctgcgcggtggctgcgaccggaagcagggaggggaacagggcagcgaacgccgggcgattgccttgacttgcctgtgtgctccgcccggagcgnagtttggnccggtcgttccattgcaatggatgacaaggaacttatctcacagtcccgacctggcagtcattctaccagcagcagcagcagcaccacggggccttccggggggggggggggggggcaacatagcccggtcctcgcttggccgggaatgcacttccgtctttcgccccatgcccaacatgaacatgagccccgtcggcgatccttaactcctatcggcggggggtctttcaccgggaatggaagtcccaatggaccccgccgcgccaccattgctgcacacggccgccatgggggcctcgggtcctactccccc

SEQ ID NO: 30077 - protein, 61 aa, Zea mays
  misc_feature: Ceres CLONE 1405455-F
MTRNLSHSPDLAVILPAAAAAPRGLPGGGGGGNIARSSLGRECTSVFRPMPNMNMSPVGDP

SEQ ID NO: 30078 - DNA, 780 bp, Zea mays
  misc_feature: Ceres CLONE 1405456-F
  misc_feature: Encodes the peptide sequence at SEQ ID NO. 30079
  misc_feature (334)..(334): n is a, c, t, g, unknown, or other
  misc_feature (465)..(465): n is a, c, t, g, unknown, or other
aaagctggagctccccgcggtggcggccgctctagaactagtggatcccccgggctgcaggaattcgcacgagaccattacctagaacatcctaatcgaaaaaccctcccgcaccgcccttgctcacaatgaacaccaaagccacctctgacagacagctgctctatttctgaaatgatggcttgatgctgcgatgcctcgcgggaggcagcccatgaacacacagagccagatatatgctaacgactgcgctgatagagctgatgcaccgcgccatcgctgacatgagctgacctgcgtcgtctcagaccagcaggtgctcacgcagttgcgnctgctgctccctacccctcccccttgcttgaccaggacaagatgctcatggtctccaaggcgtgtcagacattgcactcaggctgggaattttggaggccccagccgaacaagctttcccgggtggccagnaccaaaatgcatgttactccctcccaagggaaggacttggaccacccgggtctgaaattcaagacccccatggcaaggcccccataaccttcaggcgggtttttttcaaaaggaaaagagttagaacttcccaaaaaaggggggtgggggcccttcggtttaaagggtaccaaaaggaaaactggcccaaaacccgggaaaaagccccaggggtttggaaaaaaaggggggggggccccccagaagaaaaggggtgaaaacaaaagattggggggggggcaaaaaaaaaaaaaccgttagtttaaaaaaacgggg

SEQ ID NO: 30079 - protein, 58 aa, Zea mays
  misc_feature: Ceres CLONE 1405456-F
  misc_feature (30)..(30): Xaa is any aa, unknown, or other
MLMVSKACQTLHSGWEFWRPQPNKLSRVAXTKMHVTPSQGKDLDHPGLKFKTPMARPP

SEQ ID NO: 30080 - DNA, 752 bp, Zea mays
  misc_feature: Ceres CLONE 1405458-F
  misc_feature: Encodes the peptide sequence at SEQ ID NO. 30081
  misc_feature (130)..(130): n is a, c, t, g, unknown, or other
  misc_feature (377)..(377): n is a, c, t, g, unknown, or other
  misc_feature (508)..(508): n is a, c, t, g, unknown, or other
  misc_feature (509)..(509): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (730)..(730): n is a, c, t, g, unknown, or other
aaactggagctccccgcggtggcggccgctctagaactagtggatcccccgggctgcaggaattcgcacgagaccattacctagaacatcctaatcgaaaaacacacactctaatctctccacacagccnacacagatacggacaggacaggaggatgaagctgggagcaaaaggcctcggcctcctgctcctccttgtcctgcttgcgctttgctccaccattgaagtcggcgaggcaagaagagaccggcattggaggtcgtcgaggacctcctcctctcagctgctgaagaaaggcaaaggaaagaagaccagctcccgccgccaatacggcagcaaccggccaagtccgaagccaccggccagctcgaaccgnagcttctggtgccggcggcaaaggaaaccagactccgtaccaaccaagcccgaatgcccctcacatcccgaggccaagcccccctgccaatggcagcgcccattccactcccaagccgccgactcctccanngctgcgtaaggctcatcagcagccatcacagtcacagccgccaccaccagaacctcctcgannnnatggtgcatatttcaatggttggttgattttggagccagggggtgacggagttacagacgatactaaggcttttccaaggagcgtgggctgctgcctggcacccagggggcatctacacttctcgtacacccagactagagggttccttggtgggncaaatctcgttctctgggccta

SEQ ID NO: 30081 - protein, 120 aa, Zea mays
  misc_feature: Ceres CLONE 1405458-F
  misc_feature (118)..(118): Xaa is any aa, unknown, or other
MKLGAKGLGLLLLLVLLALCSTIEVGEARRDRHWRSSRTSSSQLLKKGKGKKTSSRRQYGSNRPSPKPPASSNRSFWCRRQRKPDSVPTKPECPSHPEAKPPCQWQRPFHSQAADSSXAA

SEQ ID NO: 30082 - DNA, 813 bp, Zea mays
  misc_feature: Ceres CLONE 1405459-F
  misc_feature: Encodes the peptide sequence at SEQ ID NO. 30083
  misc_feature (304)..(304): n is a, c, t, g, unknown, or other
  misc_feature (355)..(355): n is a, c, t, g, unknown, or other
  misc_feature (414)..(414): n is a, c, t, g, unknown, or other
  misc_feature (422)..(422): n is a, c, t, g, unknown, or other
  misc_feature (424)..(424): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (460)..(460): n is a, c, t, g, unknown, or other
  misc_feature (462)..(462): n is a, c, t, g, unknown, or other
aaagctggagctccccgcggtggcggccgctctagaactagtggatcccccgggctgcaggaattcgcacgagaccattacctagaacatcctaatcgaaaaaaaggtggcaggcacagagagagctagctttggccaggcgtccacagcagccagcacaagatgtcgacggtggtcatgggggtggatcttgagtgccacaagtgctacaagaagatcaggaaggtcctctgcaaggtccaagacaaggtgagcatcaggaccatctcctacgacgagaagaacaacacggtgacggtgtccnggcccttcgacgccgaggaggtcgccgacaggctcaccgccgacgccggcnaggtcatcacgacatacacggtcgttcgggggctttcggcttcgggtttgggcgggggncgggagcngnaagcnnnagggaaaacaacagagcacgggggccggngnttcccggcccggccaaaggcccaatccttggtggcaacaattcctgggcaccttctttccggggccgaagaaagccgccatggacccccgtcccccacatggggggtaaacccccgctcggggggccccaaaccggaaaataacccacccccctgggaggcaaaaaaagggcccccgggttcggggaaataaacctactccccccgaaaaaatcccccccccttccccgaatgggggcccctccccctccccccctacaaaaaaaaacccccggggggtggggccggggcccccctataagggggggaaaaaatcttccaaaaaaataaaaaaacctctggggcgcacccg

SEQ ID NO: 30083 - protein, 163 aa, Zea mays
  misc_feature: Ceres CLONE 1405459-F
  misc_feature (48)..(48): Xaa is any aa, unknown, or other
  misc_feature (65)..(65): Xaa is any aa, unknown, or other
  misc_feature (87)..(87): Xaa is any aa, unknown, or other
  misc_feature (88)..(88): Xaa is any aa, unknown, or other
  misc_feature (90)..(90): Xaa is any aa, unknown, or other
  misc_feature (100)..(100): Xaa is any aa, unknown, or other
MSTVVMGVDLECHKCYKKIRKVLCKVQDKVSIRTISYDEKNNTVTVSXPFDAEEVADRLTADAGXVITTYTVVRGLSASGLGGGREXXAXGKTTEHGGRXFPARPKAQSLVATIPGHLLSGAEESRHGPPSPTWGVNPRSGGPKPENNPPPWEAKKGPPGSGK

SEQ ID NO: 30084 - DNA, 765 bp, Zea mays
  misc_feature: Ceres CLONE 1405460-F
  misc_feature: Encodes the peptide sequence at SEQ ID NO. 30085
  misc_feature (635)..(635): n is a, c, t, g, unknown, or other
  misc_feature (637)..(637): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (726)..(726): n is a, c, t, g, unknown, or other
caaagctggagctccccgcggtggcggccgctctagaactagtggatcccccgggctgcaggaattcgcacgagaccattacctagaacatcctaatcgaaaaacattagattttttgtatgaaacgcccgcaaccgacttgctcctcaagcctccctgcctgccagctcactcgccttcttcctcccattcccctcgaatcaaccagcagcgattcagatcgaaacgaaacgaaccaaaccaaccaactcgccaccctccaaagccgcagccccaatcccaccgccggccaggcaggcagagcgcgccccgcgccatgtcagccacgtcgtcgttcacagcgggggagtcgtctcgagctggcgagcaaccggagcgcgacgaggtggtcgagttcctggactgcccttgggtagcactctcctccgccatcgtcgtcatcggcgccaacgacgagcggggcacggatgctcgcgcccggtgcctccgacatctttctcgacctcagccccccgctggtcggcgcctcctatctggtcctgcccgagcgcatcgtcgcgcactacaagggtattcaggcttaccaccccctgcgtcttgtccgcctgctccaactgcctcctcttcctggtatncnaaaacgccgagggcgtctcggaacccggccttctttcctcggaacgcccnnnnccggaacgtctcgnnnnntctttcccgaggtcccgnccccccatctcggggttcaacattcatccggggaaaaga

SEQ ID NO: 30085 - protein, 149 aa, Zea mays
  misc_feature: Ceres CLONE 1405460-F
  misc_feature (107)..(107): Xaa is any aa, unknown, or other
  misc_feature (124)..(124): Xaa is any aa, unknown, or other
  misc_feature (125)..(125): Xaa is any aa, unknown, or other
  misc_feature (130)..(130): Xaa is any aa, unknown, or other
  misc_feature (131)..(131): Xaa is any aa, unknown, or other
  misc_feature (137)..(137): Xaa is any aa, unknown, or other
MSATSSFTAGESSRAGEQPERDEVVEFLDCPWVALSSAIVVIGANDERGTDARARCLRHLSRPQPPAGRRLLSGPARAHRRALQGYSGLPPPASCPPAPTASSSWYXKTPRASRNPAFFPRNAXXRNVSXXLSRGPXPPSRGSTFIRGK

SEQ ID NO: 30086 - DNA, 735 bp, Zea mays
  misc_feature: Ceres CLONE 1405461-F
  misc_feature: Encodes the peptide sequence at SEQ ID NO. 30087
  misc_feature (420)..(420): n is a, c, t, g, unknown, or other
aaagctggagctccccgcggtggcggccgctctagaactagtggatcccccgggctgcaggatttcgcacgagaccattacctagaacatcctaatcgaaaaacgcacctagggttttcgcgccgccgccgcagccgcaacaatgccgtcgcacaagaccttccggatcaagaagaagctggcgaagaagatgcgccagaaccgccccatcccctactggatccgcatgcgcactgacaataccatcaggtacaacgcccagcgcaggcacttggcgccgcaccaagctcggcttctgagcgtcgggattggccggctgctgcgtcggaaggctagggtctaaagctatcttctgtttatcattgtctctgtttctgaagctagcaagtgatgctgtgatgcttttattaagatctgagnagtggtgacgttaaagaaaaatggcaggactgtgttgtaccccaagattcctgcagcatgctattgtagtaacgaacctttactattataaatggaggggtggcagaaaaaaaaaaaaaaaggtatcgtacgtcaaccctcgagggggggcccggaaccatttgccctaaagggggcggaataccgggtccctggggcgggttttcaaagggggggagggaaaacccgggggtaccaatttaaccctgtggaaaacccccttttcgaaggggaaaataaaaaaagggccccacaattgcccctcaaagggggggc

SEQ ID NO: 30087 - protein, 66 aa, Zea mays
  misc_feature: Ceres CLONE 1405461-F
  misc_feature (9)..(46): Pfam Name: Ribosomal_L39 Pfam Description: Ribosomal L39 protein
MPSHKTFRIKKKLAKKMRQNRPIPYWIRMRTDNTIRYNAQRRHLAPHQARLLSVGIGRLLRRKARV

SEQ ID NO: 30088 - DNA, 737 bp, Zea mays
  misc_feature: Ceres CLONE 1405462-F
  misc_feature (429)..(429): n is a, c, t, g, unknown, or other
  misc_feature (479)..(479): n is a, c, t, g, unknown, or other
  misc_feature (525)..(525): n is a, c, t, g, unknown, or other
  misc_feature (526)..(526): n is a, c, t, g, unknown, or other
  misc_feature (586)..(586): n is a, c, t, g, unknown, or other
  misc_feature (602)..(602): n is a, c, t, g, unknown, or other
  misc_feature (628)..(628): n is a, c, t, g, unknown, or other
  misc_feature (634)..(634): n is a, c, t, g, unknown, or other
  misc_feature (635)..(635): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (658)..(658): n is a, c, t, g, unknown, or other
caaagctggagctccccgcggtggcggccgctctagaacaagtggatcccccgggctgcaggaattcgcacgagaccatttacctaaaacatcctaatcgaaaaaaggaaccaaacagcgcaacacacgaacacaccaggcggcaggctccaccccgtccttttcctgccttttccccccgtcgagttaatccatccagtcgccaaaagctttgctaaatttcacgtgtctcgcctcgagtcgtccctaatccgacgatgccttgttctactcctaaaaaaacccaaagatcctgactttctcttgctgctagcctcccttttcccttctcccttaatcgcactgtgaaggcctcttcgctgtcacccccacccacctccggcgctcttttttagcattttccttgggctctggactccaaatcccagnccttttgtttgcttctctgtctcctgcctgattggtgtccccgggtccgnaactcttgattgctccttcgcggggggggttcggtcccatggcggnngctgcgctgcatggcaaaaaccaggttgtggcgagctcccaagtgagggtgaaaacgccnccctcattctgcgcgnaagtgccccccgtgaaatgcccgcanaaatgnncgcgnnnctggaaaaaggacggngggaagcagggtcaagatgctcctctcctacgtcgaaagctcccacagggggaaaaaggaagaatatttctatgattgg

SEQ ID NO: 30089 - DNA, 758 bp, Zea mays
  misc_feature: Ceres CLONE 1405467-F
  misc_feature: Encodes the peptide sequence at SEQ ID NO. 30090
  misc_feature (335)..(335): n is a, c, t, g, unknown, or other
  misc_feature (543)..(543): n is a, c, t, g, unknown, or other
  misc_feature (553)..(553): n is a, c, t, g, unknown, or other
  misc_feature (559)..(559): n is a, c, t, g, unknown, or other
  misc_feature (561)..(561): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (756)..(756): n is a, c, t, g, unknown, or other
aagctggagctccccgcggtggcggccgctctagaactagtggatcccccgggctgcaggaattcgcacgagaccattacctagaacatcctaatcgaaaaacactttattctttcttcagcctagtccgactaccgactaagaccgactcagctccggcgaccctcaaaccgcaccagccatggacgggccgcgttggacggaagaggtggacgacctggtcgacgccggcgacgtcgacggcgccatcgccctccttgagtccgtcgtctccgatttgtcaacctccgctgctccccctgccactgaccttcgcctcgccacggcgctcgggnaacctcgcgggcctgcacgcctcccggggagacaccctccgagccgacgagctccgcgcccgcgcttccgcccttcggccccgcgccacggtccccctgggactggacccctaaagggatttcaggagctggtcagagaaatggtccatcacaagagtggggcaacgggttcaaaggaactcaggaagtctcagctaatactaataanagcaatgaanatggangnagggatggattggggaggctatgggnnnaaatagtggtgccccttgatggacacactaagtgcgctctcttgagcaaggggagctagagtatcttctttgcagctcccccgaaaaaagtagaccccatctcaggcccaaaaagggggggggggggaggggctcattctttccaaaaaaaaagtgtttgacggggncc

SEQ ID NO: 30090 - protein, 137 aa, Zea mays
  misc_feature: Ceres CLONE 1405467-F
  misc_feature (52)..(52): Xaa is any aa, unknown, or other
  misc_feature (121)..(121): Xaa is any aa, unknown, or other
  misc_feature (124)..(124): Xaa is any aa, unknown, or other
  misc_feature (126)..(126): Xaa is any aa, unknown, or other
  misc_feature (127)..(127): Xaa is any aa, unknown, or other
  misc_feature (136)..(136): Xaa is any aa, unknown, or other
MDGPRWTEEVDDLVDAGDVDGAIALLESVVSDLSTSAAPPATDLRLATALGXPRGPARLPGRHPPSRRAPRPRFRPSAPRHGPPGTGPLKGFQELVREMVHHKSGATGSKELRKSQLILIXAMXMXXGMDWGGYGXK

SEQ ID NO: 30091 - DNA, 773 bp, Zea mays
  misc_feature: Ceres CLONE 1405471-F
  misc_feature: Encodes the peptide sequence at SEQ ID NO. 30092
  misc_feature (252)..(252): n is a, c, t, g, unknown, or other
  misc_feature (320)..(320): n is a, c, t, g, unknown, or other
  misc_feature (331)..(331): n is a, c, t, g, unknown, or other
  misc_feature (406)..(406): n is a, c, t, g, unknown, or other
tggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcgncgtggagccgtcgggcccggacgccggctcgccggcctttctcgtgcgcgtggcgcgccgcctggcgnacttcctgcangtcgtgaacctcagtacgtgcgcctcgggtaccactacttcatcagccacggggggtacctggccacatccccgnattgggggctggtggcgggcgcccaaattggccaccctcaccccgaaaacttggggcaaagggggggggggaagcccatataagacctcgccccgggggttggctttccggggggcctcggcttaacaatttccgctgaaaataaggcggggccaaggccgcgggacccctacaaatttccaggggaaaaagccgggcggagaatttaggggggcccaggggggggtttctctcccctgggggggaatccccgaaaattcaaaagaggcaacgcggggggtccccccgcgggggtgggggggcaacccgctttttgggaaaaaaaataaaatcggccgggggtggtgggacccaccccacaccgggg

SEQ ID NO: 30092 - protein, 109 aa, Zea mays
  misc_feature: Ceres CLONE 1405471-F
  misc_feature (17)..(17): Xaa is any aa, unknown, or other
  misc_feature (40)..(40): Xaa is any aa, unknown, or other
  misc_feature (43)..(43): Xaa is any aa, unknown, or other
MAREEQALLSTEIVNRXVEPSGPDAGSPAFLVRVARRLAXFLXVVNLSTCASGTTTSSATGGTWPHPRIGGWWRAPKLATLTPKTWGKGGGGSPYKTSPRGLAFRGASA

SEQ ID NO: 30093 - DNA, 748 bp, Zea mays
  misc_feature: Ceres CLONE 1405472-F
  misc_feature: Encodes the peptide sequence at SEQ ID NO. 30094
  misc_feature (404)..(404): n is a, c, t, g, unknown, or other
  misc_feature (491)..(491): n is a, c, t, g, unknown, or other
  misc_feature (523)..(523): n is a, c, t, g, unknown, or other
  misc_feature (525)..(525): n is a, c, t, g, unknown, or other
  misc_feature (605)..(605): n is a, c, t, g, unknown, or other
  misc_feature (702)..(702): n is a, c, t, g, unknown, or other
tggagctccccgcggtggcggccgctctagaactagtggatcccccgggctgcaggaattcgcacgagaccattacctagaacatcctaatcgaaaatccaacctgttccgatccgccccgagccggctggccatggcgatcagggctggccgctcggccctccacctccacgctctcgctttcctcatcctcgccgcctccccctgcctccaagtccaagctctagtggaccatcgcaaacaggtatctgactggggtaggcaacccaactttgaactgcagaatatgtcctcgagtcaaagggatggctctcatctcttgggcagatcaaaggaaataacacacaggaaactaaggggggggaattgggtgtaaggaaacaaaatggaagtagtgcagcagngatgaatgaagcattagttaaacttgagaaacacaggtattgaacgctcaaaagctgtggattcctgcagtgctgggaaaataagantcctgggagacgtgaaaatgaaaatgagaggngnaatttcaagggtttcgcttggatgcgagatcaaaatgatcatggcagaaaaataattttctgttcttgccaaatctaggnaacaaacttgatctcttatcaggagctgctagcaagactcaaggaaagcagcgctcccccttgggggaggctactgctgatgcgaacatttccgaangagtgcttcagatagaatcaagcaaagggggccagtttacaaagga

SEQ ID NO: 30094 - protein, 80 aa, Zea mays
  misc_feature: Ceres CLONE 1405472-F
MAIRAGRSALHLHALAFLILAASPCLQVQALVDHRKQVSDWGRQPNFELQNMSSSQRDGSHLLGRSKEITHRKLRGGNWV

SEQ ID NO: 30095 - DNA, 766 bp, Zea mays
  misc_feature: Ceres CLONE 1405473-F
  misc_feature: Encodes the peptide sequence at SEQ ID NO. 30096
  misc_feature (368)..(368): n is a, c, t, g, unknown, or other
  misc_feature (378)..(378): n is a, c, t, g, unknown, or other
tggagctccccgcggtggcggccgctctagaactagtggatcccccgggctgcaggaattcgcacgagaccattacctagaacatcctaatcgaaaaacacaccacagcactaaagtctattcatctctggctccccaaattcagctggagagcactttttcccatcatggataagaactacggtgaactctacaacatcctcggatggggtgaggagtacttcgcggtgaacacggaggggcacctcagcgtgaagcctttcggccgctggacggagcccgggcaggagatcgacgtgcactcggtcatcgtggaagctctagcgacccacccaacgacagcacagcaaatctcagttccccatgantcttcgcttnccccgacgtgctcagaccgtatcgagacgcttcataacgcattcaaaggggcctgaagtccacggggtaccggtccggtaacccagggggggttcccgattaaggggaaccaaaaaaacccgtcggggagaaatggggttaggttccccaaaagggaatatggggttaggggggggctccaccaaaaaatgttttccccgtaggggtccccccccctccaaaaagcgccccaccgggttttttttttttggggttaaagggggggggaattttacggggtgtttttcgggggggggggggggggacacccctttgggggggagaagggagaggggtttctctccctccccccaaaaaaaaagtgggaaaagatccccaaacatccgcg

SEQ ID NO: 30096 - protein, 88 aa, Zea mays
  misc_feature: Ceres CLONE 1405473-F
  misc_feature: SWISSPROT Homolog: EC 4.1.1.19 Arginine decarboxylase
  misc_feature (67)..(67): Xaa is any aa, unknown, or other
  misc_feature (71)..(71): Xaa is any aa, unknown, or other
MDKNYGELYNILGWGEEYFAVNTEGHLSVKPFGRWTEPGQEIDVHSVIVEALATHPTTAQQISVPHXSSLXPTCSDRIETLHNAFKGA

SEQ ID NO: 30097 - DNA, 731 bp, Zea mays
  misc_feature: Ceres CLONE 1405475-F
  misc_feature: Encodes the peptide sequence at SEQ ID NO. 30098
  misc_feature (312)..(312): n is a, c, t, g, unknown, or other
  misc_feature (322)..(322): n is a, c, t, g, unknown, or other
  misc_feature (385)..(385): n is a, c, t, g, unknown, or other
  misc_feature (432)..(432): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (582)..(582): n is a, c, t, g, unknown, or other
  misc_feature (583)..(583): n is a, c, t, g, unknown, or other
aaagctggagctccccgcggtggcggccgctctagaactagtggatcccccgggctgcaggaattcgcacgagaccattacctagaacatcctaaaaaaaaaagttcccgtcttcggtcttcccaaacccccaacatccatgatccatctcatcgacaccccctccgctctccttatcccttccattcgcccaaacccccgccgccgtgacccctgccagcccgcggccttcccctcgttctaggcttcaactgccggcctcgtgtcttctgggcaagtgaagagagagatggcgtcgccaataccgcgcgnagtgggtcgngtctgcagcagtttcctccggccacccagaccgagctgcacgagctcctcggcagctcaaggnaggaggatgtgagcacattgacaatttctggtgatgggataaggcgnannntgggggaaagtcatctactggtaactccatcgtcggggtgagaggatcgccactgtcagcgctttccaagtctgagggtctgagaccgatgaatgtggtcgcgcaaaaagggcagggttcaccttgacattatcgacactctgggnnttaattggaggtggaacatttatggagcaggctgttgacatcattaagagattcctctggcaaaaaataatgatgttctcctggattgggggacctttggatgcgaacgaaaggatccctttgatgggacgggttataaagccttccc

SEQ ID NO: 30098 - protein, 42 aa, Zea mays
  misc_feature: Ceres CLONE 1405475-F
MEQAVDIIKRFLWQKIMMFSWIGGPLDANERIPLMGRVIKPS

SEQ ID NO: 30099 - DNA, 743 bp, Zea mays
  misc_feature: Ceres CLONE 1405476-F
  misc_feature (396)..(396): n is a, c, t, g, unknown, or other
caaagctggagctccccgcggtggcggccgctctagaactagtggatcccccgggctgcaggaattcgcacgagaccattacctaaaacatcctaatcgaaaaacacgaacacaacagcacagcctctctctcctctactaaacttgttttttccgttcatccatccatacgtttcgtttgttccacctgcgcaactgcgacggggataagtacgtcttccagatgacgacggtggcatggacgcgtgcacgcttcctcgtcctcccccagcctggattcctccgctcggtctgccacggcctctgacgcctgctgtctcttctgcttcctgctgctcctcgccttcgcctgagctcagctccggaaggggggggggggcccacagcttgctgggntttcaacgaggacctccccttcccctcgaaacagggtaccgtggaaaatgggagggaggacccccgccggggaactcttctactaattcctccagaggcgagtcccggggcccccacccccccccccaatgaacccccttttctctttctgggtctacggggggcgaaccgcttgtttccgcttttagggggctccgcttaaaaaaatcgggccccattaagaattctgcctgggaaacctacaaaggggcccttggccggggccgggattaaaaccaaaaattcgtggggcaaaggggcaaataaccccctttcgcgaaatcccccgtttggaagttgggtttttc

SEQ ID NO: 30100 - DNA, 742 bp, Zea mays
  misc_feature: Ceres CLONE 1405480-F
  misc_feature (236)..(236): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (337)..(337): n is a, c, t, g, unknown, or other
  misc_feature (339)..(339): n is a, c, t, g, unknown, or other
  misc_feature (340)..(340): n is a, c, t, g, unknown, or other
  misc_feature (342)..(342): n is a, c, t, g, unknown, or other
  misc_feature (343)..(343): n is a, c, t, g, unknown, or other
  misc_feature (348)..(348): n is a, c, t, g, unknown, or other
  misc_feature (364)..(364): n is a, c, t, g, unknown, or other
  misc_feature (365)..(365): n is a, c, t, g, unknown, or other
  misc_feature (370)..(370): n is a, c, t, g, unknown, or other
  misc_feature (371)..(371): n is a, c, t, g, unknown, or other
  misc_feature (428)..(428): n is a, c, t, g, unknown, or other
  misc_feature (603)..(603): n is a, c, t, g, unknown, or other
  misc_feature (625)..(625): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (668)..(668): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (712)..(712): n is a, c, t, g, unknown, or other
  misc_feature (713)..(713): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
aagctggagctccccgcggtggcggccgctctagaactagtggatcccccgggctgcaggaattcgcacgagaccattacctagaacatcctaatcgaaaaatcgcacgccatcagcagctagcgcgctcctcgagcccagcagagaaaggccggcagcgctaatcgtaatagccatgggctccaccgccggcgacgtggccgcggtggtggacgaggaggcgtgcatgtacgcgnatgcagctggcgtcgtcgtccatcctgcccatgacgctgaagacgccatcgagctggccctgctggagtgtgcaaaaaaaggggaggccgnnnnnnnnnangnngnngctgncgcccgaaggaggggnnggcgnngaagcccgcggcgcccaaggaccccgccccccgcgcggccaaggaggaccgcaagcnccggcgggacggcccccacgaggccgcccgggggcaaaaggaggaccgggacggcccgaacaaacggcgcaaccccgcccgccccggcgggaaggggcccacccccagaaggacgggggggccagggccccccccccccccaggaccaagaaaagggcccccggggagagggggnaaaaccccaggggaccgggggngaaccccgccccccgnnnaaaaagggggacggggagaaacccncccaaaaccccgggggggggcccccnnnnnnccccggggnnnanngggggnnnagaaaaccccccgggggaacc

SEQ ID NO: 30101 - DNA, 733 bp, Zea mays
  misc_feature: Ceres CLONE 1405483-F
  misc_feature (272)..(272): n is a, c, t, g, unknown, or other
  misc_feature (286)..(286): n is a, c, t, g, unknown, or other
  misc_feature (297)..(297): n is a, c, t, g, unknown, or other
  misc_feature (298)..(298): n is a, c, t, g, unknown, or other
  misc_feature (336)..(336): n is a, c, t, g, unknown, or other
  misc_feature (337)..(337): n is a, c, t, g, unknown, or other
  misc_feature (361)..(361): n is a, c, t, g, unknown, or other
  misc_feature (392)..(392): n is a, c, t, g, unknown, or other
  misc_feature (431)..(431): n is a, c, t, g, unknown, or other
  misc_feature (432)..(432): n is a, c, t, g, unknown, or other
  misc_feature (504)..(504): n is a, c, t, g, unknown, or other
  misc_feature (583)..(583): n is a, c, t, g, unknown, or other
  misc_feature (644)..(644): n is a, c, t, g, unknown, or other
  misc_feature (693)..(693): n is a, c, t, g, unknown, or other
  misc_feature (694)..(694): n is a, c, t, g, unknown, or other
aaagctggagctccccgcggtggcggccgctccagaacaagtggaacccccgggctgcaggaattcgcacgagaccattacctaaaacatcctaaatcgaaaagcttcgtggccgccttttttcagagaaaacagagggaggaaagaaaaagctcacccccctctctcttcccaccacctctctcacgtgtgtgaggtggcgagcccaaggaggagcgggaggccacaagtccgatccgcccgtatctaatccgctcgagcgcagcggtcgnttcctcgcgggggncgcacggttgnncatttcgagtgctgagacatcggcttcattgaacctannagcacggttgaagccatggctggnctcccttgctgcctcagccttcttccctggncccaggggcgtctccagcagcatccgcgagaaacttggnnctggtgaagtacccggaaaagtttgaagcgtcccgttggtattgtcgcaaagcctaatggccaattctgggnaaacattgcaagtgaaggctcaagcacaaacccttccccaaggttaatgggcaccaaggttaacctcaagaatgcaagnctcagacacagaggaggcgataccctacactgctcccaagacattctaacaccaactgccngaattggaacatgcttttcttgcggctgtcactaccatcttcctggcannaaaaaaaagcaggggacactgccttgactgggaggcgaa

SEQ ID NO: 30102 - DNA, 758 bp, Zea mays
  misc_feature: Ceres CLONE 1405484-F
  misc_feature: Translation starting site: 446
  misc_feature: SWISSPROT Homolog: EC 2.7.11.1 Non-specific serine/threonine protein kinase
  misc_feature: SWISSPROT Homolog: EC 2.7.11.11 cAMP-dependent protein kinase
  misc_feature (427)..(427): n is a, c, t, g, unknown, or other
  misc_feature (576)..(576): n is a, c, t, g, unknown, or other
  misc_feature (619)..(619): n is a, c, t, g, unknown, or other
  misc_feature (746)..(746): n is a, c, t, g, unknown, or other
aaagctggagctccccgcggtggcggccgctctagaactagtggatcccccgggctgcaggaattcgcacgagaccattagaacatcctaatcgaaaaacatcgatcactcgcgtgtctaggtttcctctctcaccatagcgcccgctctgtcgcccttcgttcacctctccttcctctcgtccctgcctgccaggggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcnatcgacaaggagaaggtgatgcgcgtcggcatgatcgaccagatcaagcgcgagatctccgtcatgcgcctcgtccgccaccccaacgtcgtgcagctgcaacgaggtgatggccagcaagagcaagatatacttcgccatggagtacngtccggggcggcgagctcttcgcccgcgtcgcccgcggcgggntcaaggaggacgcccgcgagaaggtacttccaccagctccgtccggcgccgtcgacttctgccacagccgcgggcgtctaccaccgcgaccctcagcccgagaacttcctcgtcgacgagcagggcnacctcaaggtct

SEQ ID NO: 30103 - DNA, 727 bp, Zea mays
  misc_feature: Ceres CLONE 1405485-F
  misc_feature: Encodes the peptide sequence at SEQ ID NO. 30104
  misc_feature (149)..(149): n is a, c, t, g, unknown, or other
  misc_feature (384)..(384): n is a, c, t, g, unknown, or other
  misc_feature (500)..(500): n is a, c, t, g, unknown, or other
  misc_feature (570)..(570): n is a, c, t, g, unknown, or other
  misc_feature (627)..(627): n is a, c, t, g, unknown, or other
  misc_feature (630)..(630): n is a, c, t, g, unknown, or other
tggagctccccgcggtggcggccgctctagaactagtggatcccccgggctgcaggaattcgcacgagaccattacctagaacatcctaatcaaaaaaaacaacacacgaacaccgcaccgcaacgtagccggctaggggaagagctcnttccttcagctgtgccgtgcacaacgcacggcacgcttggtttggtttgcatcgcccccgccaagaaagacgctgccgtgagcgggctgagcgggcgggaagcagcagcaggcgggcgacatgccgagcggcagcgcgtcctccgggtcggtgaacctcaagcacgtcaagctggggtaccagtacctggtgaaccacttcctgacgctgctgctgggtggccggtgatggccgncacggcggctggagctggcgcgcctcggccccggcgagtggctctcgctgtggcgctcgctggagctggacctggtccacatcctctgctcggcgttcctggtcttcttcgtcggnaccgtgtacgtgatgtcgcggcccaggccggtgtacctggtggactacgcctgctacaagccccccgccngctgccgcgtgcccttcgccaccttcatggagcacacgcgcctcatcagcgacgacnacnagagcgtgcgcttccagaccaggatcctggagcgctcggggctcggcgaggacacgtgcctcccgcccgccaaccactacatcccgcccaacccccg

SEQ ID NO: 30104 - protein, 71 aa, Zea mays
  misc_feature: Ceres CLONE 1405485-F
  misc_feature (1)..(71): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
  misc_feature (20)..(20): Xaa is any aa, unknown, or other
  misc_feature (39)..(39): Xaa is any aa, unknown, or other
  misc_feature (40)..(40): Xaa is any aa, unknown, or other
MSRPRPVYLVDYACYKPPAXCRVPFATFMEHTRLISDDXXSVRFQTRILERSGLGEDTCLPPANHYIPPNP

SEQ ID NO: 30105 - DNA, 718 bp, Zea mays
  misc_feature: Ceres CLONE 1405486-F
  misc_feature: Encodes the peptide sequence at SEQ ID NO. 30106
  misc_feature (296)..(296): n is a, c, t, g, unknown, or other
ggagctccccgcggtggcggccgctctagaactagtggatcccccgggctgcaggaattcgcacgagaccattacctagaacatcctaatcgaaaaacggcccaccccgatctcataatcgtcgtcttctcccacttcgacgcggctagggccggcgctaccatctcctcttctcttccggcggcttctccgtcccgtcgatcaaccgcgccgccttcgccagtataccccgcattgagccgtcatcgttacctgcgccgaccggcacctctgtagcctcttctccaggggttgcnacgaggaggaggaggttcgggcttcgccatgtcgaagtcgaacctagatgatctgcttctgcaggcagccggccggacggggaagaaccactcccggtcgagcaacccgcggtggaactctgggggaagcggctccgacggcttcgacgacgacgactcggacgccgcgccgacctactcgaggaagaagccttcgtcgcaggttccgctcaagaagcggcaccagccagagcagggcggccggcgtggcagcggaggatgaaaggacgaggccgaccaggacgaacatggccgtcgcagtgccggtgaggactccgacagcgaccctccggggggaagcgccctataccagcacgagggcccacgcgagggccggacacaactgcccgacccggacagggagaacaccccgccctgaccgg

SEQ ID NO: 30106 - protein, 77 aa, Zea mays
  misc_feature: Ceres CLONE 1405486-F
MSKSNLDDLLLQAAGRTGKNHSRSSNPRWNSGGSGSDGFDDDDSDAAPTYSRKKPSSQVPLKKRHQPEQGGRRGSGG

SEQ ID NO: 30107 - DNA, 735 bp, Zea mays
  misc_feature: Ceres CLONE 1405487-F
  misc_feature: Encodes the peptide sequence at SEQ ID NO. 30108
aaagctggagctccccgcggtggcggccgctctagaactagtggatcccccgggctgcaggaattcgcacgagaccattacctagaacatcctaatcgaaaaaagaagagccgccctacctattccttctccccgccgtcgagctgcccaacccagagcaccagcagccctcacctccttcctctcggccggtccttccaacgagcccgctggtcttggagccgccgccggtctcgttctggacgaacgttcaaggagattgcatttgtggatgctctaatggagtcgaaaggtggcaagaagtctagtagtagtaatagtaatttcatgtacgaagctccccttggctacaagatcgaggacgttcgcccagccggaggaatcaagaagttccagactgctgcttattccaactgcgtccgccagccatcctgatatcgcctcacatgcaattcgcagtagagtaggattttaattcagttttcctcttgtgtcggtagttctccgttggctctggctgccatcctctgcttctgagattccaacttgtcttaaccatctctccttttcctctctcatcctctctttcttgcaaacgtctcccaaatggcgatgtcttcagcaagattcttgtgtctcttctctgcctcccctattgggctttgagggctatgagaggcgccttcgagatcacgttctctgacgcgccttgtctttgagggaccttttggggcc

SEQ ID NO: 30108 - protein, 51 aa, Zea mays; identical to SEQ ID NO: 27369
  misc_feature: Ceres CLONE 1405487-F
  misc_feature (1)..(51): Pfam Name: AdoMetDC_leader Pfam Description: S-adenosyl-l-methionine decarboxylase leader peptide

SEQ ID NO: 30109 - DNA, 730 bp, Zea mays
  misc_feature: Ceres CLONE 1405488-F
  misc_feature (457)..(457): n is a, c, t, g, unknown, or other
  misc_feature (471)..(471): n is a, c, t, g, unknown, or other
  misc_feature (660)..(660): n is a, c, t, g, unknown, or other
  misc_feature (661)..(661): n is a, c, t, g, unknown, or other
tggagctccccgcggtggcggccgctctagaactagtggatcccccgggctgcaggaattcgcacgagaccattacctagaacatcctaatcgaaaaaagaagagccgccctacctattccttctccccgccgtcgagctgcccaacccagagcaccagcagccctcacctccttcctctcggccggtccttccaacgagcccgctggtcttggagccgccgccggtctcgttctggacgaacgctcaaggagattgcatttgtggatgctctaatggagtcgaaaggtggcaagaagtctagtagtagtaatagtaatttcatgtacgaagctccccttggcacaggaaacgaggacgttcgcccagccgaggaaaatcaagaagttccagactgctgcttattccaactgcgtccgccagccatcctgatatcgcctcaaggcaattcgcagtanaagtaggatttttnaattcagttttcctcctggggggcgtaggttctcggttgggctctggctgccatcctctgcttctgagattccaacttgtcttaaccatctctccttttcctctctcatcctctctttcttgcaaacgcatccccaagggcgatgtcttcagcaagattcttgtgtctcttctccgcctcccctattgnngctttgagggctatgagaagcgccctcgagatcacgttctctgacgcgccctgtcttgagggccccttt

SEQ ID NO: 30110 - DNA, 750 bp, Zea mays
  misc_feature: Ceres CLONE 1405489-F
  misc_feature: Translation starting site: 186
  misc_feature (409)..(409): n is a, c, t, g, unknown, or other
  misc_feature (428)..(428): n is a, c, t, g, unknown, or other
  misc_feature (631)..(631): n is a, c, t, g, unknown, or other
ctccccgcggtggcggccgctctagaactagtggatcccccgggctgcaggaattcgcacgagaccattacctagaacatcctaatcgaaaaacctcaggcctcgctcagatctctccgcccgggtccatcttcccaccccaaaccttctcccgcctctctcgtcaacgccgcccgacgagagggatggcggccttgcgggctccggccgcaacgctcctcgtcctcctcgccctagcggcggccggcggcgtggcggccgacggctccgatcaccggtacaagattcgcgagcccgtcccgctctacgccaacaaggtcggcccatttcacaatcccagtgaaacatatcgatatttcgacctgcctttctgctctcctgacaaagtgaaggagaagagcgaggcccntttgggggaggttctcaantgggggatcggttagttgatgcgccttacaagcttgattccccgtgacgaagttgagtcccaaggcagtttggctcaaagaagcttactacagaggatggtaagtgaagttccggaatgcagtggctaaggactactacttccagatgtactatgatgatctcccactgtggggcttcatcggtaaagttgagaaaggcggcnaggatgatccgagcgagtggaaatactatctgtacaggcacatcatcttcgacatcctatacacaacgaccgggtgatcgaaatcatgtgcacactgatcagagtgcattggttgacct

SEQ ID NO: 30111 - DNA, 621 bp, Zea mays
  misc_feature: Ceres CLONE 1405493-F
  misc_feature: Encodes the peptide sequence at SEQ ID NO. 30112
  misc_feature (284)..(284): n is a, c, t, g, unknown, or other
tggagctccccgcggtggcggccgctctagaactagtggatcccccgggctgcaggaattcgcacgagaccattacctagaacatcctaaaaaaaaaggaattctgccttcttctctcatcttcctgctcaacatcagtagcagctttagctgtagcagcgccaccggccaccgccacgccatggccaccacgttgcacaagcccctgcgggcgatcaccgttgacgacctcgccgcggcggcgcctgggtcggacgccaccgcgctccacgcagagctccggngcgcgctcgactcgcacgtacccaccgaagggtggggcgagctctgccggtccgtgctctggtcgttttgtcccttcggcgtccacgggatgttctatacggttggttcggcgggtttcggtttccacgccggcgcctgaaagcccgaccccaaggggttggcttgaccaaggtgggccggccccccaagggcggggggaaaggcattttttcggggaacggggaaaaaggagtcccattaccccattttcccaaaacccccaaaattttccccaaaagaaaaaccccaaagagggctccgggaaaaaagggttttttgggggaaaaggggggaccc

SEQ ID NO: 30112 - protein, 80 aa, Zea mays
  misc_feature: Ceres CLONE 1405493-F
  misc_feature (35)..(35): Xaa is any aa, unknown, or other
MATTLHKPLRAITVDDLAAAAPGSDATALHAELRXALDSHVPTEGWGELCRSVLWSFCPFGVHGMFYTVGSAGFGFHAGA

SEQ ID NO: 30113 - DNA, 720 bp, Zea mays
  misc_feature: Ceres CLONE 1405497-F
  misc_feature: Encodes the peptide sequence at SEQ ID NO. 30114
  misc_feature (562)..(562): n is a, c, t, g, unknown, or other
  misc_feature (578)..(578): n is a, c, t, g, unknown, or other
  misc_feature (579)..(579): n is a, c, t, g, unknown, or other
  misc_feature (658)..(658): n is a, c, t, g, unknown, or other
  misc_feature (702)..(702): n is a, c, t, g, unknown, or other
aaagctggagctccccgcggtggcggccgctctagaactagtggatcccccgggctgcaggaattcgcacgagaccattacctagaacatcctaatcaaaaggtggttgacggccgcttacccgcaccggcgccatgcgcgcgcgcggctaggtggtcgaggtcaagccaaacgctgcccaccgcctctgcctctgcctcgcatatatcctcgcgcacgttctttgctcgtctcgcactcgcttccttcgacgactcatcgccgatcacaccaggctagctagcccacccacagtcgtagggccaggaccgatcggaggagctcggtttttcgaccaggaccgccgccgccacacccgaagaagccgacgatgcagacgacgacgtcctcggcggcggcgtcgccgcgcccgcgcgcgcgggcgccgcagtccgtggtggccgagctggagggcgcgctgctccggagcgcggacacgttcccgtacttcatgctcgtggcgttcgaggcgtccgggctgccgcgcttcgcgctgctgctggcgctgtggccgctgctgcgnctgctggaggtggcgnnccggcgcggcctggcgctgcgcgccgccgcgttcgtggccaccgcgggcgtgccgcgcgccgaggtggaggcagtgtcncgcgccgtgctgcccaagtcatggcccgacgacgtcgtccccgncgcgtgggcgggcctcgg

SEQ ID NO: 30114 - protein, 116 aa, Zea mays
  misc_feature: Ceres CLONE 1405497-F
  misc_feature: SWISSPROT Homolog: EC 2.3.1.15 Glycerol-3-phosphate O-acyltransferase
  misc_feature (70)..(70): Xaa is any aa, unknown, or other
  misc_feature (111)..(111): Xaa is any aa, unknown, or other
MQTTTSSAAASPRPRARAPQSVVAELEGALLRSADTFPYFMLVAFEASGLPRFALLLALWPLLRLLEVAXRRGLALRAAAFVATAGVPRAEVEAVSRAVLPKSWPDDVVPXAWAGL

SEQ ID NO: 30115 - DNA, 732 bp, Zea mays
  misc_feature: Ceres CLONE 1405498-F
  misc_feature: Translation starting site: 163
  misc_feature (425)..(425): n is a, c, t, g, unknown, or other
  misc_feature (427)..(427): n is a, c, t, g, unknown, or other
  misc_feature (433)..(433): n is a, c, t, g, unknown, or other
caaagctggagctccccgcggtggcggccgctctagaactagtggatcccccgggctgcaggaattcgcacgagaccattacctagaacatcctaatcgaaaaatattctcccaaaaaacccaacactccagtggcggcaaagacctaacatttcaaaatcaatggccaagaaccccaaggcgcccgacacccgcagtggccgttctcccaccagaaggccccgaccacgccgcgccaaggcggtgccagaagcctcctccgcagctgatatcgaagacctggctccctcagtgcctggggccgctgcccctggcgctgccgcacccacggccctgcgcgcacagctgctccggtggtatgacgcgcaccgtagggacctgccgtggcgatgcgtaagcggcagcgaggaagagaggcgtacgcngntgtggntgtccgaggtgatgctgcagcagacgcgggtggcccgtggtcgtcgcttactaacgagcgtggatggcgcggtggccgaacgtacgaagcctcgcgccgctaccccagaggaagggaacgaaatggtgggcggttcttggctacaaccgaaaggctcgatttctggtggagggaccaagcagatcctcaaaaagggggttgtttcctttgcccgggggtacccctttccggaggttccggggcattgggaattaacacgggtggagaaaatccttttttttgtcaaagggcccagtgga

SEQ ID NO: 30116 - DNA, 726 bp, Zea mays
  misc_feature: Ceres CLONE 1405499-F
  misc_feature (435)..(435): n is a, c, t, g, unknown, or other
  misc_feature (477)..(477): n is a, c, t, g, unknown, or other
  misc_feature (692)..(692): n is a, c, t, g, unknown, or other
  misc_feature (703)..(703): n is a, c, t, g, unknown, or other
aaagctggagctccccgcggtggcggccgctctagaactagtggatcccccgggctgcaggaattcgcacgagaccattacctagaacatcctaatcgaaaacgggatcgctctctctttgggctaccggctccgccgccgctccgccgccctaagccaggtgctgaaggccttcgtcggtcttttcaccggcgacgacgacccactaggaaaagaattttcctggcatatttttgtttccagaaatattcgtgtcaagttggtatgtcagggatccagcaatttggcgtcggtcatgtccattagctgctagtcagattctaatggagacatattttggcccatctgtatcttctggtgtttctgaggtggttcagcagcggcactaagcactcaagaaaacctggaattttctgttgctaaccatatcagggntgggtggatttgcattctggcttctgcagttaattatgtgtncaacgatcagaaggttgcccctttcatgccgtatggacacctaattggttgattacttcaaagtccagacatggtgcattgccaggaattcttaggtgtttcaagctttctatcgtggatactcttcagatactgggatcaagcagaagcttcggcagagtggtgtctctaatcttccttctacgaaaggctctgaggttggcactgcagggggnttggggggggntcatgggattgaaatctgggaca

SEQ ID NO: 30117 - DNA, 785 bp, Zea mays
  misc_feature: Ceres CLONE 1405504-F
  misc_feature (406)..(406): n is a, c, t, g, unknown, or other
  misc_feature (419)..(419): n is a, c, t, g, unknown, or other
  misc_feature (436)..(436): n is a, c, t, g, unknown, or other
  misc_feature (441)..(441): n is a, c, t, g, unknown, or other
  misc_feature (481)..(481): n is a, c, t, g, unknown, or other
  misc_feature (485)..(485): n is a, c, t, g, unknown, or other
  misc_feature (501)..(501): n is a, c, t, g, unknown, or other
aaaagctggagctccccgcggtggcggccgctctagaactagtggatcccccgggctgcaggaattcgcacgagaccattacctagaacatcctaatcgaaaaaaacaggcacaggctccctcctccactgtccagtgtccactcctcgtcccgagaagcagacaaagcgcggcgctgcagatttcggtacggttcccaatgcctcccatgcccgccgtcgtcccgtgctagcacccggcgccgctcctccacctgccgcgtcgcgccgcctggatccggcgggcacgtggctaggagcctcagatccgggcgaaacccagccttcccgtgcggacgtcttcactctacctccagactggcggctgccatttccccccctcttcttgctgtttttttggggggggnggggggggggtgnatctggggggggaagtnttggncgtcgtttcgctgtaaacgttagagctcctctctctctcnttgnccgagtaatccctggnttctttgctccatttcccgtgtttaatgcctgggcgtgtgaagtggcaaaggttttacgtgttaagaatgtggaaaacagttccctgagcaagctggccccccgaaggtcgtccggcctcccggggactcggggacattgcaacaagtggcggccgggcataccagcgcacgaagcagctggcggcagaatccccgccggggccgccccccgggcctcccgccatttcgggggcatgggcatccggccgtccttccccctcaagggtcgggggctgggcatcca

SEQ ID NO: 30118 - DNA, 756 bp, Zea mays
  misc_feature: Ceres CLONE 1405511-F
  misc_feature: Encodes the peptide sequence at SEQ ID NO. 30119
  misc_feature (282)..(282): n is a, c, t, g, unknown, or other
  misc_feature (421)..(421): n is a, c, t, g, unknown, or other
  misc_feature (486)..(486): n is a, c, t, g, unknown, or other
  misc_feature (579)..(579): n is a, c, t, g, unknown, or other
  misc_feature (588)..(588): n is a, c, t, g, unknown, or other
  misc_feature (589)..(589): n is a, c, t, g, unknown, or other
  misc_feature (607)..(607): n is a, c, t, g, unknown, or other
  misc_feature (635)..(635): n is a, c, t, g, unknown, or other
  misc_feature (737)..(737): n is a, c, t, g, unknown, or other
caaagctggagctcctcgcggtggcggccgctctagaactagtggatcccccgggctgcaggaattcgcacgagaccattacctagaacatcctaatcgaaaagttgggtgccgtgcgagctccaagtacccctgtctccctcccgtcttgcgggcttgcctttgcctgttccatttccggctcctccagttggtagtgtcgtttcaatgcgagacgccgtccttcacgagcttgattgcccttgaaagcgaagttggtgttggtgtcggttgccggtgagngaggaagaggggatatatggctcccacggaagaggcagcaggggaggacgagcggctgctgaaggatcttctcgcttcttcgtcagataaggaaggagaggatgaagagagtacaaagacacagtccgatgaatctatnaaagggggggattgtgataacgggcgggtccgtagccgccttatcgaagtgaagatgtcaatgantaggcatggtagtgacagcaacagccaatggtgctgaatctgagggtgcttggcagtcaagtggcctggaacaggctccaagagcagcaacgnatgagtgcnnggtgctgaagtgcctcanaccggatccaagagcagtattgatgaanaaatgacgggttgtgctgatgaaatgccaggagccccctccaagagcagtagcaatgaacccgcagtgagtgcgctgaccggagctcctccgcgagctgtcntaagatatctcagtatctg

SEQ ID NO: 30119 - protein, 74 aa, Zea mays
  misc_feature: Ceres CLONE 1405511-F
  misc_feature (41)..(41): Xaa is any aa, unknown, or other
  misc_feature (63)..(63): Xaa is any aa, unknown, or other
MAPTEEAAGEDERLLKDLLASSSDKEGEDEESTKTQSDESXKGGDCDNGRVRSRLIEVKMSMXRHGSDSNSQWC

SEQ ID NO: 30120 - DNA, 761 bp, Zea mays
  misc_feature: Ceres CLONE 1405512-F
  misc_feature (128)..(128): n is a, c, t, g, unknown, or other
  misc_feature (282)..(282): n is a, c, t, g, unknown, or other
  misc_feature (295)..(295): n is a, c, t, g, unknown, or other
  misc_feature (319)..(319): n is a, c, t, g, unknown, or other
  misc_feature (326)..(326): n is a, c, t, g, unknown, or other
  misc_feature (327)..(327): n is a, c, t, g, unknown, or other
aaaagctggagctccccgcggtggcggccgctctagaactagtggatcccccgggctgcaggaattcgcacgagaccattacctagaacatcctaatcgaaaaaaaaaaaaaaaaaaatagcaaattntctcggcttccgccacacccgctccaggtcccctcccccaaactgaaacgaagttgcggcggtcgcgactgagtgcagaggctgcagttcccggcgctgatgcggcagtggccatcgccgccgctgatcccggcgtcacgctgctccccgtggncggcactcccagnaggacgagcttctcctctcatggncgagtcnngactcgaggatagctgaacgagatcgggaagacaacagccacctggtatcatcgggaaagccaggccgaccccaaggaggataccaccctaacgggaagaagaccatcaaaacaaactcaaggggatttagaggggaaaaactttcaaacaggaaacgcgtttacccaaggggttcccccgggttttcggggggcttgggggggtatcccccgggggcaagggggtttccaaaccccggggggccctcttaataaaaaagcgggacccactttttggggggggggggccaaaaaagaaaagtgtccctgtggggggggcttttggataaaaaaaaaaaatatatatccccgccccataaaagtaatattttttctccccaaaaaaaaaaaaaaaatttttcccccccccccccgggggggggggcgcgcccaat

SEQ ID NO: 30121 - DNA, 745 bp, Zea mays
  misc_feature: Ceres CLONE 1405514-F
  misc_feature: Encodes the peptide sequence at SEQ ID NO. 30122
  misc_feature (668)..(668): n is a, c, t, g, unknown, or other
  misc_feature (676)..(676): n is a, c, t, g, unknown, or other
  misc_feature (684)..(684): n is a, c, t, g, unknown, or other
aaaagcgggagctcaccgcgggggcggccgctctagaacaagtggatcccccgggctgcaggaattcgcacgagaccattaacctaaaacatcctaatcaaaacctttcgggcagaaagaagccagaagagagagagagagagaggtcggggctggggagcacacacccatcacccatggactgactgacctccggactctccctgcttccgtcgccgccgcgggccgcccagctgactgctcctgccctccgcccgccctccattgcgtccgtcaagctcggctccaagcctgacgccttcaagcggcaaggccaggcatggttctgcacaacaggacttcctagcgatgtcaccgttgaggttgggggatatgtctttccaccttcacaagttccctttactttcaaaaagtggcctttcttgaacggtcaattgaagaaaattctgaccaagaagaatgcatcatcaaactaaatgacatttcctggggggtgccaagtcatttgagctagttgcaaggtttctatggtgtgaaaaatagagctttcacctgcaaatgttgctaaccctacggtgtgcctcagagcatctagaaaggactgaagaagtagctgaggaaaacctgattgccaagtcagaaatgtctccaaaccaggtggttctcgntaactggnaagatccnttggcagcattggaaacatgtgatgacctactcccccatgctgagaacctcccgattgtga

SEQ ID NO: 30122 - protein, 62 aa, Zea mays
  misc_feature: Ceres CLONE 1405514-F
  misc_feature (37)..(37): Xaa is any aa, unknown, or other
  misc_feature (40)..(40): Xaa is any aa, unknown, or other
MLLTLRCASEHLERTEEVAEENLIAKSEMSPNQVVLXNWXDPLAALETCDDLLPHAENLPIV

SEQ ID NO: 30123 - DNA, 665 bp, Zea mays
  misc_feature: Ceres CLONE 1405519-F
  misc_feature: Encodes the peptide sequence at SEQ ID NO. 30124
  misc_feature (406)..(406): n is a, c, t, g, unknown, or other
  misc_feature (407)..(407): n is a, c, t, g, unknown, or other
  misc_feature (413)..(413): n is a, c, t, g, unknown, or other
  misc_feature (420)..(420): n is a, c, t, g, unknown, or other
  misc_feature (432)..(432): n is a, c, t, g, unknown, or other
  misc_feature (443)..(443): n is a, c, t, g, unknown, or other
  misc_feature (446)..(446): n is a, c, t, g, unknown, or other
  misc_feature (472)..(472): n is a, c, t, g, unknown, or other
  misc_feature (630)..(630): n is a, c, t, g, unknown, or other
aaagctggagctccccgcggtggcggccgctctagaactagtggatcccccgggctgcaggaattcgcacgagaccattacctagaacatcctaatcgaaaaatcccacgctgccctcggcgctgcgcctggacccggcacctacctcccccctccccacctcgccgccggcgggtggagtcgggctggagcagccgctctcctctgttacccccctaaccccctataaagaaaaagaaaaaaaaacagagagagagagcgagcgaccggcggctcggcagccatggggcacggcgtcagctgcgcccgcaccggcgacgagcacgactacttccgcgcggcgcaggtcggggacctcgaggccctggacgcgctcctcgacgccgacccctctctcgccccgcgnngcacgntctacgnacggctctccgngctcacatcgncgncgcgaatggccgccctcgaggtgctngtcatgggtctgggatcacggggtgcccgccggacgtggtgaatcggcacaagcagaacgccgctgatgcttcgcggcgatgcacgcaagaactgactgggtgctgaacctcctgcaaggcggggcaaaatccctcatgttcgaatcccagcacgggnggacctgcctgaacaacggttctatttggggaagg

SEQ ID NO: 30124 - protein, 76 aa, Zea mays
  misc_feature: Ceres CLONE 1405519-F
  misc_feature (42)..(42): Xaa is any aa, unknown, or other
  misc_feature (44)..(44): Xaa is any aa, unknown, or other
  misc_feature (46)..(46): Xaa is any aa, unknown, or other
  misc_feature (50)..(50): Xaa is any aa, unknown, or other
  misc_feature (54)..(54): Xaa is any aa, unknown, or other
  misc_feature (55)..(55): Xaa is any aa, unknown, or other
MGHGVSCARTGDEHDYFRAAQVGDLEALDALLDADPSLAPRXTXYXRLSXLTSXXRMAALEVLVMGLGSRGARRTW

SEQ ID NO: 30125 - DNA, 760 bp, Zea mays
  misc_feature: Ceres CLONE 1405523-F
  misc_feature (559)..(559): n is a, c, t, g, unknown, or other
  misc_feature (615)..(615): n is a, c, t, g, unknown, or other
  misc_feature (755)..(755): n is a, c, t, g, unknown, or other
catagctggagctccccgcggtggcggccgctctagaactagtggatcccccgggctgcaggaattcgcacgagaccattacctagaacatcctaatcaaaaagatctacctgtctgttcttcgatcgagtctgagagatttgggaggaggagggaaacaaagcgaaagagcccatcttttttgtctttttggttcggtttcgtggttgcttcttttggaccccgcggaggagcccaccgtttctacaaaaacccaatctttgctgccttctcagcggtcgagatcgataggtttccagatctgaggctccgtgttctggctgtgagatcggaggcgcagcaatccgagcacgcagctagtagggaaagtatccgagaaaagttgcagattttgctgggggcaacggagcgagaacaagttactgcagaaggaaagggcaaaggtgggggaggcgccggagatgagggatgctatcagctctgatggattatttgaaatcttgctcgggtccggcatcaccgggctgggcgtccccgcaaaggatcggatgccaccggncgccaggacgggctcctgtggtacaaggacggcgggcagggtcgtcgatggtgagntctcccatggccgtgggtccaggccataaacctattggaggaccatagccaggttggaatccgggccgcttagcacatcgggagcctggactgcaaggcaccctccgtcgggggtctacgaatgggcacggtgggcccgnagact

SEQ ID NO: 30126 - DNA, 743 bp, Zea mays
  misc_feature: Ceres CLONE 1405526-F
  misc_feature: Translation starting site: 231
  misc_feature (421)..(421): n is a, c, t, g, unknown, or other
  misc_feature (444)..(444): n is a, c, t, g, unknown, or other
  misc_feature (445)..(445): n is a, c, t, g, unknown, or other
  misc_feature (576)..(576): n is a, c, t, g, unknown, or other
  misc_feature (641)..(641): n is a, c, t, g, unknown, or other
aaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgacctccgggnagaagtacgggcccatcttcacnncatggcggatggggcagccaccccctcatcgtggtccacctcggcggagctcatccacgaggcgctgggtgaagcagggccccatgttcgcgagccggcccgaggacagccccacccgcctcctcttcagngtcggcaagtgcaccgtcaactcggcgcctacggccccccttggggcgtgctctgcgccgcactnccgtcgcccgagatcgtgtcccgcaccgcgtcagggcttctctggaaacccggggagggggcccgtgaacgcgcacttgcgccgctctgcgcgagctcgcgg

SEQ ID NO: 30127 - DNA, 754 bp, Zea mays
  misc_feature: Ceres CLONE 1405529-F
  misc_feature: Encodes the peptide sequence at SEQ ID NO. 30128
  misc_feature (313)..(313): n is a, c, t, g, unknown, or other
  misc_feature (352)..(352): n is a, c, t, g, unknown, or other
  misc_feature (402)..(402): n is a, c, t, g, unknown, or other
  misc_feature (452)..(452): n is a, c, t, g, unknown, or other
  misc_feature (453)..(453): n is a, c, t, g, unknown, or other
caaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatggtggtggcgtcggtgctccaagaccggngggtgtcgacggcctcccgccgggggcctccgggttggncgggtggtggggaacctggttccaggtgatcgctgcagcgacggcccttncatgtacgtggtgcgcgacctcccgggaagaagtacgggcccatcttccnncatggcggatggggcagcgcaccccctcatcgtgggtcaccctcggcggagctcatccaacgaggcgctggggtgaagcaggggccccatggttcgcgagcccggcccgaggacagccccacccgcctcctcttcagcggtcggcaagtgcaccgtcaactcggcgccctacggcccccctgtggcgtgctctgcgccgcaactcctcggcccgagatcgtgtccccgcaccgcgtcagggcttctctgggtacccggagagggggccggggacgcgcacttgcgccgctccgcgcgagtt

SEQ ID NO: 30128 - protein, 49 aa, Zea mays
  misc_feature: Ceres CLONE 1405529-F
  misc_feature (28)..(28): Xaa is any aa, unknown, or other
  misc_feature (41)..(41): Xaa is any aa, unknown, or other
MDVNDVLLVVLAAALAAMVVASVLQDRXVSTASRRGPPGWXGGGEPGSR

SEQ ID NO: 30129 - DNA, 748 bp, Zea mays
  misc_feature: Ceres CLONE 1405530-F
  misc_feature: Translation starting site: 253
  misc_feature (405)..(405): n is a, c, t, g, unknown, or other
  misc_feature (485)..(485): n is a, c, t, g, unknown, or other
  misc_feature (510)..(510): n is a, c, t, g, unknown, or other
  misc_feature (523)..(523): n is a, c, t, g, unknown, or other
  misc_feature (533)..(533): n is a, c, t, g, unknown, or other
acaagctggagctccccgcggtggcggccgctctagaacaagtggatcccccgggctgcaggaattcgcacgagaccattacctaagaacatcctaatcgaaaaccaacccaggcaacacagcaatcagcagaaaaacatctccttggccttccatccatatgatccatccctccaggctccagctaactccaaactaaccctctggttcgactcgcgttcgcatcgcaagcagcagcgtaccatcgaggcaatggcggtgatggccgaagtagtgtcgaccaccaacgcggcgctccggagcccggccacgcagcagccggcggcggcgggcgcggcgaagggcaccgacgctgagaagctccagttcatcgaggacatgacctccaacgtggacgccgtgcangagcgcgtgcttggggggagatcctcgcccgcaacgcggacaccgagtacctctccaagcagggggggccctcgcccggngctacggaacgcgccacctcccgcngcaagggtggccnatggcgaacntacgagaacctgcagccgtacatccgcgaaattccccgaacggggacgctcgccaattccttggcggggacccgggtccccgagttcctcacaactcccgaaaagtcccggggggaagggaaactcatgcccaccattcgaggagaagttcaacgcccgcagttgttgaaaggcccccaaagccccttatgaaacttgacgggccctggaaaaaa

SEQ ID NO: 30130 - DNA, 759 bp, Zea mays
  misc_feature: Ceres CLONE 1405531-F
  misc_feature: SWISSPROT Homolog: EC 2.7.6.1 Ribose-phosphate diphosphokinase
  misc_feature (563)..(563): n is a, c, t, g, unknown, or other
acaagctggagctcaccgcggtggcggccgctctagaactagtggatcccccgggctgcaggaattcgcacgagaccattacctagaacatcctaatcgaaaaatagaccggattaaaaccctaggccctagccaccgcccaccgtcgcctcagcaaatcctcctcccgtttcaccatgccgccctgctgctcccccaccacctccgccgtcacctctgcggcggcatctcccgggcctcgtcgggagcgggtgggctcctgcgccgctcgagcccagcccccgccgccgtgaattgtaaaaagattgattctctgaggtcaatcaatggagcaccaccttgcattccggtgtccaacaggtcgttattgactcctgtaaccttgccagttttccgggatccaaacatgaggaacgacacgaggttgcgcatcttctcaggcacagccaatccttccctttcccaggagatagcaagttacttggggatagaacttggtaagataaccataaagaggtttgctgatggtgaaatatatgttcagttgcaagaaagtgtacggnagctgtgatgttttccttgtgcaaccgtcgtgtcctccagcaaatgaaaatcttatggagcttctgatcatgattgatgcctgtaggagagcatctgctaagaatatcactgcagttatcccttattttggttatgcaagggctgacaggaagtcccagggcagggaatctatagctgcaaaaattgtagctaatt

SEQ ID NO: 30131 - DNA, 744 bp, Zea mays
  misc_feature: Ceres CLONE 1405533-F
  misc_feature: Translation starting site: 231
  misc_feature (482)..(482): n is a, c, t, g, unknown, or other
  misc_feature (561)..(561): n is a, c, t, g, unknown, or other
  misc_feature (579)..(579): n is a, c, t, g, unknown, or other
  misc_feature (619)..(619): n is a, c, t, g, unknown, or other
  misc_feature (640)..(640): n is a, c, t, g, unknown, or other
aaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgacctcccgggagaagtacgggcccatcttcaccatggcggatggggcagcgcaccctcatcgtggtcaccntcggcggagctcatccacgaggcgctgggtgaagcagggccccatggtcgcgagccggcccgaggacagccccacccgnctccctctcagcgtcggnaagtgcaccgtcaactcggcgcctacggcccccctgtggngtgctctgcgccgcaacttcntcgcccgagatcgtgtccccgcaccgcgtcagggctcttctgggaatccggaaatgggccgtggaagcgcacttggcgccgctccgggcgagcttcggggggag

SEQ ID NO: 30132 - DNA, 734 bp, Zea mays
  misc_feature: Ceres CLONE 1405534-F
  misc_feature (684)..(684): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
aaagctggagctccccgcggtggcggccgctctagaactagtggatcccccgggctgcaggaattcgcacgagaccattacctagaacatcctaatcgaaaaaaaatctggaaacctttcacgccgccactctcccctttttccttctctcttcgccgttgggggtcctgccttcctgcctcgaggcatcgacacgcggagagggacagcacagcgcctcgtccccatcctttctccattcccagatcgaaggcccatgtgagtattgcgtgaatcttgcaaggtgtggatccgtcgcggatgctggctttcttgctgattgtgccctgaagtctgtgccaagacctgaaattcgagagatgtaggaagtttagaacacgagtcaggtaccaagcaccgagtatttgcaagatccgcaccggttccaagctagaattgttccacctattgatcctgtataataaccgtttcgtagttttttcctccgttgctgaatcttctcccattaatttggtgtgcagaaaaaaccatccttttgcatctgattgagcactgtctttgtgcaagagaacaatttagttgtacatacaacaaaaagaagtgggagtattttttcagagtttattaagaagagacttgtttcgaggacccaggtcagagaaaggcgagaagcttagcagcggncaatggtctggcaatgggaaccccgcaggtgacgtccacggnnngactgg

SEQ ID NO: 30133 - DNA, 711 bp, Zea mays
  misc_feature: Ceres CLONE 1405537-F
  misc_feature: Encodes the peptide sequence at SEQ ID NO. 30134
  misc_feature (326)..(326): n is a, c, t, g, unknown, or other
aatagctggagctccccgcggtggcggccgctctagaactagtggatcccccgggctgcaggaattcgcacgagaccattacctagaacatcctaatcgaaaagatccgccactacgccacaaaatcctctcctactccggcagttctgctcgccgccgcctccacgatgacggaagacgtgcagatgaacgactcggagccccagtctgcggcctcagctcccgtcgtcggtgcgccggggctctccacactacaccatctgaaggagatcgcgtccgtgatcgaaggcggttctctgtccaaggaggtacggcggatcttccgngacttccggcttaacggcgcggttcgtcgccggctcgccgcgcgggaagtctccggcttcctcgtcttcgcggtaaccgcgtgctacggaagctacagacggctcactgggcctggtgcgcaaggagatgatactcggatgggtgttgatggtgtagatccacgaactctgatttctatcaaacatgggctccctgagattgaaataaattgggacatgcgcgcacaggaatttccctattggggccaagaaaaaatgaggcgggtcaagcatgcgcaagtgtgtagcatttgctctcctgtaaaatctaaaacgggaaacaggtgtagatgtttgggtcatcgaacgggcctctataacacttcatgggagtgggacttaccca

SEQ ID NO: 30134 - protein, 181 aa, Zea mays
  misc_feature: Ceres CLONE 1405537-F
MTEDVQMNDSEPQSAASAPVVGAPGLSTLHHLKEIASVIEGGSLSKEVRRIFRDFRLNGAVRRRLAAREVSGFLVFAVTACYGSYRRLTGPGAQGDDTRMGVDGVDPRTLISIKHGLPEIEINWDMRAQEFPYWGQEKMRRVKHAQVCSICSPVKSKTGNRCRCLGHRTGLYNTSWEWDLP

SEQ ID NO: 30135 - DNA, 737 bp, Zea mays
  misc_feature: Ceres CLONE 1405538-F
  misc_feature (464)..(464): n is a, c, t, g, unknown, or other
  misc_feature (493)..(493): n is a, c, t, g, unknown, or other
  misc_feature (531)..(531): n is a, c, t, g, unknown, or other
aaaagctggagctcaccgcggtggcggccgctctagaactagtggatcccccgggctgcaggaattcgcacgagaccattacctagaacatcctaatcgaaaagcaacgcccacctccgccctttcgggcagaaagagccagaggtagagaggtcggcgtcggtgagtcacacccatcatccatggcctgactgacctccggactctccctggttccgtccacgccgagggccgtccacctgactgctcctgtcctccggccgcccgccatggcgtccgtcaaggtcggctccaagcctgacgccttcaaacggtgaggccaggcatggttctgcacaacaggacttcctatcgatgtaactgttgaggctgaggatatgtctttccaccttcacaagttctctttactctcagaaagcgcctgttcttgaacggtcaattgaagacaattctgaccaagaacnaatgcatcagtcaactaaatgacattccntggggggtggcaagtcatttgcagctagttgacagggntctgctatggtcgtgaaatagagctttcaacctgcaatgatgcttaactacgttgtggctcagagcatctaaaatggactgatgaaggagctgaggaaaaactgattgcacaggcagaaatgtcctccaaccagttgggtctcggtaactggaaaagatcctttggagcattggaaaactgggatgactaatccccatgctggaga

SEQ ID NO: 30136 - DNA, 680 bp, Zea mays
  misc_feature: Ceres CLONE 1405539-F
  misc_feature (1)..(1): n is a, c, t, g, unknown, or other
naaagctggagctccccgcggtggcggccgctctagaactagtggatcccccgggctgcaggaattcgcacgagaccattacctagaacatcctaatcgaaaaaccccaaagctccgcctccgcaccttctctcactcgcccagccgcggatatggcggccaccacatccacggcggcggcggcagtatccttctccctcccctcaccaccgcactgccgcggggcccggcgccgccgcgcgccttccctcctccgtggcagaacctccacagccgcgcccccctcctcgacctctccatacagatctcgccccgcgcgtccccgcccgcgtctaccaacggcgacgccaccgcgcatggaaccccccgtggtccgcctccttttgccccgggacccgcccccgagaaactttgaaggcaaagcccggcaaagcccccccccgggggccaaagttaaagcccaagttcccgcggcgggagggtccccccttaagggggactcccgaaagggaagggttcaaaaggggccccccgggggggaggccctgggcaccgggaagggggcccctctagaaaggggggccccccgggggggggggggcccccttctaaagggggcggcccactttaaaaaaggggggggggggggcccccccccaaattggggggggggaaaaaca

SEQ ID NO: 30137 - DNA, 672 bp, Zea mays
  misc_feature: Ceres CLONE 1405540-F
  misc_feature: Encodes the peptide sequence at SEQ ID NO. 30138
  misc_feature (52)..(52): n is a, c, t, g, unknown, or other
  misc_feature (370)..(370): n is a, c, t, g, unknown, or other
  misc_feature (394)..(394): n is a, c, t, g, unknown, or other
  misc_feature (636)..(636): n is a, c, t, g, unknown, or other
  misc_feature (651)..(651): n is a, c, t, g, unknown, or other
aaagctggagctccccgcggtggcggccgctctagaactagtggatcccccngggctgcaggaattcgcacgagaccattacctagaacatcctaatcgaaaaatttcaaacgcatctcccccctcacctcgctggcctacgtacgtgtacgtctctctctctccgccgcgacccccccacaagcggcgccggcgcccgcgctgcagctaaaccaaaccctaagccacggccaccgccctacgccgcgggctctccgcgatgcgccggcgcgcggaggcgatcgcgagggccgtggtcgagttcctcgacgccgtcatcctggcctgtctccgctcgtgcttcggcgcgcgcccccgccgcggctccggncgccgagatgcgctcgtgcgcggngatcgggccgcggaggtcatctggcatgaggaaggcttagtaagggacggacgatttcatgaggatttggctgacgggtgtggaatcgatgaggagctcagacgcgaggcaagatacctgaagctatgcggcactatctctgaaaccccagctggactacgctatgagcaatcgtatgaaaactatttggaaactactgatggagtgtgatagcaagctcacgtatggaccaacgtcaagtnggcaatgggctgttngaagctaatccatcacagggc

SEQ ID NO: 30138 - protein, 114 aa, Zea mays
  misc_feature: Ceres CLONE 1405540-F
MRRRAEAIARAVVEFLDAVILACLRSCFGARPRRGSGRRDALVRGDRAAEVIWHEEGLVRDGRFHEDLADGCGIDEELRREARYLKLCGTISETPAGLRYEQSYENYLETTDGV

SEQ ID NO: 30139 - DNA, 684 bp, Zea mays
  misc_feature: Ceres CLONE 1405544-F
  misc_feature: Encodes the peptide sequence at SEQ ID NO. 30140
  misc_feature (528)..(528): n is a, c, t, g, unknown, or other
  misc_feature (642)..(642): n is a, c, t, g, unknown, or other
  misc_feature (651)..(651): n is a, c, t, g, unknown, or other
  misc_feature (657)..(657): n is a, c, t, g, unknown, or other
  misc_feature (658)..(658): n is a, c, t, g, unknown, or other
  misc_feature (672)..(672): n is a, c, t, g, unknown, or other
aagctggagctccccgcggtggcggccgctctagaactagtggatcccccgggctgcaggaattcgcacgagaccattacctagaacatcctaatcgaaaaaacaaccatttcttcttcctttttctatatcgcggtacgtccctacccagcgatctaggccgccgcctctcctactggatctccctcgctctcgtcgcctcgttcgcttcgcctccgccccgccccgccccgaggagagcgcagccctatccggagctgggatggcggacgcgaagcagcagcagcagcagcagcagcagcagccacagcaggcggcagcggcagccaccggcgtgtggaagacggtcaagcccttcgttaagggcggggcctctgggatgctcgcgagctgcgtcatccagcctatcgacatggtcaaggtgaggatccagttgggtggaggctctgctggtcaggtcacaagggacatgcttgcaaatgagggtgtccgttcttttctacaggggtttgtccgcggattggtganggcagcgacgtacacgactggtcgtcttggatcctttaggggtctaactaaccaagcagttgaaaagatggaaggaaagcatttgctctatttcagaaagcttttattggtctngactgtggngcattnngtgcttgtggtggnagccctggtggt

SEQ ID NO: 30140 - protein, 140 aa, Zea mays
  misc_feature: Ceres CLONE 1405544-F
  misc_feature (27)..(112): Pfam Name: Mito_carr Pfam Description: Mitochondrial carrier protein
  misc_feature (89)..(89): Xaa is any aa, unknown, or other
  misc_feature (127)..(127): Xaa is any aa, unknown, or other
  misc_feature (130)..(130): Xaa is any aa, unknown, or other
  misc_feature (132)..(132): Xaa is any aa, unknown, or other
  misc_feature (137)..(137): Xaa is any aa, unknown, or other
MADAKQQQQQQQQQPQQAAAAATGVWKTVKPFVKGGASGMLASCVIQPIDMVKVRIQLGGGSAGQVTRDMLANEGVRSFLQGFVRGLVXAATYTTGRLGSFRGLTNQAVEKMEGKHLLYFRKLLLVXTVXHXVLVVXALV

SEQ ID NO: 30141 - DNA, 674 bp, Zea mays
  misc_feature: Ceres CLONE 1405556-F
  misc_feature: Encodes the peptide sequence at SEQ ID NO. 30142
tggagctccccgcggtggcggccgctctagaactagtggatcccccgggctgcaggaattcgcacgagaccattacctagaacatcctaatcgaaaaaaccatattattgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataagcttcaacaagcaatcgcagcaagcaacatacctttatcgcccttgttgtttcacaatcgccagccctatctttggtgcagtcattggtacaaaccatcagggcacaacagctgcagaaactcgtgctacctctgataaccaagtagctctgggaaacctttcctcctactctcagcacaacaatttcttccattcaaccaactgtctacactgaaccctgctggttatttgcagcaacaactattaccatttagccaggtagctactgcctactctcagaaacaacaacttcttccatttaccaaattggccgcactgaacccggctggttatttgcagca

SEQ ID NO: 30142 - protein, 101 aa, Zea mays
  misc_feature: Ceres CLONE 1405556-F
MATKIFSLLMLLALSTCVANATIFPQCSQAPIASLLPPYLPSIIASICENPALQPYKLQQAIAASNIPLSPLLFHNRQPYLWCSHWYKPSGHNSCRNSCYL

SEQ ID NO: 30143 - DNA, 664 bp, Zea mays
  misc_feature: Ceres CLONE 1405559-F
  misc_feature: Translation starting site: 199
  misc_feature (383)..(383): n is a, c, t, g, unknown, or other
  misc_feature (448)..(448): n is a, c, t, g, unknown, or other
  misc_feature (483)..(483): n is a, c, t, g, unknown, or other
  misc_feature (599)..(599): n is a, c, t, g, unknown, or other
  misc_feature (600)..(600): n is a, c, t, g, unknown, or other
aaagctggagctccccgcggtggcggccgctctagaactagtggatcccccgggctgcaggaattcgcacgagaccattacctagaacatcctaatcgaaaactgggaggcagagacgaaagcctactagcttccctttgggtcggtctcgcgctcccgctgcgcgtctgtctgtctgtctgtcttggagcctcatcaatggctaccatcagagaggagtccgactacgacagcagccggtcctcgctgacggcgccgggcggctcccgccggagctggatcagcgacattggcagcgccagctcggtctcggcgcgctccgtggcggggcgaggctgggacgcgccggcgtgccgccaccgccacaagcctcacaaggcganaccaggccgagtgggaggccatcgggcgcgtccgcgccgcccgcgggccgcgtcggcctggagcnacttccgcctggtgcggcgcctgggcagcggcgancctcgggaacgtctacctctgccagctgcgcgagcctgtcccaacccacggggtgcctgtacgccatggaaggtggtggacaaggaacgcgctggcgtcgaagaaaaactgcgggnncccgcaaaaggtgaaccgagatatcctccgcgcgctcgaccaccccttcctccccacattgtac

SEQ ID NO: 30144 - DNA, 700 bp, Zea mays
  misc_feature: Ceres CLONE 1405560-F
  misc_feature: Encodes the peptide sequence at SEQ ID NO. 30145
  misc_feature (337)..(337): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (447)..(447): n is a, c, t, g, unknown, or other
  misc_feature (495)..(495): n is a, c, t, g, unknown, or other
  misc_feature (520)..(520): n is a, c, t, g, unknown, or other
  misc_feature (521)..(521): n is a, c, t, g, unknown, or other
  misc_feature (551)..(551): n is a, c, t, g, unknown, or other
  misc_feature (579)..(579): n is a, c, t, g, unknown, or other
  misc_feature (632)..(632): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggancctgcggtggtgcaagcaggcgtggcgagtggcagtacggaaaggacaccccgcggaagagggatggnnnagagcgagtgccgcgagcggcaccagcaagctgacgcggngcgaggacggcgaccagcggcgtgggacgcctacgtctccgcctcggnaaaagaaaaaaaaaaaagtgcccgnncgccagtgccctgcgcccgccacgaggggncaaggccgtggaagaacccaggaggggnttttgaaggcggtgcccgcccgccgccgggactgggccgtcgacatggagccnaaaggagttacggtcgcggcagccgagaggcgcgggcaagggccccccggaagaggtgcgagcggcac

SEQ ID NO: 30145 - protein, 162 aa, Zea mays
  misc_feature: Ceres CLONE 1405560-F
  misc_feature (41)..(41): Xaa is any aa, unknown, or other
  misc_feature (64)..(64): Xaa is any aa, unknown, or other
  misc_feature (65)..(65): Xaa is any aa, unknown, or other
  misc_feature (78)..(78): Xaa is any aa, unknown, or other
  misc_feature (94)..(94): Xaa is any aa, unknown, or other
  misc_feature (103)..(103): Xaa is any aa, unknown, or other
  misc_feature (113)..(113): Xaa is any aa, unknown, or other
  misc_feature (122)..(122): Xaa is any aa, unknown, or other
  misc_feature (140)..(140): Xaa is any aa, unknown, or other
MGKGSVGASWWAFLLLAGVLLVVAATAGAEDGVVERDRKEXPAVVQAGVASGSTERTPRGRGMXXSECRERHQQADAXRGRRPAAWDAYVSASXKEKKKSARXPVPCARHEGXRPWKNPGGXFEGGARPPPGLGRRHGAXRSYGRGSREARARAPRKRCERH

SEQ ID NO: 30146 - DNA, 682 bp, Zea mays
  misc_feature: Ceres CLONE 1405562-F
  misc_feature: Encodes the peptide sequence at SEQ ID NO. 30147
  misc_feature (601)..(601): n is a, c, t, g, unknown, or other
  misc_feature (682)..(682): n is a, c, t, g, unknown, or other
aaagctggagctccccgcggtggcggccgctctagaactagtggatcccccgggctgcaggaattcgcacgagaccattacctagaacatcctaatcgaaaactggcttaaccattcctcccaacaccacctcgcctgggatcttcgtagcctccgtcgcgtcgagcatcgatcatgtcggcctactgcggaaagtacaaggatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcacccattgaggttgttggcactgataaggagaccaccacccaaggccatgacgaccttggcaagcgttgcgccaagtactacgaggcaggtgcccgcttttgcagntggcgcgctgttctcaagatgggccctatgagccatcacagtttgcatcgactggacgctcagggtctggctcgtatgccn

SEQ ID NO: 30147 - protein, 109 aa, Zea mays
  misc_feature: Ceres CLONE 1405562-F
  misc_feature (11)..(110): Pfam Name: Glycolytic Pfam Description: Fructose-bisphosphate aldolase class-I
  misc_feature: SWISSPROT Homolog: EC 4.1.2.13 Fructose-bisphosphate aldolase
MSAYCGKYKDELIKNAAYIGTPGKGILAADESTGTIGKRLSSINVENVEENRRALRELLFCCPGALQYISGVILFEETLYQKTKDGKPFVDVLKEGGVLPGIKVDKGTH

SEQ ID NO: 30148 - DNA, 686 bp, Zea mays
  misc_feature: Ceres CLONE 1405563-F
  misc_feature (262)..(262): n is a, c, t, g, unknown, or other
  misc_feature (321)..(321): n is a, c, t, g, unknown, or other
  misc_feature (351)..(351): n is a, c, t, g, unknown, or other
  misc_feature (353)..(353): n is a, c, t, g, unknown, or other
  misc_feature (406)..(406): n is a, c, t, g, unknown, or other
aagctggagctccccgcggtggcggccgctctagaatagtggatcccccgggctgcaggaattcgcacgagaccattacctagaacatcctaatcgaaaaactgccatgttcgcctcgcgctcctcacccccgctatcccctccgtgtcggcgtgcgccgacggcatcttgcccagtctcaaccgattttatccttcggtctgctagggccttgtcaaatcgccgcccacgcgaactcgcgcccgctgcatgggtcgctcgngcaccccacatctcctcaacaatgttcaaactggcaaccacaacatcctccctcatagncccgactctcacacattccaacttggtgcngncgtaaacgcgcagcaacacttcgacccgggtcggcacggcctgcccctaggcngtgacatccagatccatctcgctccgatctacattcgagaagtttgtctccgacatcgattccccagtctgaatcgttgtcgacgtcttcttttgggtggacggtcgaagtcacggggacgcacatcccaaattggttcctccccgggggtgatttcagaaaaactgtcttcttctccgggtcggagcaactcgggccacagggggggaccggtgaacgacgttcttttggggggtaccgattctccggtcgaaaggtcgatgttcttcccatcgaaacg

SEQ ID NO: 30149 - DNA, 684 bp, Zea mays
  misc_feature: Ceres CLONE 1405564-F
  misc_feature: Encodes the peptide sequence at SEQ ID NO. 30150
  misc_feature (684)..(684): n is a, c, t, g, unknown, or other
aagctggagctccccgcggtggcggccgctctagaactagtggatcccccgggctgcaggaattcgcacgagaccattacctagaacatcctaatcgaaaaactgaaaagccccagcgcacccaacccaagagcgaaaatggatccgcaccagttcgccccctcccagcagtcggcgctgaccatggaatcggcggagagcacggccgccgccgtcgcgcgggcgtccaacggcgctgcccgagctgtcgttgaggacgacgacgaggacgactacgcccccgaggtggccgactgcatatcgacaatgctcgaccgagggggtagcgtgtaaagccatcgcctcttgctgggggggcagcaccgagctggacatgctccgcgaccgggaggaccccgttccgaaggaaaaagctcccccgcacccttccgggagttccgcgcctggagggaaataggggccggaattcaaaacgcctcgcctttctccactacccctcacctccaacccggtcaaggaagaaggaaagtggggttccttgtccccctgggactggccaaaaccggagggtattccgggtgaaaatataacctaagccaaagagggaaaacttttcccaaactaaattcttgaaacgccgggaaaaaaaaattgtttacaaccaaaacaatccccccaggggan

SEQ ID NO: 30150 - protein, 64 aa, Zea mays
  misc_feature: Ceres CLONE 1405564-F
MDPHQFAPSQQSALTMESAESTAAAVARASNGAARAVVEDDDEDDYAPEVADCISTMLDRGGSV

SEQ ID NO: 30151 - DNA, 779 bp, Zea mays
  misc_feature: Ceres CLONE 1405567-F
  misc_feature: Encodes the peptide sequence at SEQ ID NO. 30152
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
tggggccccccccccccccccccccaccccccccccggggctccnnnnnnccaaagtggggctccccgcggtggcggccgctctagaactagtggatcccccgggctggaggaattcgcacgagaccattacctagaacatcctaatcgaaaagacctttctagatatttcccaaccccctcagaaaggagaaataatcctccctttctctcctctcctgcctttccccattactactccccagtcccactcccacccgcaggccgcgccgccccagcaaatctcacgcacagaaacaccaaagccccaaaggcccaaactcaccacctcccaatggagaacggcgacgaaaccctcgcctcccccacgaccgccgccgagacggacgcgctcaacggcggcgtcgcggaggaggagcaggtccccatcacccaccccggagagtcctacgtcacgctcgccgacgacaaccccgctcctaacggcggcgtcctgaaagagaaggaggggggtgccccccacccaccgcgaagtcctacgcagctggccgccgcccaaggccgagaatcgaggacctccggggccgcataggtcggaactgggaggagaaacttccgtgaagggccccgcccgtgaaaaacaagtccccctcccccaaggaaaacgcacccggaaccggagggggattctttccgcgagggcccccggggagggaggggaaacacattcgggccgaatttccggcccgccacccttttggggagcgaagaaaagggggg

SEQ ID NO: 30152 - protein, 85 aa, Zea mays
  misc_feature: Ceres CLONE 1405567-F
MENGDETLASPTTAAETDALNGGVAEEEQVPITHPGESYVTLADDNPAPNGGVLKEKEGGAPHPPRSPTQLAAAQGRESRTSGAA

SEQ ID NO: 30153 - DNA, 720 bp, Zea mays
  misc_feature: Ceres CLONE 1405571-F
  misc_feature (213)..(213): n is a, c, t, g, unknown, or other
  misc_feature (261)..(261): n is a, c, t, g, unknown, or other
  misc_feature (388)..(388): n is a, c, t, g, unknown, or other
  misc_feature (480)..(480): n is a, c, t, g, unknown, or other
aagctggagctccccgcggtggcggccgctctagaatagtggatcccccgggctgcaggaattcgcacgagaccattacctagaacatcctaatcgaaaaaagagaggattttgctaggtttttgcccccaaccgcccaactgcgcgtgctcctggcgacctcccaccctcccactccctgcggttggcggctgtctcgccgaagcgacccanccggcgcatccgatatggcgaatggcgacgacgcgctggcgcggaacncaaccgtgtgcgccgcaagcgcctccgtagcagcgagaacgctgttcccgcgcgtgtcgcggcgatcatcgcctccaagcacccgccgcaagtcggggaaacccccgcgcctgcgaaggcaatgtgntttctccctccccacgccccgaaaaccggtttcaacaagcggccatgggaggaaagcacaagtttcgttgacaagcgcgcccgacaacacancccgccaaccccggttgaaggacaggggcaaaccccaagaaagagggggcccgaaccccaaaaaaacatggagcgcgggggaaaaatattggcccccaaagcaaaagccgaaggccgtctcccgaaaagggaaacgggtggggggagggggcccccggggaatttcaacccgcccgcccaagttcctggggggccttgtctcaaccgtaatccgggaagggcgggggccccccgaaggaa

SEQ ID NO: 30154 - DNA, 686 bp, Zea mays
  misc_feature: Ceres CLONE 1405576-F
  misc_feature: Translation starting site: 173
  misc_feature: SWISSPROT Homolog: EC 2.7.11.7 [Myosin heavy-chain] kinase
  misc_feature (451)..(451): n is a, c, t, g, unknown, or other
  misc_feature (519)..(519): n is a, c, t, g, unknown, or other
  misc_feature (545)..(545): n is a, c, t, g, unknown, or other
caaagctggagctccccgcggtggcggccgctctagaactagtggatcccccgggctgcaggaattcgcacgagaccattacctagaacatcctaatcgaaaaaaccgcatcatcctttccctcgcgccgccgccaacgcaacccttgcagccccaatccctcacagcaaccatggctggcgcgcaggagtccctctctctggtgggcacgatgcgcggccacaacggcgaggtgacggcgatcgcgaccccgatcgacaactcgccgttcatcgtctcctcctcccgcgacaagtccctgctggtgtgggacctgaccaacccggtccactccaccccggaatccggcgccaccgccgactacggcgtccccttccgccgcctcaccggccactcccacttcgtccaggacgtcgtcctcagttccgacggccagttcgccctttccgcntccttggggatggagagctccgcctctgggacctctccaccggcctcaccacccgcccgcttcgtcgncacggaagaaggatggtcctctccgnttgccttctccgttgacaacccgccagatcggtctccgcgtcccgcgacaagaccattaagctctggaacacccctcgggtgagtgcaagacaacccatcggagtgggacctccgtggggcggcgaggccacacaaagcgg

SEQ ID NO: 30155 - DNA, 670 bp, Zea mays
  misc_feature: Ceres CLONE 1405582-F
  misc_feature: Encodes the peptide sequence at SEQ ID NO. 30156
caaagctggagctccccgcggtggcggccgctctagaactagtggatcccccgggctgcaggaattcgcacgagaccattacctagaacatcctaatcgaaaagttcccttcgttgcgtcttgaaaggggagagagagagagagaagagagagagaagagagagagagagagaggagtgggagacccgcgagaggctgccgtgtagggaccgtacactctgcgactgcgaaggagggataaggggatggtcgggatcggaccgatcaggctggactgggagccggtcgttgtgcggaagaaggcacccaccgccgccgccaagaaggatgagaaggccgtcaacgccgcgcgccgcgccggtgcggagatcgataccatgaagaagtacaacgctggtacgaacaaggcggcatccagcggtacatccctctgcaccaagcgcctcgacgacgacaccgaatacctcgcccatgagcgagttccaagtgatctgaataagaatctcatgcaagcgaggctcgattagaagctgactcaggctcaacttgctcagatgataaatgagaagccacaggtgattcaggagtatgaatcaggctaggcaatccccaaccagcagatcattatcaagctcgagagggccctgagaaccaagttgcgtggcaagaa

SEQ ID NO: 30156 - protein, 93 aa, Zea mays
  misc_feature: Ceres CLONE 1405582-F
  misc_feature (9)..(79): Pfam Name: MBF1 Pfam Description: Multiprotein bridging factor 1
MVGIGPIRLDWEPVVVRKKAPTAAAKKDEKAVNAARRAGAEIDTMKKYNAGTNKAASSGTSLCTKRLDDDTEYLAHERVPSDLNKNLMQARLD

SEQ ID NO: 30157 - DNA, 798 bp, Zea mays
  misc_feature: Ceres CLONE 1405583-F
  misc_feature (16)..(16): n is a, c, t, g, unknown, or other
  misc_feature (38)..(38): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
ttttatatattttcantttttttatttggtctactagngggnannnnnnaaaaactggagctccccgcggtggcggccgctctagaatagtggatcccccgggctgcaggaattcgcacgagaccattacctagaacatcctaatcgaaaatcccctcagtcctcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggcacgcgcaccaccaccccgtcgtccgtgggcgtggccaccccgcgcgccgggggaggccccatccgggcgttcatctcctcctcccccaccccgccctacgacctgacgtccttccgggttcaaccccatcaaggagtccatcgggtccccggaagatgaccccgcgctacatggacggaactgatcacccaccccaacaccgaagtgggtgatccgtgggccccccgctcccccgggaccctgttccatggcgccgtacaagctttcccaaggacccccccccggggggggggggccactttggcaaaaatgcccgtggccccccgggcggggaaaaacaccagaataggcccgagaaaattttttcggacccaagggagagggagaaaacaaccccccggacccacctggctcctaggaacaaaagatggccccggcgcgctctccccaccgcgggccccctcgatttgcctctgttgcgggggc

SEQ ID NO: 30158 - DNA, 684 bp, Zea mays
  misc_feature: Ceres CLONE 1405585-F
  misc_feature: Translation starting site: 228
  misc_feature: SWISSPROT Homolog: EC 2.6.1.1 Aspartate transaminase
  misc_feature (437)..(437): n is a, c, t, g, unknown, or other
  misc_feature (555)..(555): n is a, c, t, g, unknown, or other
  misc_feature (564)..(564): n is a, c, t, g, unknown, or other
aaagctggagctccccgcggtggcggccgctctagaactagtggatcccccgggctgcaggaattcgcacgagaccattacctagaacatcctaatcgaaaaagcaaaactagcggcgcagtgacaaaagcccacagcttcttccccctcctccttctccgtcatccgtttcgctctctgccgccgccaccgcacaagaagctagctcctgcctgtaccaccccggcatggcgatgctatcccgcgcagcctcctccgcggcccggcgcccgctgctgccgccgcctaggcttctggcggtgagggcgatggcgtcgtcgctcttcggccacgtcgagcaggcgcccaaggaccccatcctcggcgtcaccgaggctttcctcgccgacccctcgtccgacaaagtgaacgtcggcgtcggcgcctaccgggacgancaacggccagcccgtcgtgctcagctgcgtgcgcgaggccgagcgccggatcgcgggcaacctcaacatggagtaccttccgatgggaggcagcatcaagatgattgaagagtcctgnaagctgggntacggagaagattctgacttcatcaaagataagaggatagccagcggtgcaggcgcttttcaggcactggtgcctgccggcttctttgctgatttccaaaaaagcgttttttgccgggat

SEQ ID NO: 30159 - DNA, 849 bp, Zea mays
  misc_feature: Ceres CLONE 1405586-F
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (26)..(26): n is a, c, t, g, unknown, or other
  misc_feature (30)..(30): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
gggggccccccnncnacnnnnnnacnaaanagggannnnnnttccannnnnccaaagctggagctccccgcggtggggggcgctctagaactagtggatcccccgggctgcgggagttcgcacgagaccattacctagaacatcctaatcgaaaaacgcagcagcgacgcgacgcccccgccccgcggcttctactcttcttcatcttcactggtcaccaacccatccatcccccagtcctcctcactggtcacccgtctcccatccccacaccaccaccaccaccatcttccggtcttcccctccccacacccggcgggatccccaccatccccgccccccgatggagctggtcgcgcgcggcaaggtggggcggctcaagaggcacgacgacaagttccctgtacgccgacgaggacgagggcgcacgtgacgcagggagcggcgacgggtccttctgccgaccgcgcggtgggggccgtgggagccgggtggccgacacaccccggggggggcattccggccggggggggagccgggtaacgggccaactaaccttaacccggccccccggggggaaggccgcgttccctggcctgggggatagaccggggcccggggaggggggggcccgaagaggggggtggccggggcgggggcccccgcccccctgtcaaaccccgctccccggtggaactggggggaggcccccgggggggggaaccgggttttcccacggggcgccggccctccgggccaccaggggggggggccccactcttccctccgggggcgccacgggggggggggcttcccgcgccgctggggaggggacactccgccgcaccc

SEQ ID NO: 30160 - DNA, 579 bp, Zea mays
  misc_feature: Ceres CLONE 1405587-F
  misc_feature: Encodes the peptide sequence at SEQ ID NO. 30161
  misc_feature (545)..(545): n is a, c, t, g, unknown, or other
aaagctggagctccccgcggtggcggccgctctagaactagtggatcccccgggctgcaggaattcgcacgagaccattacctagaacatcctaatcgaaaaatttttcgcccgccgcccccagtcccgatccgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtccggcctgctccttatctctgggccttttcagatcatggagtaccgatccgcccgtgtgaccagacctatgtcattgctacntcaaccaaagttgacttccctggggggtgaggcg

SEQ ID NO: 30161 - protein, 139 aa, Zea mays
  misc_feature: Ceres CLONE 1405587-F
  misc_feature (1)..(49): Pfam Name: Ribosomal_L6e_N Pfam Description: Ribosomal protein L6, N-terminal domain
  misc_feature (128)..(128): Xaa is any aa, unknown, or other
MAPTSKLSTGIKRASRSHAYHRRGLWAIKAKNGGAFPKADKAAAAVEPKFYPADDVKPRVPSTRKPKPTKLRSSITPGTVLILLAGRFMGKRVVFLKQLKSGLLLISGPFQIMEYRSARVTRPMSLLXQPKLTSLGGEA

SEQ ID NO: 30162 - DNA, 641 bp, Zea mays
  misc_feature: Ceres CLONE 1405590-F
  misc_feature: Encodes the peptide sequence at SEQ ID NO. 30163
  misc_feature (320)..(320): n is a, c, t, g, unknown, or other
  misc_feature (331)..(331): n is a, c, t, g, unknown, or other
  misc_feature (418)..(418): n is a, c, t, g, unknown, or other
  misc_feature (451)..(451): n is a, c, t, g, unknown, or other
  misc_feature (513)..(513): n is a, c, t, g, unknown, or other
gctctagaactagtgggtcccccgggctgcaggaattcgcacgagaccattacctagaacatcataatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggncggaattgcangaacatggtggcgccgctcctggtgctcaacctcatcatgtacatcatcgtcatcggctttcgcggagctggaaccctgaacacttncatcacgggcagacaactacccccggcgtgccngcaacggcgcgacgtctactttcctggtgtcccatctggcccccgggggggggggcccgccncccaacttggcggggggggaccacgtggggggctgggggcacaaaggctggccacaaagcgcggggcgtcgttcatcggcggggcataggggggttcgccttcggttggccggaagggaatcccatcg

SEQ ID NO: 30163 - protein, 88 aa, Zea mays
  misc_feature: Ceres CLONE 1405590-F
  misc_feature (28)..(28): Xaa is any aa, unknown, or other
  misc_feature (39)..(39): Xaa is any aa, unknown, or other
  misc_feature (60)..(60): Xaa is any aa, unknown, or other
MVAPLLVLNLIMYIIVIGFRGAGTLNTXITGRQLPPACXQRRDVYFPGVPSGPRGGGPAXQLGGGGPRGGLGAQRLATKRGASFIGGA

SEQ ID NO: 30164 - DNA, 805 bp, Zea mays
  misc_feature: Ceres CLONE 1405593-F
  misc_feature: Encodes the peptide sequence at SEQ ID NO. 30165
  misc_feature (1)..(1): n is a, c, t, g, unknown, or other
  misc_feature (7)..(7): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (20)..(20): n is a, c, t, g, unknown, or other
  misc_feature (29)..(29): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
ngggggncccnnnccccccnggggggggntcctaacccccccccnnntnnncaaaactggagctccaccgcggtggcggccgctctagaatagtggatcccccgggctgcgggaattcgcacgagaccattacctagaacatcctaatcgaaaaaaacaacagcgaacacatctgcttcgcatttcttcccatcccccttcgcaacccaaaccccaactcgctccgcatcgatggcgcccaaggccgagaagaagcccgcggcgaagaagccggcggaggaggagcccgcggctgagaaggcgcccgccgggaagaagccgaagggggagaagcgggtccccgctggcaagtccgctgccaaggagggccggcagggcaagaagggcaggaagaagggcaagaagaggggtgagacctaccagatctacatcttcaaggggggtgaagaagggggaccccggacattgggcatcctccctccaagggccatggcccatcatggaaactcccttcgattaaacgattatcctttcgaggaaagctagcgtgggtggagggcccggaaaagggtttcgggggggctaataaccaaggaaagggcgaagcccatgagccctcgcgggggggaaataccagaactgtcccggggcgggcgctcgggcccctttcccgggggggaaggctcgggccaaaggcaaccgccggtctccccggaggggggacccgagggggggcggacggcgcgggggtgcacccctccgcggcctaagggcgtggggggctggccccgccgccggttggggg

SEQ ID NO: 30165 - protein, 104 aa, Zea mays
  misc_feature: Ceres CLONE 1405593-F
MAPKAEKKPAAKKPAEEEPAAEKAPAGKKPKGEKRVPAGKSAAKEGRQGKKGRKKGKKRGETYQIYIFKGGEEGGPRTLGILPPRAMAHHGNSLRLNDYPFEES

SEQ ID NO: 30166 - DNA, 733 bp, Zea mays
  misc_feature: Ceres CLONE 1405598-F
  misc_feature: Encodes the peptide sequence at SEQ ID NO. 30167
  misc_feature (516)..(516): n is a, c, t, g, unknown, or other
tggagctccccgcggtggcggccgctctagaactagtggatcccccgggctgcaggaattcgcacgagaccattacctagaacatcctaatcgaaaaatcttcgccgccgctaaacgttccccccacgccccaacctatccacgcgaaaccttctttcccccgggagacgattcgtcagggagaggaaagaggcaagaggggccatggacgctgccaagttggtgacgccggtcgctgtgtctcacattctggcgcacccgtcggcgggctccgacggcgcagtgaccgatctcgtcgttcaggtcctcgacctgaagtccgtcggcacgggcagccggttcagtttcacagcaactgacgggaaggataagatcaaggcgatgcttcccaccaacttccgggtcggaggtccgctctggcaacctgaagaacctcggcctcatccgcatcatcgactacacttgcaacgtcgtcaaaggcaaagatgacaaaggtcttggttgtcatcaaatgcngagcttgtgtgccaagcgcttgacgccgaggatcacggcgaggccaaaaaagaggagcctccaattgtgctgaagcctaaggacgaatgggatgggcgtgacatccccactcgctatgaagcccagcaggggagtggaagtctgcggtccaaagatcgtgaaaggagcaacggtggaaatactggctcctgtcaagccccttcccggggaaaaagag

SEQ ID NO: 30167 - protein, 94 aa, Zea mays
  misc_feature: Ceres CLONE 1405598-F
MDAAKLVTPVAVSHILAHPSAGSDGAVTDLVVQVLDLKSVGTGSRFSFTATDGKDKIKAMLPTNFRVGGPLWQPEEPRPHPHHRLHLQRRQRQR

SEQ ID NO: 30168 - DNA, 633 bp, Zea mays
  misc_feature: Ceres CLONE 1405602-F
  misc_feature (234)..(234): n is a, c, t, g, unknown, or other
  misc_feature (236)..(236): n is a, c, t, g, unknown, or other
  misc_feature (239)..(239): n is a, c, t, g, unknown, or other
  misc_feature (278)..(278): n is a, c, t, g, unknown, or other
  misc_feature (279)..(279): n is a, c, t, g, unknown, or other
  misc_feature (287)..(287): n is a, c, t, g, unknown, or other
  misc_feature (290)..(290): n is a, c, t, g, unknown, or other
  misc_feature (297)..(297): n is a, c, t, g, unknown, or other
  misc_feature (308)..(308): n is a, c, t, g, unknown, or other
  misc_feature (322)..(322): n is a, c, t, g, unknown, or other
  misc_feature (333)..(333): n is a, c, t, g, unknown, or other
  misc_feature (352)..(352): n is a, c, t, g, unknown, or other
tggagctccccgcggtggcggccgctctagaactagtggatcccccgggctgcaggaattcgcacgagaccattacctagaacatcctaatcaaaaagaggcaaagccgttagccaatctgctgttgcgtgttgcaccgatcaacgtcggttcccagcgcttgctcgtcaagcgtgtcctgctgctgttctctgctcctgcttgccgcgagagctcctctcgctcatctacccnangtncgacagcaacgacttcgtcgagctgctatgggagaacgnnccagcggntgntgcacgnaaagaagaaancagaatccccaggnccgcttcccgncccttcactggggggcggnccagaagaagtaaagctcaagaaaccaggcgggtactaaccgaaccgggcttccttggtaaaaaagggaaggccttttcccgaattttttggccgggcaaaaaaaccccccggggaaaagggaaacttttaaaaaacccgggccctggaaaactgtgccccatcctcaaagaaaaaaaagggcgcgaccccgaacttgttcctttggggggaggttacacccccaaattttttttctctgaagtaccttgaaagaggggttttaaaacccgcgggggaaaa

SEQ ID NO: 30169 - DNA, 675 bp, Zea mays
  misc_feature: Ceres CLONE 1405607-F
  misc_feature: Encodes the peptide sequence at SEQ ID NO. 30170
  misc_feature (240)..(240): n is a, c, t, g, unknown, or other
cggtggcggccgctctagaactagtggatcccccgggctgcaggaattcgcacgagaccattacctagaacatcctaatcgaaaaagcagtactgcctccactgcagtcccagctcagagctctcagcggtggcggccggcgaccggcgacatcctccggtatcgactcccgtggagtggagcgttgaaccacgctgcggacctgcattcaccagtccgccgtttccttcgccttcgccntctccgcgtgatccggttgctctggccactgatggccggtgacattacatgcggatccttgctgcaaaaattgcagttgatatggggatgaagttggcgagaagtgatgaggattcgtgacaaggtcctttatcagctggatcaggaatggccttgatgtttaccaagaggaaagttgaccaagcaataaactctaggggatctcctgatccagggctctgggatgactcaaagatagaacttgctaggcttcttttctgggtcttgggagaaaaagctattgcaagaacccctgagaagacaacaggaacaatcaagcagcagctagctgctatagcgccacccctttgagcagttgactaaacgcaaaaatgaaggaaggaacggaggttttgtaatgtacaatcacaaatggtcccaaatatgtgggtgaag

SEQ ID NO: 30170 - protein, 67 aa, Zea mays
  misc_feature: Ceres CLONE 1405607-F
MALMFTKRKVDQAINSRGSPDPGLWDDSKIELARLLFWVLGEKAIARTPEKTTGTIKQQLAAIAPPL

SEQ ID NO: 30171 - DNA, 683 bp, Zea mays
  misc_feature: Ceres CLONE 1405609-F
  misc_feature: Translation starting site: 166
  misc_feature (353)..(353): n is a, c, t, g, unknown, or other
  misc_feature (415)..(415): n is a, c, t, g, unknown, or other
  misc_feature (505)..(505): n is a, c, t, g, unknown, or other
  misc_feature (639)..(639): n is a, c, t, g, unknown, or other
tccccgcggtggcggccgctctagaactagtggatcccccgggctgcaggaattcgcacgagaccattacctagaacatcctaatcgaaaaagaatcttctgccactgcccttccatctcgtcccttagctacaagtcatctcgccgcaaccggaacccgcagccatggggacggaggcggagcagccggacatggacagccaccgaaacgacggcgtcgtggtggtgccagcgccgcgcccgcgtaaggggctcgcctcctgggcgcttgacctgctcgagtccctcgccgtgcgcctcggccacgacaagaccaagccgctccactggctctccggcaacttcgcccccgntcgtcgaggagaccccgccggccccaaaccttagcgtccgcggcaccctcccggagtgttgnaattgagagttttggtcagggttggccttaaattccgaagtttgctccctggttgcggggtatatcactgggtttggatggaagaccggnatgattcatgccatgcgtaattaaaggatggaaaagctacctatgtatcaagataaatgtgaagactgcccgcctcaacaagaggaaaggaattttggtggaagcaaagttttatgaagattggagacccttangggatttttttggaatgggttaaaggtccaaatggcagaacttc

SEQ ID NO: 30172 - DNA, 762 bp, Zea mays
  misc_feature: Ceres CLONE 1405610-F
  misc_feature: Encodes the peptide sequence at SEQ ID NO. 30173
  misc_feature (271)..(271): n is a, c, t, g, unknown, or other
  misc_feature (411)..(411): n is a, c, t, g, unknown, or other
  misc_feature (456)..(456): n is a, c, t, g, unknown, or other
  misc_feature (502)..(502): n is a, c, t, g, unknown, or other
  misc_feature (525)..(525): n is a, c, t, g, unknown, or other
  misc_feature (532)..(532): n is a, c, t, g, unknown, or other
  misc_feature (551)..(551): n is a, c, t, g, unknown, or other
  misc_feature (552)..(552): n is a, c, t, g, unknown, or other
  misc_feature (579)..(579): n is a, c, t, g, unknown, or other
  misc_feature (580)..(580): n is a, c, t, g, unknown, or other
  misc_feature (761)..(761): n is a, c, t, g, unknown, or other
tggagctccccgcggtggcggccgctctagaactagtggatcccccgggctgcaggaattcgcacgagaccattacctagaacatcctaatcgaaaagacacagcctgagcggctggctggcgggggctagcgagcggcgccacagcgcagcacgcagagagccagggcggcggccatggcgagcgcggcgagtggcggcggcgggtcgctgaagcggatgggcccgctccgggtacagtactacatcgtgatgggcgcggtggcagcggncggtggtgctggccacgctgcgctacatgcgggggccagccgtcccggcgaccaccgcccgtaccagcggagggcggcgtcgtgcgctcggccccagaggccgcggccgtccctgtgcccgtgcccggccgtggaggtanaaaacgggggaggatgaccaaggccgcagagggaggaggaggagnaggaaaaaagaaggggggacgggggaccgtgctccttcaacttcgngttactcccacaagcgacaccgnccggccntgggcgtcggggccatggnnaatcccccatcggcgccgcccgtaggnncagggccctactttccaccacccccacgatgcgggctcctccgagggaggggttcatccgtcgacttcctcctgggaaaagcctgggccatgcccgggccctgaacccgttgcgtgaggggcggtggggctccaaatttgccccaaaggggtaaactctcggccgtgggaggtgcccacgnt

SEQ ID NO: 30173 - protein, 83 aa, Zea mays
  misc_feature: Ceres CLONE 1405610-F
  misc_feature (32)..(32): Xaa is any aa, unknown, or other
  misc_feature (79)..(79): Xaa is any aa, unknown, or other
MASAASGGGGSLKRMGPLRVQYYIVMGAVAAXGGAGHAALHAGASRPGDHRPYQRRAASCARPQRPRPSLCPCPAVEVXNGGG

SEQ ID NO: 30174 - DNA, 664 bp, Zea mays
  misc_feature: Ceres CLONE 1405613-F
  misc_feature: Encodes the peptide sequence at SEQ ID NO. 30175
  misc_feature (421)..(421): n is a, c, t, g, unknown, or other
  misc_feature (431)..(431): n is a, c, t, g, unknown, or other
  misc_feature (466)..(466): n is a, c, t, g, unknown, or other
  misc_feature (470)..(470): n is a, c, t, g, unknown, or other
  misc_feature (517)..(517): n is a, c, t, g, unknown, or other
  misc_feature (518)..(518): n is a, c, t, g, unknown, or other
aagctggagctccccgcggtggcggccgctctagaactagtggatcccccgggctgcgggaattcgcacgagaccattacctataacatcctaatcgaaaaatctcccacgcactccgcaattccgcatcacgcaccccaccccaccgcccgcaaacgcaagctcagattccctcccaccccaccccaccgtcccgctcactccaggccagcccgcgtccccacagcccagcgacagcgagcaccggcggcatccagccatgtgcggcggcgccatcctgtcggacatcatcccgccgccgccgccgcgagggagtcacggcgggccacctctggcccgagagcaagaagccgatgagggctgcagccggcaggaggagagccctcgtgcagcaggagcagggagaggatttcgagcgacntcgaggagtnccaaggtggagtccggcgagtccggagctccaggncccnaggaggagccaaaccaaagccttctcccccccacaaggggtttgggnnaaaagggggactaacactgggggaactggggggggcaaatggcctggttggatttcgttaaagggaagggaaaaaaaccctttccggggtttcccccgggccccggggggaaaatgggttgcgtgaaaaacaaaacccccccaggg

SEQ ID NO: 30175 - protein, 96 aa, Zea mays
  misc_feature: Ceres CLONE 1405613-F
  misc_feature (23)..(23): Xaa is any aa, unknown, or other
  misc_feature (38)..(38): Xaa is any aa, unknown, or other
  misc_feature (55)..(55): Xaa is any aa, unknown, or other
MRAAAGRRRALVQQEQGEDFERXRGVPRWSPASPELQXPRRSQTKAFSPPQGVWXKRGTNTGGTGGGKWPGWISLKGREKNPFRGFPRAPGGKWVA

SEQ ID NO: 30176 - DNA, 780 bp, Zea mays
  misc_feature: Ceres CLONE 1405614-F
  misc_feature: Encodes the peptide sequence at SEQ ID NO. 30177
  misc_feature (339)..(339): n is a, c, t, g, unknown, or other
  misc_feature (340)..(340): n is a, c, t, g, unknown, or other
  misc_feature (374)..(374): n is a, c, t, g, unknown, or other
  misc_feature (387)..(387): n is a, c, t, g, unknown, or other
ctggagctccccgcggtggcggccgctctagaactagtggatcccccgggctgcaggaattcgcacgagaccattacctagaacatcctaatcgaaaacagcatcgccgccccccctctccgcctcaaggctctcctctcggaggtctgataggcaacccaataatggcagaagtcctatcaggatctcatgaacaccgtctaagctctgccttagatggacactacgacgagaagaggaaatccaatgtggaatacacagaggacgagaagaaagccgtgatcgcggctctgaaaaagaagctttgagcgcctcacagaagtttagcattccatgaanngaggggagaagagcagcaaggtgatgtccatctncgatctggatgancgtgaacctgaggaggtgcaggcttggggatgccttccggcagctttctgaactgaaagagctgctaccatcgcaggctggtgccctacccctggggctaaaaattccccggggaaaaaaattttgtatccaaaaaggaaacaatgggggcttaaatttctaaaggaaaaaaagagtttcggggaaaaaacctttccggggatttttaatttcaaaaatttttttgggggggaaaaacccccccccagggaatattgtgggaaaaaaaaaagaggggcgcctcttttttttaaggggtggagaaaaaattggggaaaaaaattggggggcgcccaaaagggggtttttttttaaaaaaaggggggggggggaaaaaaattttttttttatctc

SEQ ID NO: 30177 - protein, 47 aa, Zea mays
  misc_feature: Ceres CLONE 1405614-F
MAEVLSGSHEHRLSSALDGHYDEKRKSNVEYTEDEKKAVIAALKKKL

SEQ ID NO: 30178 - DNA, 737 bp, Zea mays
  misc_feature: Ceres CLONE 1405615-F
  misc_feature: Encodes the peptide sequence at SEQ ID NO. 30179
aaagctggagctccccgcggtggcggccgctctagaactagtggatcccccgggctgcaggaattcgcacgagaccattacctagaacatcctaatcgaaaaactgcgatgtggtcctctcctcctatcacctgacctccacacacacacacagacagacaggcacgcgcaagcaaaaattcattcatatatgcacgctcgttcgttgtcgatctcccccatcactgcacggcgcggcgcaacaagagcgagggattggagctcagctagtcgtctaatcagctagtaggtacgtgtagctaggctgcgctgcaccagctgccgtgcatgcagtgcatggcgcaggagggctctgaggcctccgtcgccagctccccgccgccccagccgacgccgtaggcctcctcctggtggcgcgacatgcagtacccggatgtctacggagcgtgaactccgtcccacgcgacgaggaggacgaccccgtgatcgatggagccggcagcgacgcagcatcagcatcagcacggcggacggacgacgacgtcatccgatgaactctcagacttcaacgccaacgatatagccttcaccaacaattcaagttccaggatcatgcgggactccgagatgaaccctaaaggccgcactaaggggtgaaaaagaagcaaagcctgcttatttaaacggtttgaacgaacaatggggataaggataagaaggccctataaatgattccc

SEQ ID NO: 30179 - protein, 55 aa, Zea mays
  misc_feature: Ceres CLONE 1405615-F
MEPAATQHQHQHGGRTTTSSDELSDFNANDIAFTNNSSSRIMRDSEMNPKGRTKG

SEQ ID NO: 30180 - DNA, 703 bp, Zea mays
  misc_feature: Ceres CLONE 1405617-F
  misc_feature: Encodes the peptide sequence at SEQ ID NO. 30181
tggagctccccgcggtggcggccgctctagaactagtggatcccccgggctgcaggaattcgcacgagaccattacctagaacatcctaatcgaaaagtttcctctctccaattcccacccgcgtcaaggagcttctcgtctgagcccgagctaacaagctcaccggcgggcaggatgctggcggcgtccaccaaggtcggctctaggctggcctctccgcacgcctccttgtccgccggtgctgcagcggcggcgctggcgagctcccccgtgctgggctctgggatgctcccaggcgccgagatcggcgagacggtgagtcaccacgcggcggacgctgcgtacgcgctgccttgaagttcctcgagcgattcgaggtactattatcagtggcagagactgctgaatcaaaggcagtcaccgcctgatggaaggaaaagtgcctggatcattggaccacaattggttttgggggggggacttttccctagggaacctgaattgaaagaaattttttcactttcccctcaggggagagtatggccccgggggccagggtttcaaagaaccttcccgggtattaaaaaaatgggggaaaaatagcccccgaaggggtccaaaaaagcggagggtttttgggcgccaacttttaagaagccttttttaataaaaaagggcgcccccgggtttgcttgggggggt

SEQ ID NO: 30181 - protein, 60 aa, Zea mays
  misc_feature: Ceres CLONE 1405617-F
MLAASTKVGSRLASPHASLSAGAAAAALASSPVLGSGMLPGAEIGETVSHHAADAAYALP

SEQ ID NO: 30182 - DNA, 678 bp, Zea mays
  misc_feature: Ceres CLONE 1405618-F
  misc_feature: Translation starting site: 207
  misc_feature: SWISSPROT Homolog: EC 1.3.3.6 Acyl-CoA oxidase
  misc_feature (352)..(352): n is a, c, t, g, unknown, or other
cgcggtggcggccgctctagaactagtggatcccccgggctgcaggaattcgcacgagaccattacctagaacatcctaatcgaaaagcatcgcactccctcaatctctcgtctctatcgccgcatcgcttctctgccggagctccaacaacctcgcctcgcgcagcactccgctgaccctccctgactccctccctgccgctgggatggccgggaaacgagttacgggccgcgatgggcaagacgagggcggcgccaaggtcgggctcccggcgatggacctctccctcgcgttcccgcaggccacacctgcctccattttcccgccgtccgcttcggattattaccagtnctgatgatttgctgaccagtgaagagcgctctatcaggatgaaggtcaggggtattatggaaaaagaaattgctcccattatgtcagcgtactgggaaaaaggcagagtttccatttaatgccattctaaactgaaaaggccttggggggttgctgggggaacaaaaaggggttaagggggggcccaggaacttccattacaagccagggctggtgcactatgtcgaaaattgcaccgggaagaaggcaagctgttccaacatttaaactgggggccttctcccctggggggaggggacaatagccttctttgggggatccggagg

SEQ ID NO: 30183 - DNA, 766 bp, Zea mays
  misc_feature: Ceres CLONE 1405621-F
  misc_feature: Encodes the peptide sequence at SEQ ID NO. 30184
  misc_feature (1)..(1): n is a, c, t, g, unknown, or other
  misc_feature (279)..(279): n is a, c, t, g, unknown, or other
  misc_feature (338)..(338): n is a, c, t, g, unknown, or other
  misc_feature (348)..(348): n is a, c, t, g, unknown, or other
  misc_feature (349)..(349): n is a, c, t, g, unknown, or other
  misc_feature (431)..(431): n is a, c, t, g, unknown, or other
ncaagctggagctccccgcggtggcggccgctctagaactagtggatcccccgggcttgcaggaattcgcacgagaccattacctaagaacatcctaatcgaaaactttcatcatccaatccagatcagcaaagcggcagtgcgtagagaggatcgtcgaacagaacagcatgaagatggtcattcgttctcgtcgtgtgcctggcttcttgtcagcttgccagcgcctctgcaatgcagatgccctgcccccttgcgcggggcttgcagggcttgtancgcgcttggcgccggctgacgacgatgatggggcgccggcgggctgtacccctacgcgnagtacctganngcagcgcagtgcagccggctggcgggcgcgcctactaagcccgggtgggggcaaaacaacgccatggaccagccgctcccgnaaacatgctgcagcagaaaatgaaggttgatgggactttgcaattcgtcccgcaccatttgaaaatgatgaatgaattttgaagggggccctttcccccaaaaaaaactttgtacaaaccaattttggatgggaaaaaaaaaagaagttgttggaaacccaggggtccaacccttgggggctggtgaaaggggggaaaaattggcgcgcctttgggggggaattttaaccaaaacaaaaaacaggtttgccagttttacgcaaaacccgggggggggggttccggggtgttttccccccaaagagtgttttggggatttttgggaaattccccct

SEQ ID NO: 30184 - protein, 50 aa, Zea mays
  misc_feature: Ceres CLONE 1405621-F
  misc_feature (15)..(15): Xaa is any aa, unknown, or other
  misc_feature (35)..(35): Xaa is any aa, unknown, or other
  misc_feature (38)..(38): Xaa is any aa, unknown, or other
  misc_feature (39)..(39): Xaa is any aa, unknown, or other
MQMPCPLARGLQGLXRAWRRLTTMMGRRRAVPLRXVPXXSAVQPAGGRAY

SEQ ID NO: 30185 - DNA, 849 bp, Zea mays
  misc_feature: Ceres CLONE 1405622-F
  misc_feature (19)..(19): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
aaacaaacaaaaaaaaccngcgcggcgggcgcgaagagcggggagaaaaannntgggtatgggggagtccccgcggtggcggccgctctacacctagcggagccccgggctgcaggaatcgcacgagaccattacctagaaatcctaaccgaaaaaacccccctttcccggcacgccatctcctcgccgcttcccgccacctctctcccatggcggcgccggcggcggccacgtcgcaggagaagtgcagcgcaggtcccgcctacgaggcttcaccctcaaggaggacgcccctcgaggagggcgccgccttcctcgagcgcttcccggagtgcgggggaggaccccgctcgatctcccctcctcgacgaggctcgacaaggaaaccccctgctgtcggcgggtactggaccccgggacgcgcgaaaaaggggggcgggtgcgccgcctcacttggtcgtggccccgccaggctggcctacaacgacgggcgcactctaccagaggcaccgagaccaggcgggacggtgccccctctccctgcggggcgagagacggaaacaacatcgagaccacaacccgctgcgcgctcagcccatccgccgccgcaacacgcgcggggggcaacggcgaccacctctccatggtggcccgcccccggaagacagcccgccccgatgttgcgaaaatcaaagataaagagtcgataagcacactccaaccgtcacacacgttcgacgcggccttctaggcgtgttcgtgtgagcccatgacgcggtgagggagcagatatggggagtaggcgagcaagagcgccttgtcggggagctgtgtgcgggctgtaggcgt

SEQ ID NO: 30186 - DNA, 685 bp, Zea mays
  misc_feature: Ceres CLONE 1405623-F
  misc_feature (262)..(262): n is a, c, t, g, unknown, or other
  misc_feature (335)..(335): n is a, c, t, g, unknown, or other
  misc_feature (610)..(610): n is a, c, t, g, unknown, or other
cgcggtggcggccgctctagaactagtggatcccccgggctgcaggaattcgcacgagaccattacctagaacatcctaatcgaaaaagccgccacctcaccccccccatcggccgcctgcgtcccaccacccgctcctgctgccgggcctgccgcccgttgctctcgccactgaagccctcgccgccgcctccgcctccgcccgcttgcttgccctcctgccggctgcctcccggatgagaagcggcgcaacctgggcagncggaagcgtggtcggcctgagcccttcgccggggtttctgccgagaaggatcctggagattaaagcgcatggntttccttggaggcccgggtacaggccgggcggggggcagctgaggacacagcctaagagaaggacccaaaaaagcaaagtttttcaaagaggttgaaaaaatttgaatgtttttggcttgggagaaaaagtcctgggtggcaaggttccgatcggatgcaacttttctcttcgctatcatggtctgctgcatttctaacaatcctatacacaccaatctgtgtatgaacattcagttgcagtcaagctctcggcttgtcaatggggtggataggngaaaaaagagaagttctgatccccgatatgtatcttctgctagattcaatcgcgaggatggatataaaagattcc

SEQ ID NO: 30187 - DNA, 679 bp, Zea mays
  misc_feature: Ceres CLONE 1405624-F
  misc_feature (258)..(258): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (435)..(435): n is a, c, t, g, unknown, or other
  misc_feature (537)..(537): n is a, c, t, g, unknown, or other
  misc_feature (545)..(545): n is a, c, t, g, unknown, or other
  misc_feature (552)..(552): n is a, c, t, g, unknown, or other
  misc_feature (567)..(567): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (578)..(578): n is a, c, t, g, unknown, or other
cgcggtggcggccgctctagaactagtggatcccccgggctgcaggaattcgcacgagaccattacctagaacatcctaatcgaaaaatcctaaggccatacgatgcgatggtgcagcgaacgccgactccgcgtctcctgtgggctctgctcctcctcttcgatcccactcccgacccgatggccacctcttccgtgctcccgctccagctcgtgtcctgcgcgcgtcggtccagcaccgccgcgcgcgcctccggngcccccggaggtgtcgtcgaccagcgcgcactcccgtggagtactgctacaaacgaattggacataaatcccatggcaaccttgagcgcacgnnnnnngccggcgggggcagttgaggaaacgcctaaaagaagaaccaaaaaaccaaaggttcaaggaggtgaaaaattgaggttntgggcgggaaaaaaaacctggttaaaaaaccaaaaaaaaatttttttatcgcacataatggcggccgatcttaaaatgcaaaacaccaactggcgtgaaggngggggggnggggggnggtggggggttgggnccccnnnnncntctcacgtagcgtctcacccccctctcttccccgcgcccgtgcccacccgacacagccctcagatccgccttttaattaatatatagatccgaccgaataa

SEQ ID NO: 30188 - DNA, 760 bp, Zea mays
  misc_feature: Ceres CLONE 1405626-F
  misc_feature (190)..(190): n is a, c, t, g, unknown, or other
  misc_feature (285)..(285): n is a, c, t, g, unknown, or other
  misc_feature (617)..(617): n is a, c, t, g, unknown, or other
  misc_feature (725)..(725): n is a, c, t, g, unknown, or other
aagctggagctccccgcggtggcggccgctctagaactagtggatcccccgggctgcaggaattcgcacgagaccattacctagaacatcctaaaaaaaaaggaattctgccttcttctctcatcttcctgctcaacatcagtagcagctttagctgtagcagcgccaccggccaccgccacgccatggncaccacgttgcacaaagcccctgggggcgatcaccgttgacgaccctcgcccgcgcggggccctgggtcggaacgcaccgggctccacgcagggntccggggcgcgctcgactcgcacgaacccaccgaaggggtggggcgagtcttgccggcccgggtctttgtccggtttgccccctttgccggcaaacggatggtcttaaaacgggtggtttcccccgggttccccgtttccccccccccccccgtgaaaccccaaaccccaggaggggtgggttttttaaaaaaggggccccgggccccccaaggggggggggggagggggtttctttcgcgggggggaaaaaagaggtccccttcaccggtttttccaaaacccccaaaaatttttcccaaaaaaaaaaacaagggggttggggaaaaaaanttttttttgaaagaggggtgtcccccccctccggggggagcccccccctcttctgggggaaaaaaaaacccttttttcccgggggggggaggggggaacaaagggggnaacacaaaacggggggggaaaaaaattttacgcct

SEQ ID NO: 30189 - DNA, 698 bp, Zea mays
  misc_feature: Ceres CLONE 1405628-F
  misc_feature (194)..(194): n is a, c, t, g, unknown, or other
  misc_feature (221)..(221): n is a, c, t, g, unknown, or other
  misc_feature (263)..(263): n is a, c, t, g, unknown, or other
  misc_feature (325)..(325): n is a, c, t, g, unknown, or other
  misc_feature (364)..(364): n is a, c, t, g, unknown, or other
  misc_feature (503)..(503): n is a, c, t, g, unknown, or other
  misc_feature (675)..(675): n is a, c, t, g, unknown, or other
caaagctggagctccccgcggtggcggccgctctagaactagtggatcccccgggctgcaggaattcgcacgagaccattacctagaacatcctaatcaaaaaacacgcgcgcacgtaaaaacgaaaaaaggtccccggccgagaccgagagccgcggtccagagcggggggcggccggcaaggacgaaacggnccaacgccaccacctccaccacctcgntctcgatcgacacctcccccgtcgccgtcccgtgactccccngctcagccgtcaggcccagctgcccccgcgacccagacgaccacgtcccgcttcggctgcgncttcccgcttacagagtccgtccgcccgcagggctgcgntggcagggagccccttccttctcactctctgggggggggagattccgttcctttttcttggccccggtaacgggaggagcactgcaggggcccgggtttttggactggcatggaggggggggggcggtttcgcgggggnggggggtttttgggctttgatttaccattggcaagggggggtttgttgggggggccccttttttttttcggggtcttttttttaacttctcggggggggggggggtttttccaccgtggttttacccccggtggtaccccaaaaacggccatcttcttttttacaaaatgtngcaaaatttttggaatttttttt

SEQ ID NO: 30190 - DNA, 674 bp, Zea mays
  misc_feature: Ceres CLONE 1405632-F
  misc_feature (190)..(190): n is a, c, t, g, unknown, or other
  misc_feature (193)..(193): n is a, c, t, g, unknown, or other
  misc_feature (195)..(195): n is a, c, t, g, unknown, or other
  misc_feature (205)..(205): n is a, c, t, g, unknown, or other
  misc_feature (221)..(221): n is a, c, t, g, unknown, or other
  misc_feature (222)..(222): n is a, c, t, g, unknown, or other
  misc_feature (225)..(225): n is a, c, t, g, unknown, or other
  misc_feature (226)..(226): n is a, c, t, g, unknown, or other
  misc_feature (273)..(273): n is a, c, t, g, unknown, or other
aaagctggagttcaccgcggcggcggccgctctagaatagtggatcccccgggctgcaggaattcgcacgagaccattacctagaacatcctaatcgaaaaattcggatttccttccgccttccgacagcggctgtctcggcgacccaaccccagcctgaccccactcccgccccgcgccgccgcgccgncgngncttcgtcgtnaggagaaaggtcccgnntgnntgggtctttctccccctggcccccccctggtttccaaaattccgggntttcacgcggtcgggtccggtaccggagggccctcgactcgtacgcccgtccccggggggggattcggggcggaaccggtaaccctagaacttccaacggggcaaggaaaagatggggctcttgaaaaaaaaattgtcctcccaaaaaaaggggtcttggggaaagggggccccccccaaaaaaaactgggtaaaggggggggggggggggacaccccaaaaaaaaaaaaattttggggggggggcccccccccgggggggtttcacaaaaatcggggggggggggggcacctttccggggggccgcgttatttttttgtttataacaaaattatttggggccttggggggggggggggggtgggaaaaaaaccccctttatataccgggggggatttttc

SEQ ID NO: 30191 - DNA, 665 bp, Zea mays
  misc_feature: Ceres CLONE 1405633-F
  misc_feature: Encodes the peptide sequence at SEQ ID NO. 30192
  misc_feature (267)..(267): n is a, c, t, g, unknown, or other
  misc_feature (276)..(276): n is a, c, t, g, unknown, or other
  misc_feature (329)..(329): n is a, c, t, g, unknown, or other
  misc_feature (360)..(360): n is a, c, t, g, unknown, or other
  misc_feature (378)..(378): n is a, c, t, g, unknown, or other
tccccgcggtggcggccgctctagaactagtggatcccccgggctgcaggaattcgcacgagaccattacctagaacatcctaatcaaaaactttaaaatggacgcgcacctccacctgggtctgtctgcgcagggacgcggacgcggcggcaccggcaagcaattgtctcatctgctccactccatctccatttaacgcactctccactccttcgcggcgggggtttaggcgcacggcggcaggccaattaacgccgctgcggcgnagcgccggngaggggaaatggggcggcgacgggcacgagggcgctggacaagacgccgacgntgggcccgtggccgccggtctgcgctgtcantcgtcgcggcgtccaaanctcctcgagggcttcctccaccaccctcggtcagttgctcaacaagaagcggaaagaaggcgctgtttgacgcctctggagaaggttaaatcggagctggatgactctggggttcatatcgctgctgctgaccgtgacgggaaggtacatcgcgcgcatctgcatcccggagggagccgcaaacaccatgctgccctgccgcctgtccggtcactcgggggcggaagaggccaagggccctggccgacggaacctatctgaagtacaaccaaccctttttcctggcc

SEQ ID NO: 30192 - protein, 62 aa, Zea mays
  misc_feature: Ceres CLONE 1405633-F
MTLGFISLLLTVTGRYIARICIPEGAANTMLPCRLSGHSGAEEAKGPGRRNLSEVQPTLFPG

SEQ ID NO: 30193 - DNA, 764 bp, Zea mays
  misc_feature: Ceres CLONE 1405634-F
  misc_feature: Encodes the peptide sequence at SEQ ID NO. 30194
  misc_feature (196)..(196): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
caaagctggagctcaccgcggtggcggccgctccaaaaacaagtggaacccccgggctgcaggaattcgcacgaagaaccatttaaccttaaaaacattcctaatcgaaaaataaaataacacacaaagttgtccgatcaaagcttgcgcgtttacaattgtctggacgatcaaggcacttcacaatgtccacccntctcgctacgagcttcttctttgtactcctatgcagctcgcttacagtacgtggcgtggactacacgttcgtgaaagacgcgacgctgacgcccagcgtgtcgtactacgacacctcatcgcgggggcgcggaaaccgcccgaatggccgctgcccgcaccccttgtcgaaccctttccggtttctcttgttttaaaaagggttcccggccctaaaaagagaaaaaggttttgggaaaatggccccttttttggggaacacttttggggaaacctccccgggtttcgccccgaaaagatttttgggggaaggaagcggggggctcaactctgcccccctttttttttttgaacccccaattttttttaaaaaaccggttttttaacccggggccaaaaaaaaataattgtgggggggtaaaaggggaaatctggccccccccccccgggttttaacatggtgttttgtaaaaaaaattnnnnnttccattcccacctgggggcccccaaaaaaaaaaacactttttttgggccccccccaaagggggggcccccctctcggtaaaaaa

SEQ ID NO: 30194 - protein, 68 aa, Zea mays
  misc_feature: Ceres CLONE 1405634-F
  misc_feature (4)..(4): Xaa is any aa, unknown, or other
MSTXLATSFFFVLLCSSLTVRGVDYTFVKDATLTPSVSYYDTSSRGRGNRPNGRCPHPLSNPFRFLLF

SEQ ID NO: 30195 - DNA, 731 bp, Zea mays
  misc_feature: Ceres CLONE 1405635-F
  misc_feature: Translation starting site: 193
  misc_feature (412)..(412): n is a, c, t, g, unknown, or other
  misc_feature (443)..(443): n is a, c, t, g, unknown, or other
  misc_feature (656)..(656): n is a, c, t, g, unknown, or other
aaagctggagctccccgcggtggcggccgctctagaactagtggatcccccgggctgcaggaattcgcacgagaccattacctagaacatcctaatcgaaacttctacgtaacacttttcccgtcttccccttcctcgccgcctccactacagggctttgctcctcccaactctcgaaaccctacccacccgatgagagatcgatcggtcgagcgcgaattccccagccgcgaggggggggatcggccgccgcccggggtgctggggcccccgcgccgcgggccgggtacaagacgaagttgtgcgcgctgtggcagcgcggcggctgttcccgcgacacatgcagcttcgcgcacggacacgcgaagctccgccggtttccccggatcgcgcacctcgttccaccccgcgnccgggagaagaatctatagagctggtgactntcagagataggtttgataggaggcgctcacctcataggaggcattcccctgatggagattccagacgccatcgctcccttcggtgaccgacggccaaattcccaagaaagggaatctagctattcacggtctcccaggtaggaagagtgaaatgaggcatgagaagaagcctgatgatggagaaactaactcatctaggagtctcagtgtctnctgacataatgatgatagaaaaaagagacactgttaagtggtgattgataaagaggatcacgaaatacagctcaa

SEQ ID NO: 30196 - DNA, 729 bp, Zea mays
  misc_feature: Ceres CLONE 1405636-F
  misc_feature: Encodes the peptide sequence at SEQ ID NO. 30197
  misc_feature (310)..(310): n is a, c, t, g, unknown, or other
  misc_feature (311)..(311): n is a, c, t, g, unknown, or other
  misc_feature (345)..(345): n is a, c, t, g, unknown, or other
  misc_feature (360)..(360): n is a, c, t, g, unknown, or other
aaagctggagctccccgcggtggcggccgctctagaactagtggatcccccgggctgcaggaattcgcacgagaccattacctagaacatcctaatcgaaaaaattgggaatttctcctcgccgcctcgtctctgccgggctcgctcgtacgtcgctccccacccgcaatggcggacactttcgccctcctccttctcctgatcctgtcctcgtcggtccgcgccgcccccgacgccgtggtgtcgagaatcgccttcggatcctgcgccaaccagagcgagccccagcccatttggaacgccgtcgcgnngttcgaccccgcaggtgtcgtctggctcgggaanacgtctaacgcgacnacagcgcccattccgggtcttcggaaggagcgcaccgtgggccctggaagaacgtgcgggcttctaccttccacgagaagaactgcggaggggtaccgctcccagggcgcacccggaacccaggttagggaagggtccaggtctggaaactgggaggcatgttttggttgaaggggggaaaaaaatttgggggaaagggttgccaaagttttgttaaatttttggggaccctgaaaaaaaaggggaaaaaggggggtttgccacaaaagtggccccgagaaaaaagggggagaaatttttgtgtgaaaaaaaaaaaaacccctttaaggggggaaattttgggaaccccccgggggtttaaaaagagtt

SEQ ID NO: 30197 - protein, 120 aa, Zea mays
  misc_feature: Ceres CLONE 1405636-F
  misc_feature (48)..(48): Xaa is any aa, unknown, or other
  misc_feature (59)..(59): Xaa is any aa, unknown, or other
MADTFALLLLLILSSSVRAAPDAVVSRIAFGSCANQSEPQPIWNAVAXFDPAGVVWLGXTSNATTAPIPGLRKERTVGPGRTCGLLPSTRRTAEGYRSQGAPGTQVREGSRSGNWEACFG

SEQ ID NO: 30198 - DNA, 667 bp, Zea mays
  misc_feature: Ceres CLONE 1405637-F
  misc_feature (401)..(401): n is a, c, t, g, unknown, or other
  misc_feature (474)..(474): n is a, c, t, g, unknown, or other
tccccgcggtggcggccgctctagaactagtggatcccccgggctgcaggaattcgcacgagaccattacctagaacatcctaatcgaaaaaaccgcgccgctctctctctctctctcgcacgagccgcgccggcgccgccaccacgcgcgcgggagacagagaccacagccgcagccaccggcgggcggaatagaatgtgttggcgccgggaggaggagcaggaggaggtccgtcgcggtggtcggcggcggaggagcttgacactgtacggaagaaggtggtggagattagtggaagggatgaacaagaggttatggttgctgcttgcccctacagaatttggccctttgggggctcatattgatcatcagggggtggagtagtcacagctatgacctnaaattatggagtactccccttggtttcgtcccccctaatggggttctgaggttttacttcattctgggcaggnttgaaggtgctataagattcagagttgatgacttgcaaaagcctattgataaacctgagaactaaaactggggaagttatgcaaaaggtgctgttagtgcactgcagaatagtggatatgatctaaggaagggtatcataggatatatttctgggtgtgaaaggtcttgatagttcagggctcagttcttctg

SEQ ID NO: 30199 - DNA, 675 bp, Zea mays
  misc_feature: Ceres CLONE 1405641-F
  misc_feature: Encodes the peptide sequence at SEQ ID NO. 30200
  misc_feature (219)..(219): n is a, c, t, g, unknown, or other
  misc_feature (220)..(220): n is a, c, t, g, unknown, or other
  misc_feature (236)..(236): n is a, c, t, g, unknown, or other
  misc_feature (250)..(250): n is a, c, t, g, unknown, or other
  misc_feature (282)..(282): n is a, c, t, g, unknown, or other
tccccgcggtggcggccgctctagaactagtggatcccccgggctgcaggaattcgcacgagaccattacctagaacatcctaatcgaaaattggctgctgctcccttctcccaccgaccaactcgatcccgcgccatggatcgcgccgaccccgcgcggggccgccttgccgtgctctcctcccacctccgtggtgcaggggccgaggaggcggcggnnctggaaaggtccccgnaattcggcggcggngcccgggccccgcgccgggcgctttgccgggngggacgggaggaaccgggaacgggaccgaggtcagggcttccaaaaaaggaaccggggggggcacggatttaagaaaaataccactgggaaaggcggacaaggggctaaaaaattataaagcccgggggaacctaaaaccggggccccgggtgcctcggcccacttgctaaatacgggggggagaggggggggaaccttccgctctaaggggggtttcccgccccaaaaaaatgggggaaaaaaacctcctttttttgaggggggccaccccttttaggaaggggagattttgcgcacccaaaaaaaatgtgggggggggggaaaatttttatattttccccaatttggctggggtccccagagggggggggggataaataaagaagaacggc

SEQ ID NO: 30200 - protein, 72 aa, Zea mays
  misc_feature: Ceres CLONE 1405641-F
  misc_feature (28)..(28): Xaa is any aa, unknown, or other
  misc_feature (34)..(34): Xaa is any aa, unknown, or other
  misc_feature (49)..(49): Xaa is any aa, unknown, or other
MDRADPARGRLAVLSSHLRGAGAEEAAXLERSPXFGGGARAPRRALCRXGREEPGTGPRSGLPKKEPGGARI

SEQ ID NO: 30201 - DNA, 697 bp, Zea mays
  misc_feature: Ceres CLONE 1405643-F
  misc_feature: Encodes the peptide sequence at SEQ ID NO. 30202
  misc_feature (368)..(368): n is a, c, t, g, unknown, or other
tccccgcggtggcggccgctctagaactagtggatcccccgggctgcaggaattcgcacgagaccattacctagaacatcctaatcgaaaaacactcgtccactcaccccctctttgctctgcctcgccgcgccgcagagcagagcatggcgcccccacgccctctcctcgccgccgtcttcctcgccgcggcggttctgctcctcctttctccggcagaggcggggacggtgggcgtgaactacggccgcgtggcgaacaacctgcccaaccagcgtagttgggcagctgctcagccagcaggccgtcgcgcagggtgaagctgtacgacgccgaccgcaccgtgctgcgcgccctcgcgacacggnttcaaagggggggggttgggcctgcccaacgagcaggggccggtggtgggggtcgggggggtcctaacagttgggttggggtggatccgcaaacggtgcggcgcaccccccggccgaaccagaaggcgtgttttccccgtgcgcttagaggggggcggccctcacaagaggttttctttcctctcctcttctgtccggtgtcgcgtgaccccctttgtttgggttccctccccctccccgccccgcacccatcacctcccactcccatttttgttacaatgggtgccgcaaggatattggccaaagcggacgccttagcggtacccgcc

SEQ ID NO: 30202 - protein, 57 aa, Zea mays
  misc_feature: Ceres CLONE 1405643-F
MAPPRPLLAAVFLAAAVLLLLSPAEAGTVGVNYGRVANNLPNQRSWAAAQPAGRRAG

SEQ ID NO: 30203 - DNA, 742 bp, Zea mays
  misc_feature: Ceres CLONE 1405646-F
  misc_feature: Encodes the peptide sequence at SEQ ID NO. 30204
  misc_feature (547)..(547): n is a, c, t, g, unknown, or other
  misc_feature (558)..(558): n is a, c, t, g, unknown, or other
  misc_feature (581)..(581): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (692)..(692): n is a, c, t, g, unknown, or other
  misc_feature (693)..(693): n is a, c, t, g, unknown, or other
  misc_feature (702)..(702): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (714)..(714): n is a, c, t, g, unknown, or other
caaagctggagctccccgcggtggcggccgctctagaactagtggatcccccgggctgcaggaattcgcacgagaccattacctagaacatcctaatcgaaaaaatttccacttcagtcgaggccacctcctccccctttcggcacgcagccatgggcaaccgtgcgtcgcgccaccaccgccacgccaccgagcagcagccagagacgccgacccttcccaagccccagatccagccgccgcccccgccgacgcagacgcagcagtaccagcaggccccgccgccgccgaagccgaagccggcggcggacgcgagggcggtggggcgcgtgctggggcggcccatggaggacgtcaaggcgacctacaccttcggccgcgagctcgggcggggccagttcggggtcacctacctcgtcacgcaccgggagactgggcagcgcttcgcctgcaagtccatagccacgcggaagctcgtccaccgcgacgacatcgaggacgtgccgccgggaaggtgcagatcatgcaccacctcaccggccaccgnaacatcgtcgnagctcccgggagcttacgaggancaggcgctcggtcaacctcgctatggaggctctgcccaagggcgggggagctcctcgacccgcatcattgccagggggcactacaccgagcgcgctgccgcgcgcnnnttnncccggaaancannnnccccgncgtccaagtgcaccccccccgggggggc

SEQ ID NO: 30204 - protein, 196 aa, Zea mays
  misc_feature: Ceres CLONE 1405646-F
  misc_feature: SWISSPROT Homolog: EC 2.7.11.1 Non-specific serine/threonine protein kinase
  misc_feature (132)..(132): Xaa is any aa, unknown, or other
  misc_feature (136)..(136): Xaa is any aa, unknown, or other
  misc_feature (143)..(143): Xaa is any aa, unknown, or other
  misc_feature (179)..(179): Xaa is any aa, unknown, or other
  misc_feature (180)..(180): Xaa is any aa, unknown, or other
  misc_feature (181)..(181): Xaa is any aa, unknown, or other
  misc_feature (184)..(184): Xaa is any aa, unknown, or other
  misc_feature (185)..(185): Xaa is any aa, unknown, or other
  misc_feature (186)..(186): Xaa is any aa, unknown, or other
  misc_feature (188)..(188): Xaa is any aa, unknown, or other
MGNRASRHHRHATEQQPETPTLPKPQIQPPPPPTQTQQYQQAPPPPKPKPAADARAVGRVLGRPMEDVKATYTFGRELGRGQFGVTYLVTHRETGQRFACKSIATRKLVHRDDIEDVPPGRCRSCTTSPATXTSSXLPGAYEXQALGQPRYGGSAQGRGSSSTRIIARGHYTERAAARXXXRKXXXPXSKCTPPGG

SEQ ID NO: 30205 - DNA, 692 bp, Zea mays
  misc_feature: Ceres CLONE 1405649-F
  misc_feature (429)..(429): n is a, c, t, g, unknown, or other
  misc_feature (445)..(445): n is a, c, t, g, unknown, or other
  misc_feature (455)..(455): n is a, c, t, g, unknown, or other
  misc_feature (486)..(486): n is a, c, t, g, unknown, or other
  misc_feature (487)..(487): n is a, c, t, g, unknown, or other
  misc_feature (522)..(522): n is a, c, t, g, unknown, or other
tccccgcggtggcggccgctctagaactagtggatcccccgggctgcaggaattcgcacgagaccattacctagaacatcctaatcgaaaaacggcgggcgtttgagctgttcgccacctacccctccctccttcctttcatttttctggaagacttcttcggcctcacgcatctcctcctcctcctccaatccaattcacaaacacacacgggcaatcaattagcagaacccgcgccacccccccttcctcggagtcggagcgagtcgaggaacggctcgtctgcctctcccgttctccttcctctcctccccagaagatctgatccatcatcgaggactcgccgggaagaatcaaggatatatagataataaacaaacaaaggttcctccagagccagaaggagggaagtcaccggccgtcggcggnggaaggagatgtcggnacggcgcggnctcccggacggggcgtcgcttggcgcgtggnngcctctcggtcacccttcgtcgggtggccatcgtncatctgcaacaagtacctcatcagcactctagggctttcttctttgccgacgaacgctgacgagctgggaaccctcatgggtggacttcttcaaggcttgtacggttggcgcaagcggctggcgctttctcgagcccaagccggaacgaacgggcgggacgtcaatctcc

SEQ ID NO: 30206 - DNA, 661 bp, Zea mays
  misc_feature: Ceres CLONE 1405650-F
  misc_feature: Translation starting site: 264
  misc_feature: Pfam Name: Calmodulin_bind Pfam Description: Calmodulin binding protein-like
  misc_feature (422)..(422): n is a, c, t, g, unknown, or other
  misc_feature (469)..(469): n is a, c, t, g, unknown, or other
  misc_feature (625)..(625): n is a, c, t, g, unknown, or other
tccccgcggtggcggccgctctagaactagtggatcccccgggctgcaggaattcgcacgagaccattacctagaacatcctaatcgaaaaacagtaggttcattccccccaccacatcgaactgtgcgcgcgctgcgcggtcggtcgctcccctcctctgtccgcgatctcggctggccgcctgggcttggccctcgccaccgctcccgtctccggttccggcggccgagccaggtttgctcgggtcttcgtgccagcgacgatgaaggacaagcgtgggctcgaggacgccggcgacgggcgccctgatgccaagaggccgcggcctccggctctggccagtgttattgttgaagcgttaaaggtggatagtctgcagaggctctgctcatcattggaaccaattcttcgtagagtagcnagtgaaggaagtggagtgcgcactgggcaaacttggccctgcaacanttcggtggaaggccttccccaagccgaattgaaggtccaaatggaagaactctgcaactcgaattccgaacaaggctgtcacttcccctttttactggaggaaaagttgaaggggagcagggagctgcaattcattgttgttttgtttgatgctgncacttggctgtgttgtatcctctgggaccagagtcg

SEQ ID NO: 30207 - DNA, 744 bp, Zea mays
  misc_feature: Ceres CLONE 1405651-F
  misc_feature: Encodes the peptide sequence at SEQ ID NO. 30208
  misc_feature (591)..(591): n is a, c, t, g, unknown, or other
  misc_feature (633)..(633): n is a, c, t, g, unknown, or other
acaagctggagctccccgcggtggcggccgctctagaactagtggatcccccgggctgcaggaattcgcacgagaccattacctagaacatcctaatcaaaaaatctccatcggccatcgctgcctccccagtccccacatccgcacacatttttacccctcgcggcggccccaccgaccgccggggcgcagcggcgtcgccgcgggcaacgccgtcacgtcacgtgcatcacgacaatctcctcctccgcctcgtcttcctgccaggccgcgggagcaccagcccagcggcagatcagtcgaggcgggcgattccagggtttagagaggagcggagatggtgaaggtcatccaggggcgcccggccgagatggggttccggatgccggcggagtgggagccgcacgagcagtgctggatgggatggcctgagcgtccagataactggagggagaatgctggtccagctcaagaggtatttgctagaactgcaattgccatttcaaagtttgaacccgtcacgttatgtgcaagtggcaagcagtaccccaaagtccacgagctgatgtaacatgaaaccacatcatggtncgttgagatgagcatgaacgattcctgggtccgcgacatggnccccacttttgtcactcataaagggggattcagggaatgcagaacaacaatagcagggaatgatggcaattcatgggctggggagaatctatgacgactgagcggtggcgg

SEQ ID NO: 30208 - protein, 77 aa, Zea mays
  misc_feature: Ceres CLONE 1405651-F
  misc_feature: SWISSPROT Homolog: EC 3.5.3.12 Agmatine deiminase
MVKVIQGRPAEMGFRMPAEWEPHEQCWMGWPERPDNWRENAGPAQEVFARTAIAISKFEPVTLCASGKQYPKVHELM

SEQ ID NO: 30209 - DNA, 653 bp, Zea mays
  misc_feature: Ceres CLONE 1405652-F
  misc_feature (217)..(217): n is a, c, t, g, unknown, or other
cgcggtggcggccgctctagaactagtggatcccccgggctgcaggaattcgcacgagaccattacctagaacatcctaatcgaaaaattttttaactagtctaaatacttgacagaagaaattcccgttttcgcttgactattcttcttcgtccctgatttttatccccaaactcaccgccggggcacaacaatccaggtctcctttcgccggatntggtccctctcccccctctcccggcttttggggttactggaccacgggggaggggggattctccagggttaggccaattcctccctttgggccggtctcttccccatcggggaaagtcccccccagttgaccccaaaaaaaaatcgtggcccaaaggggggtttccccaaaaaattttttccaaaaaatttgggaaatgggggcaaaaccttatccccccggtaaaacttggggggggggttggcccccttataaacgaccggggggtccctgggcccggggggggggggccactttcccccccgggaaaaagggggtgtgtccccccgccggggggcgctttttataaaacggaccccgctgtgggtcccccgaaacccccccccccccccccccgggggtcacaccccccaggtctattccccttagaaaaaag

SEQ ID NO: 30210 - DNA, 677 bp, Zea mays
  misc_feature: Ceres CLONE 1405653-F
  misc_feature (341)..(341): n is a, c, t, g, unknown, or other
  misc_feature (348)..(348): n is a, c, t, g, unknown, or other
  misc_feature (352)..(352): n is a, c, t, g, unknown, or other
  misc_feature (381)..(381): n is a, c, t, g, unknown, or other
  misc_feature (387)..(387): n is a, c, t, g, unknown, or other
  misc_feature (512)..(512): n is a, c, t, g, unknown, or other
  misc_feature (546)..(546): n is a, c, t, g, unknown, or other
  misc_feature (553)..(553): n is a, c, t, g, unknown, or other
ccccgcggtggcggccgctctagaactagtggatcccccgggctgcaggaattcgcacgagaccattacctagaacatcctaatcgaaaaaggcacacttccaccacctcgctttgctgcttcactgcttgcttctgttgggcggagtgctaagaggacggcacgggagtcaagattcctcctccttaacctgccctttcgtgttgcgttgttggtgggtttggtttgtgattgcggtggcgctggagttgcggtgtgtggaaagcgagggatccgagattcttggtggattctgttctacttttcgattgctgctgatcctctctcccgtgcgacggacnaagcggncggnggtggggagagcatccgccgttgccgggncctggnaaaggcccccggcccgtcttatggaacttgcccgccccggtgccacgccccggcccgggaactgaagtgctcagcaaggcgcttcttgcctgccactctcacgctgctggtgctaactgtggcancccccctgtttggttcctgctcctcactgaccgnctacggngctgcgataatggggcctcaaatggggctgctcctttgctgctgccttctggcgttcccgccacatggtccgttagtcgttgaggctttttgaagcggttatggagtaaactatgggagaatag

SEQ ID NO: 30211 - DNA, 829 bp, Zea mays
  misc_feature: Ceres CLONE 1405654-F
  misc_feature: Translation starting site: 507
  misc_feature (158)..(158): n is a, c, t, g, unknown, or other
  misc_feature (405)..(405): n is a, c, t, g, unknown, or other
  misc_feature (432)..(432): n is a, c, t, g, unknown, or other
  misc_feature (541)..(541): n is a, c, t, g, unknown, or other
  misc_feature (549)..(549): n is a, c, t, g, unknown, or other
  misc_feature (554)..(554): n is a, c, t, g, unknown, or other
  misc_feature (559)..(559): n is a, c, t, g, unknown, or other
  misc_feature (560)..(560): n is a, c, t, g, unknown, or other
  misc_feature (562)..(562): n is a, c, t, g, unknown, or other
  misc_feature (568)..(568): n is a, c, t, g, unknown, or other
  misc_feature (629)..(629): n is a, c, t, g, unknown, or other
  misc_feature (632)..(632): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (679)..(679): n is a, c, t, g, unknown, or other
  misc_feature (680)..(680): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (708)..(708): n is a, c, t, g, unknown, or other
  misc_feature (716)..(716): n is a, c, t, g, unknown, or other
  misc_feature (717)..(717): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (723)..(723): n is a, c, t, g, unknown, or other
  misc_feature (724)..(724): n is a, c, t, g, unknown, or other
  misc_feature (726)..(726): n is a, c, t, g, unknown, or other
  misc_feature (727)..(727): n is a, c, t, g, unknown, or other
  misc_feature (752)..(752): n is a, c, t, g, unknown, or other
  misc_feature (761)..(761): n is a, c, t, g, unknown, or other
  misc_feature (763)..(763): n is a, c, t, g, unknown, or other
  misc_feature (764)..(764): n is a, c, t, g, unknown, or other
  misc_feature (770)..(770): n is a, c, t, g, unknown, or other
  misc_feature (771)..(771): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (782)..(782): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (801)..(801): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
aatagctggagctccccgcggtggcggccgctctagaactagtggatcccccgggctgcaggaattcgcacgagaccattacctagaacatcctaatcgaaaaactgcgatgtggtcctctcctcctatcacctgacctccacacacacacacagacngacaggcacgcgcaagcaaaaattcattcatatatgcacgctcgttcgttgtcgatctcccccatcactgcacggcgcggcgcaacaagagcgagggattggagctcagctagtcgtctaatcagctagtaggtacgtgtagctaggctgcgctgcaccagctgccgtgcatgcagtgcatggcgcaggaggggctcttgaggcctccgtcgccagctccccgccgccaatgccggccgccgtcggnctcccttcctggtggcgcgacatgcancacccggctgccttaaccggcgcggtggcctcgtccccccggcgggtcgaggtggccgcccccgggggtatccgatgggcgcccgggcagcgacgcagcagcagcagcnagcacggncggcngggtnngngacacnttttccctccgacgggttctctcgtgcctccaacgccccaccgtaagcgtccttcaccaancanttttcccggggtccgggctcgctgggaactcccgggggggannnnannannnnnnagaaccccccccccccttttncccccccnncnnncnnannaaaacccaccctccaaaaacccaancccctcaangnncccccnngnnnnaaaagnttaaaaaaaaacannnnancccnnnaaaaaaaccccaacaaaaaact

SEQ ID NO: 30212 - DNA, 656 bp, Zea mays
  misc_feature: Ceres CLONE 1405656-F
  misc_feature: Encodes the peptide sequence at SEQ ID NO. 30213
tggagctccccgcggtggcggccgctctagaactagtggatcccccgggctgcaggaattcgcacgagaccattacctagaacatcctaatcgaaaaaaacggcccacacagaccagctaaggagcgagccggcccctccttccttcctcccagttctctcgcgaggcgctcgcttacctcgcctcgaattgcgttctagcatctcagcgtcagcgacaaagcaggcaattaacgcgagatgctcatcgagagtttccgcgtcgtagagcccccacgtgcggtacggtacgacggagtatcgagtcgcagtaccgttacgacacgacgtcagctgagtgcacgagacctaggactgggcctcgcgcatgggtcgtccgcaacaagtacgccaagtacaagttcgggagcagacagcgcgatcactgacatcggagtcatgattagatgcacagggctggcaacatactttcctgtttggaattatgacaattccactaatccagaagaacgaatttggaggggaattgcccatgccataatcctcaggaggaagttgccgattctaattggtcgctttcaattgaggaaataaggatgggtcctggaacctgaaaagggaaaaaatcccttgccaaggggtgggttgggactttca

SEQ ID NO: 30213 - protein, 51 aa, Zea mays
  misc_feature: Ceres CLONE 1405656-F
MIRCTGLATYFPVWNYDNSTNPEERIWRGIAHAIILRRKLPILIGRFQLRK

SEQ ID NO: 30214 - DNA, 677 bp, Zea mays
  misc_feature: Ceres CLONE 1405657-F
  misc_feature (256)..(256): n is a, c, t, g, unknown, or other
  misc_feature (449)..(449): n is a, c, t, g, unknown, or other
  misc_feature (486)..(486): n is a, c, t, g, unknown, or other
tccccgcggtggcggccgctctagaactagtggatcccccgggctgcaggaattcgcacgagaccattacctagaacatcctaatcgaaaagggccgggagtgggcgacgaacgatggctggctggccgtccgtgattgttttggaacgggcagcgtgtttggttggtgcctgggctgtgccgccgttcgtctctgggtagcgtagcgacggcgccacggcggcttccggctcgtgcgcgcgcgcgcgtgtccggncgagaagagctgccaagggatggaggcgctgaggaagcaggcgagcaagttcaaggagcaggtcgccaagcagcagcaggctgttataaagcaattcagtactactgggctatgagcggtcagattccattgtaaattgatgaggttgaactacagagacatcaacagcttgagaaattgtatacttctactncgttctgtaagggatttccagaaggacatagttaagncagctggaaggtttggtgtctattggaaacaacatattgaagtgggaacaaaattttctgaggactgctatagatatggaagcgaaataatgcaagcgacgaaccccttaaaaaagacatcactatacggaggtgctttgagaaatattgagaaagaatatgaagattttcacagaattttatcttctcaa

SEQ ID NO: 30215 - DNA, 768 bp, Zea mays
  misc_feature: Ceres CLONE 1405659-F
  misc_feature (338)..(338): n is a, c, t, g, unknown, or other
  misc_feature (387)..(387): n is a, c, t, g, unknown, or other
  misc_feature (552)..(552): n is a, c, t, g, unknown, or other
  misc_feature (596)..(596): n is a, c, t, g, unknown, or other
  misc_feature (600)..(600): n is a, c, t, g, unknown, or other
  misc_feature (613)..(613): n is a, c, t, g, unknown, or other
  misc_feature (619)..(619): n is a, c, t, g, unknown, or other
  misc_feature (620)..(620): n is a, c, t, g, unknown, or other
  misc_feature (622)..(622): n is a, c, t, g, unknown, or other
  misc_feature (628)..(628): n is a, c, t, g, unknown, or other
  misc_feature (639)..(639): n is a, c, t, g, unknown, or other
  misc_feature (656)..(656): n is a, c, t, g, unknown, or other
  misc_feature (657)..(657): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (724)..(724): n is a, c, t, g, unknown, or other
  misc_feature (753)..(753): n is a, c, t, g, unknown, or other
  misc_feature (754)..(754): n is a, c, t, g, unknown, or other
aaagctggagctccccgcggtggcggccgctctagaactagtggatcccccgggctgcaggaattcgcacgagaccattacctagaacatcctaaccaaaaaaacgagaaggaagccaccgctccccaatcgcctgcttgccttcccatcctcctcgtagatctccggcaccgggcaccatgagctcctactccggcgaccgctcctcctcctcctccttgcgccccaccaacacctccttcgactcctacaagttcgacttcggcatcaactcctcccgctcctccggctctcgccccctccgcgaccagcggccgggcgcggctaccaaccctccnacgaggcccgccaccggcgccacgtggatgcaccagcccgccagcgccnagccgtcgtggacccaccagccttcccccgccgcgggcgtcggcgcccacccatggcggggcccctggatccgggccaaccctccatggtcggcgacatcttggggccggagctggtcctccgcgcgccctccctttcgggggtcggccatccctcaggccaacnaccccggccttcctcagcgatctccctcgggtccgcgctcgggntctncccgctcccagtncacggnngncgcttnagatcccgcgnccgcggcacaggatccnngggccagggccggtggaaaagcccaatgtcaacgctagcagtctccccttcctcgatgnnnngggcnatgggcgggcgcgctcccgaaactagggnnagacggatttgggc

SEQ ID NO: 30216 - DNA, 741 bp, Zea mays
  misc_feature: Ceres CLONE 1405660-F
  misc_feature: Encodes the peptide sequence at SEQ ID NO. 30217
  misc_feature (1)..(1): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (33)..(33): n is a, c, t, g, unknown, or other
ncccccccccccccccccannnaaaagaaaaanaaaaaaaaaaaaacaacaaaactggagctccccgcggtggcggccgctctagaactagtggatcccccgggctgcaggaattcgcacgagaccattacctagaacatcctaatcaaaaaaacaaccgatcgcccacgcaaacctctcctcaactcgatcaaaccggggcacggaaaaggcccaccaaaatcccccaaaatttcggacctcctcagccccagcaatctcgaatcccgatgctcacagcctccaccgaatccctggcggtcgtcatcagcgcatgagctttcttcgctcgctagcggactccttctcatcgctgctcttctcgtcgggaggcggggcggtgtccatggacgcggcgggggcggccccgtcgccggcggcggtggtgggggagcgcgcgacgctgaatctcagggggtacttcgacctcgccaaagaggagatcgacaaggccgcgtgggctgaaggagggggggctcaccgacgaggccaccgcgaactaccgaaacgcgatgtggtccgtgctcaaagccaaggccgcgcgcgacgccaaagccggatccgccagagggagggggcaggcccgccgcggcaccctacaacaaccgccaacggacccccgcaacgccccgggccaccgcccagacgccggccccaaaaaacgggcggaccatcagggcggtcgcaacgagtagtgtaacc

SEQ ID NO: 30217 - protein, 141 aa, Zea mays
  misc_feature: Ceres CLONE 1405660-F
MSFLRSLADSFSSLLFSSGGGAVSMDAAGAAPSPAAVVGERATLNLRGYFDLAKEEIDKAAWAEGGGAHRRGHRELPKRDVVRAQSQGRARRQSRIRQREGAGPPRHPTTTANGPPQRPGPPPRRRPQKTGGPSGRSQRVV

SEQ ID NO: 30218 - DNA, 701 bp, Zea mays
  misc_feature: Ceres CLONE 1405662-F
  misc_feature: Translation starting site: 191
  misc_feature: SWISSPROT Homolog: EC 1.3.5.1 Succinate dehydrogenase (ubiquinone)
  misc_feature (305)..(305): n is a, c, t, g, unknown, or other
  misc_feature (322)..(322): n is a, c, t, g, unknown, or other
  misc_feature (327)..(327): n is a, c, t, g, unknown, or other
tccccgcggtggcggccgctctagaactagtggatcccccgggctgcaggaattcgcacgagaccattacctagaacatcctaatcgaaaagttttttcgtctccaccgccgctctcctttccagtctccaccaccgctcgtctccccgtaccgcccgcaacccccctcccctgcgagatccggggcgcgatgtggcgcagctgcgtctcgcggggcctctccagggccaaggcctccgcctccaggctcctctccacggcgtcgtcgtcctacacggtggtcgaccaccctactacgcagtggnatggtgggggacgccgncgcgncgctccagggcggcgatcggcctctccgagcacggctgcaacaccgcgtgcatcaccaagctcttcaccacgcgctcgtacaccgtcgcgtgttcaggcgagggataaatgctgcacttggaaacatgagtgaagaaggactggaggtggcatatgtatgacactggtaagggaagcgattgggctggttgaccaggattctattcaggatatgtgcagagaggcacccaaaagttgtaataaagtttggaaaactaggactaccattttcaagaactggagaggggaaagatatcccaccggggccttggggggggaaaagttatattttggggaaggggggaaaagcctaccggtgggcctccgccctttaa

SEQ ID NO: 30219 - DNA, 752 bp, Zea mays
  misc_feature: Ceres CLONE 1405664-F
  misc_feature: Encodes the peptide sequence at SEQ ID NO. 30220
  misc_feature (323)..(323): n is a, c, t, g, unknown, or other
  misc_feature (597)..(597): n is a, c, t, g, unknown, or other
  misc_feature (599)..(599): n is a, c, t, g, unknown, or other
  misc_feature (609)..(609): n is a, c, t, g, unknown, or other
tggagctccccgcggtggcggccgctctagaactagtggatcccccgggctgcaggaattcgcacgagaccattacctagaacatcctaatcaaaagtgtctagtgtcttccgtctcgatcccgcgggtgggactcgccggcgacaaaaacgaaaagcgacttgccctccgcggcctccggccttcccactccactcgccctcctctcctagcgtcggtgagccggtgcgctgcagtccccgctccccttccgcgtcgccgcgatggaggtcttccgggagcacggggacgacggagtgccctaggattccatcacgccgccnagcatcagtcccgcagccagggatttcttctccgaccccgaccttcatgtgagtcgcggccttcctcctcgaagcggatccggcggattggaggggccaaccatagcaggtacttcttgcgggtgtaagcatttcgctgcacttggagacgcttatttggagtatttgaagtatgagttggctctctgtcctgtcagttatgtgcctgtgcttcataaaaaagagctacattttcttctactaggggctttggagactgcccagatgaagagtnanatttcttggntctctgtgccattggctgcgtcatggttcaaatgggagattgcaatgtcgtgctattggggaataatctgaacctggcctttgctgataatgaggcaagcttttctcccggaggggaaaggatcgggagccatggcataattt

SEQ ID NO: 30220 - protein, 40 aa, Zea mays
  misc_feature: Ceres CLONE 1405664-F
MVQMGDCNVVLLGNNLNLAFADNEASFSPGGERIGSHGII

SEQ ID NO: 30221 - DNA, 730 bp, Zea mays
  misc_feature: Ceres CLONE 1405665-F
  misc_feature: Translation starting site: 233
  misc_feature (473)..(473): n is a, c, t, g, unknown, or other
  misc_feature (474)..(474): n is a, c, t, g, unknown, or other
  misc_feature (479)..(479): n is a, c, t, g, unknown, or other
  misc_feature (487)..(487): n is a, c, t, g, unknown, or other
  misc_feature (496)..(496): n is a, c, t, g, unknown, or other
  misc_feature (497)..(497): n is a, c, t, g, unknown, or other
  misc_feature (508)..(508): n is a, c, t, g, unknown, or other
aaagctggagctccccgcggtggcggccgctctagaactagtggatcccccgggctgcaggaattcgcacgagaccattacctagaacatcctaatcgaaaaattccaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggcgcgctgcagctcccgcctgggttccgcttccaccccaccgatgacgagctggtgatgtactatctcctccgcaagtgcggcggcctgccgctcgccgcgccggtcatcgccgaggtggatctctacaaaagtcgaccatggcagctcccagagaaaggcgttcggtgggaagaaagagtggtacttctttctcgcgcgcgaccgcaaagtaccgaatggctccagnnctaancgggcggncgggaaggnnaactgggaggncacccggcgcgacaaacccggaagggcccccgccccccccgggcattaagaaggcgctcggcttctacgcgggaaagccggccagggcggcaagaccaatgggatctgcacgataccgcctccgggaaataaaacgttcggccgcgaaaaaaaaaaaacaaaaacggtctaagttggaagactggggtttttgcggaaaaaaaaaaagagggggtttttcgg

SEQ ID NO: 30222 - DNA, 696 bp, Zea mays
  misc_feature: Ceres CLONE 1405666-F
  misc_feature: Encodes the peptide sequence at SEQ ID NO. 30223
  misc_feature (260)..(260): n is a, c, t, g, unknown, or other
  misc_feature (348)..(348): n is a, c, t, g, unknown, or other
  misc_feature (429)..(429): n is a, c, t, g, unknown, or other
  misc_feature (474)..(474): n is a, c, t, g, unknown, or other
  misc_feature (494)..(494): n is a, c, t, g, unknown, or other
  misc_feature (593)..(593): n is a, c, t, g, unknown, or other
ggagctccccgcggtggcggccgctctagaactagtggatcccccgggctgcaggaattcgcacgagaccattacctagaacatcctaatcgaaaaaaatcgaatcctcatcgctccgtctatggcgactctaaccatgcagccgatcggtcccacccctgctccggctgcgcagcaagacccaagcaagggagagaatcctcctaccgtggatggtaccgatctgggtgacatcgacttgggctgggttatcctcaagnaactcggatgtcgtttccgcggatttggaggccgccgccgttctgtggcggtcagcgtctaggctcttctacgattcctagctgggcnacgggggtttctcgggagggtgtggtttacacgcctcgtgccgttctacaacagagttaggcatctcgaagacgagaccgntgggattcgtggagatggctgggggaaggttgtggagcatttagnctgaagtaacagagaagctnagctgcgaatgtggctaagcaacttccctgaagatgggtctctgcagaaagcagtggaagaggttgaacacattgctgaggtagtggatgatgatgcgnagaaggttgaagcagtcactgaagagacgacaaggtcagtgatgaaattgatgctgctgtggagccggtcatcgcggagcttgaaaaggaacgcggtcagagc

SEQ ID NO: 30223 - protein, 64 aa, Zea mays
  misc_feature: Ceres CLONE 1405666-F
  misc_feature (31)..(31): Xaa is any aa, unknown, or other
MWLSNFPEDGSLQKAVEEVEHIAEVVDDDAXKVEAVTEETTRSVMKLMLLWSRSSRSLKRNAVR

SEQ ID NO: 30224 - DNA, 668 bp, Zea mays
  misc_feature: Ceres CLONE 1405667-F
  misc_feature: Encodes the peptide sequence at SEQ ID NO. 30225
  misc_feature (568)..(568): n is a, c, t, g, unknown, or other
tccccgcggtggcggccgctctagaactagtggatcccccgggctgcaggaattcgcacgagaccattacctagaacatcctaatcgaaaaataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacacctccccgggctcgcccgcgcagcgcttcgtgtcggaggacggcgtcatcaactcgcgcccgcgggtgctgggcggcggcagctgcatcaacgccggcttctacacgcggtccagcgacgactacgtgcggngccgcgggtgggacctgtgcgccgcccggaacgagtaccggtgcgtgcacgacctatagaccttccgcccgcagccgcagccctgtacccccccacactc

SEQ ID NO: 30225 - protein, 140 aa, Zea mays
  misc_feature: Ceres CLONE 1405667-F
  misc_feature: SWISSPROT Homolog: EC 4.1.2.10 Mandelonitrile lyase
  misc_feature (122)..(122): Xaa is any aa, unknown, or other
MQLATSTWRELHVREGRGAGAQRVVLHYIIVGGGTAGCPLAATLSERFRVLLLERGASPYDDDRIGDMARFADTLSDTSPGSPAQRFVSEDGVINSRPRVLGGGSCINAGFYTRSSDDYVRXRGWDLCAARNEYRCVHDL

SEQ ID NO: 30226 - DNA, 712 bp, Zea mays
  misc_feature: Ceres CLONE 1405668-F
  misc_feature (277)..(277): n is a, c, t, g, unknown, or other
  misc_feature (345)..(345): n is a, c, t, g, unknown, or other
  misc_feature (373)..(373): n is a, c, t, g, unknown, or other
  misc_feature (374)..(374): n is a, c, t, g, unknown, or other
  misc_feature (404)..(404): n is a, c, t, g, unknown, or other
  misc_feature (405)..(405): n is a, c, t, g, unknown, or other
  misc_feature (497)..(497): n is a, c, t, g, unknown, or other
  misc_feature (501)..(501): n is a, c, t, g, unknown, or other
  misc_feature (504)..(504): n is a, c, t, g, unknown, or other
  misc_feature (547)..(547): n is a, c, t, g, unknown, or other
  misc_feature (548)..(548): n is a, c, t, g, unknown, or other
tggagctccccgcggtggcggccgctctagaactagtggatcccccgggctgcaggaattcgcacgagaccattacctagaacatcctaatcgaaaaacgccacccagttgcttctctgtgtactctccaactcatcaccggctccatccttgtcctacactgacctcgtccccatcccgcaaccgcaagcaaccaccgatccagcccgttcggcctttcggcgaatggtgacgaaccaggacgcggaggcggcatcggcggcagccccggggccanggggcgacggtggacccgatgccctagacgcccccgggggggcggtccccagacggagtggaaaccgncgcgagtgccggaagctggaggctgaannccggagcccgtccgagctcaacacccgtcnnaacaggttcgggactcctttctccgtcgtctctacggggaaaaaggttgttccggtgaaataaacctcggcagccatcaccacgggccaccnaaanggntcgggtggtcggtgcaaggcccgaccggccccgtctcccacgnnggcccggggccgtggtactaacttccgagaatggccgtccaggaacgccgagaatacaaggggcagacaatcccataggggttcacgaagcgagaggcttcaagatgaggcgaacaaccgggtttggaagtcaaacagttgtggataccattggtgacgacggc

SEQ ID NO: 30227 - DNA, 655 bp, Zea mays
  misc_feature: Ceres CLONE 1405669-F
  misc_feature (218)..(218): n is a, c, t, g, unknown, or other
  misc_feature (219)..(219): n is a, c, t, g, unknown, or other
  misc_feature (283)..(283): n is a, c, t, g, unknown, or other
  misc_feature (286)..(286): n is a, c, t, g, unknown, or other
  misc_feature (293)..(293): n is a, c, t, g, unknown, or other
  misc_feature (297)..(297): n is a, c, t, g, unknown, or other
  misc_feature (298)..(298): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (626)..(626): n is a, c, t, g, unknown, or other
tggagctccccgcggtggcggccgctctagaactagtggatcccccgggctgcaggaattcgcacgagaccattacctagaacatcctaatcgaaaacgttccaggtcgtggtctttgccaaattcccacgcccctgcccaccctgcccgaatcctctcgccctttacccccgcccgcgaccccattcacactctcgctgctccactccgctccgctnncagctcgtcgggacgcgccccccgcctcccatcccatgcccgccccgcgggttcgtcggagggncgntcgcggngggnnctcccatccgcgagctgacgagagggctctcggggggggcggcttgggggggtcatttttgtccgttcggccaaagggagggggggtggtggggataacaaaagggatggaaaggcggggttccaaaaaaaggatgcaagggtaagggagaaggggaaaaaaattttaaaacggggggaccgaaaaacccgnnnctgtggggggggaggttttagccccctccccgggccccgagggggagtgcgggggggggcgcagggggggggcgccccgggaggggggagggggggcggggggggcgccgcaccgccgagcggggggggggggnggggggagggggagcgcgccgcgccgccc

SEQ ID NO: 30228 - DNA, 735 bp, Zea mays
  misc_feature: Ceres CLONE 1405670-F
  misc_feature: Encodes the peptide sequence at SEQ ID NO. 30229
  misc_feature (680)..(680): n is a, c, t, g, unknown, or other
caaagctggagctccccgcggtggcggccgctctagaactagtggatcccccgggctgcaggaattcgcacgagaccattacctagaacatcctaatcgaaaaaaaacgccccacagcgcaagcgagcagatcctcctccctttctgcttcctggcatcctctctgcctccccgcgccgatctcgagcacctggggagaccgcgagacgtgcgcctgatttttctcatcgcagcagccctcaagttccccacctcttttttcttgcagctttcaattaatctggttatttagctacatctttattttactttcattttacctttaatctgtttagttccattgcatcttctgcggttgcggttagtattgctgtttcttgctccttgtttcttgttcttttgcttctaaccatggacgcaggaacctactccatctcatcagagaagagccacacggcggcagcggcgcggccccctcttcaggaggccggcactcggccctacatgccgtcgctgagcacaggatcgcgcaacccgtcggccaagtgctacggcgataggttcatcccggacgggtcggcgatggatatggacatggcgcactacctgctcacggagcccaggaggacagggagaacgcgggtggcagcgtcccattccaggaggcgtaccggagctgntctcgccgagaagttgctcacaccggacacgcatccttggctcagaacaagccgc

SEQ ID NO: 30229 - protein, 108 aa, Zea mays
  misc_feature: Ceres CLONE 1405670-F
  misc_feature (90)..(90): Xaa is any aa, unknown, or other
MDAGTYSISSEKSHTAAAARPPLQEAGTRPYMPSLSTGSRNPSAKCYGDRFIPDGSAMDMDMAHYLLTEPRRTGRTRVAASHSRRRTGAXLAEKLLTPDTHPWLRTSR

SEQ ID NO: 30230 - DNA, 672 bp, Zea mays
  misc_feature: Ceres CLONE 1405671-F
cgcggtggcggccgctctagaactagtggatcccccgggctgcaggaattcgcacgagaccattacctagaacatcctaatcgaaaatctctatgacaggagtcgcttccccacgctgaagctaagggacccttgggcaggccggcatcttctccgatctgcaccctgctgcgccctctcgatttcttcttcgcatctcccgagccatcgcaacccaaaccctagtccagggagatctcggtctccgccgacgctgccgacgtgagcacagcatcatagccgctgagatggagttccgccgcatctatccagcgcggtgcggctggcgttcttggtgggcgccaggggctggggaacgtcacgtgaaacccccggaaactggaacacatcctgggggggggtttcaaaaataaccaagggcccctggggcagggggggtttcacgatctccggggcagggaacttcaatcccccgggggaaagggggtgcgtccaggaaaacggggggttccgggaatccacaaagagaccttgggaggggggagggggtggcggcaaccgaataaatgaccccgcgggggaatctccccgacaccatgagaccccgccaccaacccacccaccagcccgccggtgaccctcaatccgaaaaccatggtgcgccctagcacg

SEQ ID NO: 30231 - DNA, 736 bp, Zea mays
  misc_feature: Ceres CLONE 1405673-F
  misc_feature: Encodes the peptide sequence at SEQ ID NO. 30232
  misc_feature (334)..(334): n is a, c, t, g, unknown, or other
  misc_feature (494)..(494): n is a, c, t, g, unknown, or other
  misc_feature (663)..(663): n is a, c, t, g, unknown, or other
ccaagctggagctccccgcggtggcggccgctctagaactagtggatcccccgggctgcaggaattcgcacgagaccattacctagaacatcctaatccaaaagaaggggaggaatcccttcctccgcgagtcgcgagccgtggagatccgtcccactccacccctccgctccgccccagacctcgctacaaacctgccgcgaaaatagcagccgcccgtttgctctctcccgtctccgcactcctcccgcgatgagcgacccgcggggccgcgccgccggtcccgaccgctacggggacgaaccgcacgacctcccgctcgccgaggacgcanacggcgaggaagcgtggcagacgcccgagaaagaggcggttgccgtgtcggaaggggccgctgcgcggagtggggatacgaccccggacgctgaacaggagagcgatgacggagaggaaggagtgggctccccggatcaggcggaacccatggaagcggntgagggcgtaccgcccgtggccgcgactgtggagccgggatgggattgttagcggcgcaaaggtggagacgaacagcgaggacgcatcacttttggtcccccccacgaaggaggaggaaggacgacgacgatgactccaccccaggatgcgtctccgatagcccgagtngaaatgtggagggcgaaaaagtggcgccgtcaccccgcttggagggtgaaccggacccctttcttcgatggag

SEQ ID NO: 30232 - protein, 97 aa, Zea mays
  misc_feature: Ceres CLONE 1405673-F
  misc_feature (28)..(28): Xaa is any aa, unknown, or other
  misc_feature (81)..(81): Xaa is any aa, unknown, or other
MSDPRGRAAGPDRYGDEPHDLPLAEDAXGEEAWQTPEKEAVAVSEGAAARSGDTTPDAEQESDDGEEGVGSPDQAEPMEAXEGVPPVAATVEPGWDC

SEQ ID NO: 30233 - DNA, 668 bp, Zea mays
  misc_feature: Ceres CLONE 1405674-F
  misc_feature (385)..(385): n is a, c, t, g, unknown, or other
tccccgcggtggcggccgctctagaactagtggatcccccgggctgcaggaattcgcacgagaccattacctagaacatcctaatcgaaaaagaactgactccctcgatcccagcggcagcggcggaagcgaacggtgaccgcgacctcccctgaccctgaggctgcatatactcggatcgggtttcacatctccggttttggattggttggttgcccgcggtgatgggaggagagctgtggtggtatccataggggatcctcgtttgcgtccttgtgcgatggcttcgacctccgttcctgagttaaccgcggacaagaaatgcgacaaagccatcgcggatacggcggcaccacttacttctcagggacactccgaagaacgnaactgggaaagtcagcacactagtgcctgccttttgccggttgtaattggcagcaggcgatggggctgcatcccagtggggtgatagaaaacagaaatggcatggacaatttctgctgatggttctttgaagcggatggacagtgaaggtgctgagaagagctcgctgcgggggagcgtcaggaatagctcggtgtcggctaaatgcagtgacagggcgagcagcctgtcgaaagccagtgggagcccaaagatcagcggtcaacctgctgacatgatcgaga

SEQ ID NO: 30234 - DNA, 753 bp, Zea mays
  misc_feature: Ceres CLONE 1405675-F
  misc_feature: Encodes the peptide sequence at SEQ ID NO. 30235
  misc_feature (446)..(446): n is a, c, t, g, unknown, or other
  misc_feature (489)..(489): n is a, c, t, g, unknown, or other
  misc_feature (494)..(494): n is a, c, t, g, unknown, or other
aaagctggagctccccgcggtggcggccgctctagaactagtggatcccccgggctgcaggaattcgcacgagaccattacctagaacatcctaatcgaaaaacaacggtgtcctgcacttgcacccttatgccgtcgccgcggcggcagcggcattgatctcggcgtacatggtgtggttctgggcgctgacgcgacggctgtccgggccgcggatgtggcccctcgtcggcagcctgcccagcgtcgtcctgaaccgggcgcgggttcacgactggatcgtcgacaacctgcgctccaagggggaagcgggcacgtaccagacgtgcatcttgccccgctgcgtctttgcgcgcgccagggggctggtgaccgtcacgtgcaacccgcgaacctggagcacatctgcgcgcgcgtttcgacactaccccagggccccatgtggnaggcggcggttcacgatctccagggccaggatcttcaattccnacggnaaaacgtggttgctccagcgaaaaaggggggccttaatttccccacaggaccttgcccccaggggatggcccctttgccacccctaataaaaggccccgggtgggggaattcccctcaaaaaacttggggcccccggaaaaactcaccccccgaaatggttttgggccccccttttaaaaaattgggggccccccctttgagaccccaaaaaattttttcgggggtttaaaaaaaaaccttttaaagtttttttccccc

SEQ ID NO: 30235 - protein, 136 aa, Zea mays
  misc_feature: Ceres CLONE 1405675-F
  misc_feature (107)..(107): Xaa is any aa, unknown, or other
MVWFWALTRRLSGPRMWPLVGSLPSVVLNRARVHDWIVDNLRSKGEAGTYQTCILPRCVFARARGLVTVTCNPRTWSTSARAFRHYPRAPCGRRRFTISRARIFNSXGKTWLLQRKRGALISPQDLAPRGWPLCHP

SEQ ID NO: 30236 - DNA, 624 bp, Zea mays
  misc_feature: Ceres CLONE 1405676-F
  misc_feature (173)..(173): n is a, c, t, g, unknown, or other
  misc_feature (174)..(174): n is a, c, t, g, unknown, or other
  misc_feature (178)..(178): n is a, c, t, g, unknown, or other
  misc_feature (179)..(179): n is a, c, t, g, unknown, or other
  misc_feature (205)..(205): n is a, c, t, g, unknown, or other
  misc_feature (207)..(207): n is a, c, t, g, unknown, or other
  misc_feature (215)..(215): n is a, c, t, g, unknown, or other
  misc_feature (216)..(216): n is a, c, t, g, unknown, or other
  misc_feature (218)..(218): n is a, c, t, g, unknown, or other
  misc_feature (233)..(233): n is a, c, t, g, unknown, or other
  misc_feature (242)..(242): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (252)..(252): n is a, c, t, g, unknown, or other
  misc_feature (255)..(255): n is a, c, t, g, unknown, or other
  misc_feature (256)..(256): n is a, c, t, g, unknown, or other
  misc_feature (259)..(259): n is a, c, t, g, unknown, or other
  misc_feature (303)..(303): n is a, c, t, g, unknown, or other
  misc_feature (342)..(342): n is a, c, t, g, unknown, or other
  misc_feature (343)..(343): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (443)..(443): n is a, c, t, g, unknown, or other
  misc_feature (563)..(563): n is a, c, t, g, unknown, or other
  misc_feature (617)..(617): n is a, c, t, g, unknown, or other
tggagctcaccgcggcggcggccgctctacaacaaatggatcccccgggctgcaggaattcgcacgagaccattacctagaacatcctaatcgaaaaattgttgattgattgatcctccccgcctcactcctttgtctcctcgcctcgtggtcgctcgctcccctcgccatgnngagnnaggcagcagaaaccctagcggctcangncgagcggnngntagatgctccaaggntcgagaggnaaggnnnagntanntgntgcgcatcgactatggctgcgttctcgggcggggggttggggcntcctctgcagggcgaaaaagaatgggcccaggggggggnntttccccccttttgttccacagggagcttccggccgaaccccatttttaggggaagggttgnnnccttttaacccaaaaaaaccactttcgaaaaagaanaatggtgtgttttcccccttcaaaaaagggttggaaatttaaggaaagggggggccccccacttggaaaaggttgggggaaaatttaaaccccccggaaaaaaactctccccaaaaaaancccccccctaacgggtttacaacaggggtggaaaaaaaaaaattgggggggggnaaaaaaa

SEQ ID NO: 30237 - DNA, 701 bp, Zea mays
  misc_feature: Ceres CLONE 1405677-F
  misc_feature (306)..(306): n is a, c, t, g, unknown, or other
  misc_feature (309)..(309): n is a, c, t, g, unknown, or other
  misc_feature (311)..(311): n is a, c, t, g, unknown, or other
  misc_feature (312)..(312): n is a, c, t, g, unknown, or other
  misc_feature (322)..(322): n is a, c, t, g, unknown, or other
  misc_feature (373)..(373): n is a, c, t, g, unknown, or other
aaagctggagctccccgcggtggcggccgctctagaactagtggatcccccgggctgcaggaattcgcacgagaccattacctagaacatcctaatcgaaaagcattgcattgcataaacctctcgtgggaagtgcaaacaccaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgggctttgcacgncgncnnacgcgcgggnacgtccccttctacccgtcggggaatccgccgcccgcgggactggcgaagnacgctgaaccccgagtcctgctgtcaaaactccggaaatcccggaactaaccaaaagccggtcccggaggtatttggccgggccgggaccgcacccagaaatgggggggcccaagtcaaaaaatggttgaataactggagggaaggccctggtggggggggaacccctgggaataaaaaagggggggagttgggtcccccccaaaggaaaaaattccggcgcaacccccaaaatggggtccccccccgggagagggggggggggccaagggtgttttttaaaggggcccccggcccccaaaaaaaaacaccttgttaacggtgttttt

SEQ ID NO: 30238 - DNA, 652 bp, Zea mays
  misc_feature: Ceres CLONE 1405678-F
  misc_feature (280)..(280): n is a, c, t, g, unknown, or other
  misc_feature (457)..(457): n is a, c, t, g, unknown, or other
  misc_feature (473)..(473): n is a, c, t, g, unknown, or other
  misc_feature (569)..(569): n is a, c, t, g, unknown, or other
  misc_feature (604)..(604): n is a, c, t, g, unknown, or other
  misc_feature (648)..(648): n is a, c, t, g, unknown, or other
  misc_feature (649)..(649): n is a, c, t, g, unknown, or other
cgcggtggcggccgctctagaactagtggatcccccgggctgcaggaattcgcacgagaccattacctagaacatcctaatcgaaaactgctagtgctcagtcctcgccctctcgctttccgagggagcctttgcctttcccctccgcccgccagccattaatggcggcggcatctccatccactcccccctcgcccccctcccactgctgctacttctagaagcgctggtggcagggcaggcgttatcccggccgctggcgctggcgcgagagttggtnggctgctggtgttcagcccccctccctcttcaggttgtagggcggagcgatccgtgcagggcaacgtcgtcgtgcggtgacccagaaaggagaaacgcgccgccttttttcctcttctgccgggccccgcttttaccaatccctcctcatcctcatccgccgccgcccgcaccatcnaccaaaaaggtccccngccttcttcttcctcttctccctgcccctgggttggtcgttttgctcgtgctcccccaccccctttctgattcaagccagggttccttcccgcggncgcggcgcgtcgccatgggcaaactgctggggcgnccaagatcagctccgacagcccctcccgcgggccccctccccgnnagg

SEQ ID NO: 30239 - DNA, 708 bp, Zea mays
  misc_feature: Ceres CLONE 1405682-R
  misc_feature (55)..(55): n is a, c, t, g, unknown, or other
  misc_feature (56)..(56): n is a, c, t, g, unknown, or other
agctgccgtgacgcccgtggtgctcctcgtattgcatttaaattcgggggtgggnntccgattgggtaccgggccccccctcgaggtcgacggtatcgatattttttttttttttttttgttaaaaaagcgaagtttctagcccgcatagaatgtcgaatttggaatgccagtaccaagttcactcgtccacgatacacagccaaagcaatccacagacagacaggttctaccctcagttgaaagatgtggctaaaccatctcattctaataattcctatacagcatcagaaaacgaccatgtgcctcactcctcacttcctcgggaaaataaaaacggattggaaacaacttcatgccctgtgcaccccttgttaaccatcctcatcagaaatcgtagtctttaagggctatcttgaagtcggccaattgcatctccaccatacactcctcttggatgagaggcgggagcccattcttgtggcgtgtgaacttgtgtttgtgccacccactcttgaagtgctctcggtaaagcttggcctccacgagtacatcacactccgtgcaccttctctgtaggttgccttgtgcatcgccctggctttcagtagaaatgctccgtttctgcgtggggctccttatccgagcgacagtatcgagctccttttcaggaaccgcgtgtggcacttccacactgatgtgttgttct

SEQ ID NO: 30240 - DNA, 667 bp, Zea mays
  misc_feature: Ceres CLONE 1405683-F
  misc_feature: Encodes the peptide sequence at SEQ ID NO. 30241
  misc_feature (498)..(498): n is a, c, t, g, unknown, or other
  misc_feature (513)..(513): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (561)..(561): n is a, c, t, g, unknown, or other
  misc_feature (610)..(610): n is a, c, t, g, unknown, or other
tccccgcggtggcggccgctctagaactagtggatcccccgggctgcaggaattcgcacgagaccattacctagaacatcctaatcgaaaaactcgatcagtcgcgtgtctaggtttcctctctcaccatagcgcccgctctgtcgcccttcgttcacctctccttcctctcctccctgcctgccagggagaggggaagtcagaggcacggagtggcgcagagcagacgcacgtgaaccattgtagctgtccctgtcgtcgtcgtcgtcgtcaacgaatccacacaaggaaaggatggagaagaagccgaccatcctcatgaacaggtacgagctcgggcgcacgctcgggcagggcaccttcgccaaggtgtaccacgggcggaccctcgcgtccggcgagagcgtggccatcaaggcatcgacaagggagaaggtgatgcgcgtcggcatgatcgaccaatcaagcgcgagatctccgtcatgcgcctcgccgcanccccaacgtcggagnttgaacnnnaggtgatggccagcaagagcagaatcttccccctggagnaacacccccgggggggggggagctcttcgccgcgtcggccggcgcgggntttaagggggaaccccccggaaaaaggtactccccagcttttgggggggccccgtaa

SEQ ID NO: 30241 - protein, 77 aa, Zea mays
  misc_feature: Ceres CLONE 1405683-F
  misc_feature: SWISSPROT Homolog: EC 2.7.11.1 Non-specific serine/threonine protein kinase
  misc_feature (68)..(68): Xaa is any aa, unknown, or other
  misc_feature (73)..(73): Xaa is any aa, unknown, or other
  misc_feature (76)..(76): Xaa is any aa, unknown, or other
MEKKPTILMNRYELGRTLGQGTFAKVYHGRTLASGESVAIKASTREKVMRVGMIDQSSARSPSCASPXPQRRXLNXR

SEQ ID NO: 30242 - DNA, 655 bp, Zea mays
  misc_feature: Ceres CLONE 1405684-F
  misc_feature: Translation starting site: 145
  misc_feature (235)..(235): n is a, c, t, g, unknown, or other
  misc_feature (252)..(252): n is a, c, t, g, unknown, or other
gctctagaactagtggatcccccgggctgcaggaattcgcacgagaccattacctagaacatcctaatcgaaaagctcgaccggaccgacgagcgacgaagcgcgcagaaagagaagaacctcggagctgagatggcacaagccatggcgtcgatgaccggcctctcgcagggcgtcctgcccagcaggcgcgccgacagcagaaccaggacggccgtcgtcatcgtcagggcgntccgcgaggggcgacgncgttgcgcaggcggccgccgcgccgtgatcgggctggtggcatgggcaatcgtcggcggcgccttgtcgcaggcggcgcgcgccgagaccgtcaagaccatcaagattggagccccgccgccgccctccggtggactccccgggactctcaactctgaccaggcgagggacttcgacctcccctttgaaggagcggttctacctgcagccgctgccgccggcggaggcggcggcgagggtgaagacgtcggcgcaggacatcatcaacctcaagccgctcatcgacaagaaggcgtggccgtacgtccagaacgacctccgcctccgggcctcctacctgcgctacgaccctcagaccgtcatcgcttccaagcccaaggaggagaagaagagtgctcaggag

SEQ ID NO: 30243 - DNA, 658 bp, Zea mays
  misc_feature: Ceres CLONE 1405689-F
  misc_feature: Encodes the peptide sequence at SEQ ID NO. 30244
  misc_feature (658)..(658): n is a, c, t, g, unknown, or other
tccccgcggtggcggccgctctagaactagtggatcccccgggctgcaggaattcgcacgagaccattacctagaacatcctaatcgaaaaaaacacgcaaaacgtgcttctgtccctctcctgttataatttcgtcttcttccctctcccaccggtgtcctcgcctcgcctatccgatctgccacctcgccgtctcgcacgttcctttccccaactccccagcgcctctccgcgccgcgatccagatccaggttgttcagcatgggtctggtgaaggaaggcgtcgacatggaggagggaaccctagagatcggcatggagtacaggactgtatctggtgtggccgggcctctggttatcttggataaagtaaagggcccaaagtaccaagaaattgtaaacatccgacttggagatggcaccactcgccgtggtcaagtccttgaagttgatggagaaaaagctgttgtgcaggtttttgaaggaacttctggaatagacaacaaatacacaaccgtgcagtttacaggcgaggttttgaaaactcctgtctcactcgatatgcttgggcgcatttttaatggttctggaaaacctattgacaatggccccccgatattacctgaagcctacttggatatctctggaagttctatn

SEQ ID NO: 30244 - protein, 131 aa, Zea mays
  misc_feature: Ceres CLONE 1405689-F
  misc_feature (24)..(90): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MGLVKEGVDMEEGTLEIGMEYRTVSGVAGPLVILDKVKGPKYQEIVNIRLGDGTTRRGQVLEVDGEKAVVQVFEGTSGIDNKYTTVQFTGEVLKTPVSLDMLGRIFNGSGKPIDNGPPILPEAYLDISGSS

SEQ ID NO: 30245 - DNA, 640 bp, Zea mays
  misc_feature: Ceres CLONE 1405691-F
  misc_feature: Encodes the peptide sequence at SEQ ID NO. 30246
  misc_feature (213)..(213): n is a, c, t, g, unknown, or other
  misc_feature (333)..(333): n is a, c, t, g, unknown, or other
  misc_feature (336)..(336): n is a, c, t, g, unknown, or other
  misc_feature (376)..(376): n is a, c, t, g, unknown, or other
ggagctccccgcggtggcggccgctctagaactagtggatcccccgggctgcaggaattcgcacgagaccattacctagaacatcctaatcaaaaaacacaacaatctctctcccctcactccctctctgcagcgcgcagctttcaaagcgttgggagagatggcagaggagacgcaaccagaggccgcagccgccgccgcgcccgccgcggncgaggtagtcgtgaccgaagctgcgccggcggaggcggaggtgcctgcggcggcggatgctgaagccgaggccaaggatgagaagaaaggtgacgaggcggagctcaccgccgatgacgncgngggtggggaccggctcgttcaaggaggaaagccacctggntgaagacctgcccgaccccgagaagaaggcgctcgacgagttcaagcagctgatcgctgcttgcctcgcccgccgtgaagatcaactggcttccccggcggcggcggcgaaggcaaaggaaccaagggggagaagcccagggcgaagagccggccaagaagagcccgcgcccgaggcggaggaagcaagggccaggtggctgccgatgccccggttgaggagtcaagacgaaggtgcgcccggcgagaaggcagggtgagacat

SEQ ID NO: 30246 - protein, 72 aa, Zea mays
  misc_feature: Ceres CLONE 1405691-F
  misc_feature (18)..(18): Xaa is any aa, unknown, or other
  misc_feature (58)..(58): Xaa is any aa, unknown, or other
  misc_feature (59)..(59): Xaa is any aa, unknown, or other
MAEETQPEAAAAAAPAAXEVVVTEAAPAEAEVPAAADAEAEAKDEKKGDEAELTADDXXGGDRLVQGGKPPG

SEQ ID NO: 30247 - DNA, 669 bp, Zea mays
  misc_feature: Ceres CLONE 1405694-F
  misc_feature: Encodes the peptide sequence at SEQ ID NO. 30248
  misc_feature (315)..(315): n is a, c, t, g, unknown, or other
  misc_feature (371)..(371): n is a, c, t, g, unknown, or other
  misc_feature (374)..(374): n is a, c, t, g, unknown, or other
tggagctccccgcggtggcggccgctctagaactagtggatcccccgggctgcaggaattcgcacgagaccattacctagaacatcctaatcgaaaaactaggaaaaacctagacacgaagtccaacccaaatctcaatatcccaaccctccgatccccatttccatccactccgacaccaatcctccgctccgaccaccgccggagaaatggggcggcgccgccggttcgcgcagctggacgatgacgacgacgacgacgaagacgtgcccatcaatttcaagccctcgggtggcgcctcctcctcggacgccnaacccagaagccccagccgccgccgcagcagcgccgcggagtctccgatgacgacnacnaggacgtggagaagtggggaacttggaggaggaggaggacgaccagaaggatctcgaggcatgcgaacgggcccgaggaggaaggaacgccgcgagccaaaagcccaagaccaaaactcccccgccgccgggggacggcccaaggggccgcccgaacccggggaaagaagggatgaaggaacccgaaggacctgaagctgcaaacgggaggatcccccggggggagagagaacacggggaggcggggggcccgtaacttgtaggggggacccggggtcaaagaacccgtgggaag

SEQ ID NO: 30248 - protein, 119 aa, Zea mays
  misc_feature: Ceres CLONE 1405694-F
  misc_feature (36)..(36): Xaa is any aa, unknown, or other
MGRRRRFAQLDDDDDDDEDVPINFKPSGGASSSDAXPRSPSRRRSSAAESPMTTTRTWRSGELGGGGGRPEGSRGMRTGPRRKERREPKAQDQNSPAAGGRPKGPPEPGERRDEGTRRT

SEQ ID NO: 30249 - DNA, 670 bp, Zea mays
  misc_feature: Ceres CLONE 1405708-F
  misc_feature: Encodes the peptide sequence at SEQ ID NO. 30250
  misc_feature (403)..(403): n is a, c, t, g, unknown, or other
cgcggtggcggccgctctagaactagtggatcccccgggctgcaggaattcgcacgagaccattacctagaacatcctaatcgaaaaattccgcgccgcatctgggaaggtctcgtcttgctcgcctccgtccgtcgccgcaccctgcgtcgtcgccatggccacgacgcagggtgcggcggcggccggagtgttcgtctcttgctccgccgggaactccggcccatccggatccaccgtctcaaactccgctccgtgggtcgccaccgtcggcgccgggacactggaccgcgacttcccggcatacgtgatgctccccacgggtgcgcgcctggccggcgtgtccctctacgcggggacttctccctccccacgccccgccatgctcccgctcctctacggnagcgggcgtgacaacgccagcaagctctgcctctccgggacgctcgacccggccgccgtgcgcggaaaaatagttgtgtgcgaacgcggtgtaaaggcgcgagtgaagagggccgccgttctgaaagcggcccgttgtgcttgtctgtaatagttccaataccccagcaggtgaaaagaatttcgtggagcgaaagccacctgctccccctggtggcaggaacacgcacagtggtcccacataaacatccatgaacctgtcctagac

SEQ ID NO: 30250 - protein, 131 aa, Zea mays
  misc_feature: Ceres CLONE 1405708-F
  misc_feature: SWISSPROT Homolog: EC 3.4.21.25 Cucumisin
MATTQGAAAAGVFVSCSAGNSGPSGSTVSNSAPWVATVGAGTLDRDFPAYVMLPTGARLAGVSLYAGTSPSPRPAMLPLLYGSGRDNASKLCLSGTLDPAAVRGKIVVCERGVKARVKRAAVLKAARCACL

SEQ ID NO: 30251 - DNA, 647 bp, Zea mays
  misc_feature: Ceres CLONE 1405712-F
  misc_feature: Encodes the peptide sequence at SEQ ID NO. 30252
  misc_feature (575)..(575): n is a, c, t, g, unknown, or other
tccccgcggtggcggccgctctagaactagtggatcccccgggctgcaggaattcgcacgagaccattacctagaacatcctaatcgaaaaaccttgtctacaagggttttccgctgtcttatcccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgcctcgccgctcgcgggcggcgccccgtcgtacaacagcgtgccaccgccccccgatgagatccagctcgcgaagcagcgcgcgcaggagatcgcggcgcggatctttaacgccgcagaggccaagcgtcctcgcgtcgacaacggcgacgatgacagcggcggcttcggtgtaggcctgggcagcactggtggcggtggccgcatcgggcggcggaggactcggcttctcgtcctcctgccggtggtgggcacggggcttctatcccacaattatcttctcagagcagcgcacctcagactccntcttatggtgggatatcagggtacaagcaaaaagattgaatccaaaaggggaaaggggttggtgttatcatt

SEQ ID NO: 30252 - protein, 155 aa, Zea mays
  misc_feature: Ceres CLONE 1405712-F
  misc_feature (132)..(132): Xaa is any aa, unknown, or other
MADDHYSSKRKYDDPSPPPRRTGFSSGPPPASPLAGGAPSYNSVPPPPDEIQLAKQRAQEIAARIFNAAEAKRPRVDNGDDDSGGFGVGLGSTGGGGRIGRRRTRLLVLLPVVGTGLLSHNYLLRAAHLRLXLMVGYQGTSKKIESKRGKGLVLS

SEQ ID NO: 30253 - DNA, 665 bp, Zea mays
  misc_feature: Ceres CLONE 1405713-F
  misc_feature: Encodes the peptide sequence at SEQ ID NO. 30254
tcagaactagtggatcccccgggctgcaggaattcgcacgagaccattacctagaacatcctaatcgaaaaacaagctcctcctcctctcctccctacacactccagagccagaggcagcacgtgctgccgtgctcgagcacagctaggccgcagctgcatcaccatggcgggcgcgccgctgcggagatcggaccttgacttcgccgacgtctttggcggcccgccgcgccgcgtgtctgggaacgagcaccgctcgcagcgcggctcgcaggacacctcgtcgttcgagtccgcgacgagggcggggagcggcggaccggacacgcccgttttcggggaccgggggagctccgaccgaagaaggagctccgggggaggagttctacaaggacatattccccgggagcgaggcagcgtcgcccaggcgtagcggcgcccgggattggggggaaatgtgttccgggggggcgggcttcggcctgtctccacggcccggccggcgatcggagcttcctccattcggttcaacagaggccatggacagttcaatggccaacttctccctctcagaaattgtccaacagaaaacgaggatggcacatcttatgggtcaaagggttccaacttcgcccaatgcctccgttgaacattttcttgcttaag

SEQ ID NO: 30254 - protein, 88 aa, Zea mays
  misc_feature: Ceres CLONE 1405713-F
MAGAPLRRSDLDFADVFGGPPRRVSGNEHRSQRGSQDTSSFESATRAGSGGPDTPVFGDRGSSDRRRSSGGGVLQGHIPRERGSVAQA

SEQ ID NO: 30255 - DNA, 672 bp, Zea mays
  misc_feature: Ceres CLONE 1405715-F
  misc_feature: Encodes the peptide sequence at SEQ ID NO. 30256
gctctataactagtggatcccccgggctgcaggaattcgcacgagaccattacctagaacatcctaatcgaaaactactctttcggatcgccggatcgccgtctcgcacacccacttcctacaccgccaccgagcactcgctcagtttcatacccatcctcgaagtcgcctctgtctagttcctgctcttccaccaccgcctgtgatgtatccccgaggcccggatgggggacgagatgcctcgtctcgccctatgcttgccactcccgccggaaacgactcgcgcgaggaggatgagatcaccaccgcggaggctcatgtggagaaagacgccgcgcggatggacgctgccctcctcatgcggactacgcccaagatggacgagtttcgcaccgggggcgatctggactcaactggaaggtgtaagtggcatctccgggccaagcgcctccaaaagacagttaccaagaaaggggatcgtgccggcaacgaatcaaaaggcccagcatccatgcttatcctttttcctttgagcttgctatttgggtgtggcttttttgcccgccgccgcaaccaaaaaaaaaaggtgcgtcgtgtgctgtacaggggtcagcaaggtacaccatcccgcgctcatcctttatccttttggggctcctgggatggatccta

SEQ ID NO: 30256 - protein, 139 aa, Zea mays
  misc_feature: Ceres CLONE 1405715-F
MLATPAGNDSREEDEITTAEAHVEKDAARMDAALLMRTTPKMDEFRTGGDLDSTGRCKWHLRAKRLQKTVTKKGDRAGNESKGPASMLILFPLSLLFGCGFFARRRNQKKKVRRVLYRGQQGTPSRAHPLSFWGSWDGS

SEQ ID NO: 30257 - DNA, 664 bp, Zea mays
  misc_feature: Ceres CLONE 1405716-F
  misc_feature (360)..(360): n is a, c, t, g, unknown, or other
  misc_feature (446)..(446): n is a, c, t, g, unknown, or other
  misc_feature (486)..(486): n is a, c, t, g, unknown, or other
  misc_feature (641)..(641): n is a, c, t, g, unknown, or other
  misc_feature (642)..(642): n is a, c, t, g, unknown, or other
gagctccccgcggtggcggccgctctagaactagtggatcccccgggctgcaggaattcgcacgagaccattacctagaacatcctaatcgaaaaatcgatcgtccttcctgtcgtttcgttttctcgccggcagggcactgggtacgccgccgccgcctcaacgccaccacgctgccgccgcgccagttcgtcaccgcgagacacaagacacgtgcctcgcttccctcgggccggtgggccgtggcgggccgtcgctgttctgttcctatttcttggcaactccgcccgtttcacctccggaggaccgacagcgacggcgccagtagatagatgcactactgacgccactggccacctncgagttcgagtgccaagggacgccacgagaccaaccgtgaggacaggacaacggtcgcctttgcccgcggaatccgcggatttcgntcttcttgggtgccatggatccagtcgccggcacggcggnacatcggggccccgtttggaaagtgcgcgcccgcgcgcccggaagaaaattttcttcgcgggcgaggaacgccgtcgtccacggttttccgcccgccgtcgcggcttgccatcgatctctacaccaactcctccctcctccttccgccccgaggnncaaggaaaaaggtggggcggcg

SEQ ID NO: 30258 - DNA, 658 bp, Zea mays
  misc_feature: Ceres CLONE 1405718-F
  misc_feature: Translation starting site: 182
  misc_feature: Pfam Name: Cytochrom_C Pfam Description: Cytochrome c
gctctgaactagtggatcccccgggctgcaggaattcgcacgagaccattacctagaacatcctaatcgaaaaataagctctgctaggtcgtcgatcgcatgcgcatgtgtactttttaacttgtgcgatcgatcatcatctcgatccagccgcccgccgtatttagctaaatctgctgccatgtcttcctttgacgaggctcccggcgctgacgccggcagcgttgagaagatcttcccgcaccaagtgcgcgtagtgccataccgtggagcgaggtagggcgcacaggcagagacccaagctgcacggcctcttcggtcgtcattcaggcaccacccctcgaatatgcctactccacgggcaacaagaacatggccgtctgtctgtgaggaaggaaccctgtacgaacacctctttcacccccaagaagtacattccaggcacaaaagatggcccttcccggggctcaaaaaagccttagggaaggaaacgattttcatcggctaacctaagggaatccccgggattaaacttccctcaacgcatacttaaataaattcccccatgcacgccacgcaccatcattaaattcgggggtaggaaacccaccttttccctttccttttaacctttataaaagaaacctcccttctttag

SEQ ID NO: 30259 - DNA, 796 bp, Zea mays
  misc_feature: Ceres CLONE 1405719-F
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (41)..(41): n is a, c, t, g, unknown, or other
tttccccccccnnnggnnnntnttttctattttttagccgntcccctccaatctggagctccccgcggtggcggccgctctagactagtggatcccccgggctgcaggaattcgcacgagaccattacctagaacatcctaatcgaaaaatttgccaatgcgacggtgaaatcccgcacctacctccttcctctctcaccgaggaccctcgcaccaagaactgagcgggaagagaggtagagaggcaagcgcacgagagtttctgctcctagtctcgtctcgccccgcctccgtctcctttccctctctggttctctctctgcgactctcgtcgcattggttccgttccctcacgaaaggcggaagctttctgtcttccctgatctatctagatcatggggaccacgacgtcagcgaccaccgtcgcagcagcaagccgccaccacccgccaggccgcgggtggtctgtcgtcggccctctgcccagaagggtggccgcgcgacggaaggcggcgcctccgggggggggtggcgctgacaacccccgccggggtggagggtccgggccccagcccggtggaaaaaggccgccaagaggccgccgccccccgaggcacgtccaaatattttccggccggccgggaaccttgtggggggtaagcgaccaccaataacgtgtgggaagcggccccatgtgttacacaccctggcacccggtggagaagagggcggcgacaacaacctgtgccggttccgtaggagggaaatatggagcgcctctcgggcgtgtaaatac

SEQ ID NO: 30260 - DNA, 604 bp, Zea mays
  misc_feature: Ceres CLONE 1405722-F
  misc_feature: Encodes the peptide sequence at SEQ ID NO. 30261
tccccgcggtggcggccgctctagaactagtggatcccccgggctgcaggaattcgcacgagaccattactagaacatcctaatcgaaaaattttattaattaacaaagagaagacttcttccttcctcgtcgtctccagcccattccaattcttgattccatcgccccaccatccacaactcccctaatccttccaacctcctcgtcgtccagtccaccacctccacgcgcaatggccagcggctaggcggcaccaaccagatcacaaggattcgtttcatccggcagcgcagctctagagcctccatgggcagctacgcgtacaagtactgtatgtgcttcacgcgcaagttccgatccccggacgcccagccgccgccggacgtccgcgccgcccacctctccttcgcctctgacgcccatgccctccgccgcttcgtcgccggcggccagggcgagtcccccgccgacgtcaacgcatcctcccatgctctccgggggcacagccatgaaatcgccgctcgtcaaaggtcgcggcgcaaccacgccccgctcgaagactctttgctttctcgtttccccgacttaaccacccattgggaa

SEQ ID NO: 30261 - protein, 99 aa, Zea mays
  misc_feature: Ceres CLONE 1405722-F
MGSYAYKYCMCFTRKFRSPDAQPPPDVRAAHLSFASDAHALRRFVAGGQGESPADVNASSHALRGHSHEIAARQRSRRNHAPLEDSLLSRFPDLTTHWE

SEQ ID NO: 30262 - DNA, 668 bp, Zea mays
  misc_feature: Ceres CLONE 1405724-F
  misc_feature: Encodes the peptide sequence at SEQ ID NO. 30263
  misc_feature (354)..(354): n is a, c, t, g, unknown, or other
  misc_feature (668)..(668): n is a, c, t, g, unknown, or other
gctcaataactagtggatcccccgggctgcaggaattcgcacgagaccattacctagaacatcctaatcgaaaagaaacccactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggcaacagccggccccgccgccgcaggggctccgctctacctctccctctcccgccggtggncgcgcactctgctcggattgctgttgagatgcccaaagcctttgtgatcctagatgatgttgtgcacacccccttactaatttgcacagtcttccaaaagcttactaatttggcaggccaagggttgagggaccaaattctcaaaaagggtattttttgaattttggaaagaggcccaggggcccttggtgggggcaaatttccaacccctccctaaaccccgggggcagggggcccccggcccaaaaaattttggatttcggcaccgggaaaggggggcaaaaaaaaatccctggcgccgcgaaagagaggcn

SEQ ID NO: 30263 - protein, 133 aa, Zea mays
  misc_feature: Ceres CLONE 1405724-F
  misc_feature (81)..(81): Xaa is any aa, unknown, or other
MATSPPQNPSSGEPSDASSLAAAALEAPVRVWRSLVARFPPLPDSSSFLAGVSDLQLRYFGNSRPRRRRGSALPLPLPPVXAHSARIAVEMPKAFVILDDVVHTPLLICTVFQKLTNLAGQGLRDQILKKGIF

SEQ ID NO: 30264 - DNA, 681 bp, Zea mays
  misc_feature: Ceres CLONE 1405726-F
  misc_feature: Encodes the peptide sequence at SEQ ID NO. 30265
  misc_feature (365)..(365): n is a, c, t, g, unknown, or other
aagctggagctccccgcggtggcggccgctctagaactagtggatcccccgggctgcaggaattcgcacgagaccattacctagacatcctaatcaaaaaacctcagtagtagcaggacgtatctagagccatttctacacgagatagagattaataaaaataggagcggagagagaggggcaggaaataaacgaggatctcaaccacacgcaacacaagaagctgacgaagggctaatcccccggaacccgttaacgctgtgggagtgtgagcccacccggccacccgtttcggctaatctaccgctcgccttctcccatcgccatgcctgccgcttcctggtccgcgcccaccacctccttcngggcgggcgccggcgcccgccattgggggcccgtggaggaccaaggcggcgcctttacccatcaggacgcttccccgccgagtgcttctcaacgcagttggcgaatccgccatggttgctgctggtgacacattgcttggtttgtatgagaaagagcggttaggcctgttgcagtatgccgacgacgagtctaaagaagagaggtactgcgaaaccttggatgctgatttgcgttactggaccagatccctgcggcccagtgcagtggtatcctggtcatattgcaaaaacagagaaagaatcgaggaacattgag

SEQ ID NO: 30265 - protein, 67 aa, Zea mays
  misc_feature: Ceres CLONE 1405726-F
MVAAGDTLLGLYEKERLGLLQYADDESKEERYCETLDADLRYWTRSLRPSAVVSWSYCKNRERIEEH

SEQ ID NO: 30266 - DNA, 637 bp, Zea mays
  misc_feature: Ceres CLONE 1405729-F
  misc_feature: Encodes the peptide sequence at SEQ ID NO. 30267
  misc_feature (358)..(358): n is a, c, t, g, unknown, or other
  misc_feature (459)..(459): n is a, c, t, g, unknown, or other
  misc_feature (488)..(488): n is a, c, t, g, unknown, or other
  misc_feature (498)..(498): n is a, c, t, g, unknown, or other
  misc_feature (597)..(597): n is a, c, t, g, unknown, or other
  misc_feature (613)..(613): n is a, c, t, g, unknown, or other
gctctataactagtggatcccccgggctgcaggaattcgcacgagaccattacctagaacatcctaatcgaaaacacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcgncgcctcgccctacgacgacgaccgcatcggggacatggcccgcttcgcggacacgctgtcggacacctccccgggctcgcccgcgcagcgcttcgtgtcgnagggacgcgtcatcactcgcgcccgcggntgctgggcgncggaactgcatcaacgccggcttctacacgcggggcagcgacgactacgtggggggcgtcgagtgggacctgggcgccgccgggcggcgtaccgggggngggaggacggggtgcngttccagccggagtggggtccttg

SEQ ID NO: 30267 - protein, 171 aa, Zea mays
  misc_feature: Ceres CLONE 1405729-F
  misc_feature: SWISSPROT Homolog: EC 4.1.2.10 Mandelonitrile lyase
  misc_feature (79)..(79): Xaa is any aa, unknown, or other
  misc_feature (113)..(113): Xaa is any aa, unknown, or other
  misc_feature (126)..(126): Xaa is any aa, unknown, or other
  misc_feature (159)..(159): Xaa is any aa, unknown, or other
  misc_feature (164)..(164): Xaa is any aa, unknown, or other
MSGRSRHFTMSTLLATSFFFVLLCSSLQVRGVNYTFVKDAALAPSVSYYDYIIVGGGTAGCPLAATLSERFRVLLLERXASPYDDDRIGDMARFADTLSDTSPGSPAQRFVSXGRVITRARGCWAXELHQRRLLHAGQRRLRGGRRVGPGRRRAAYRGXEDGVXFQPEWGP

SEQ ID NO: 30268 - DNA, 613 bp, Zea mays
  misc_feature: Ceres CLONE 1405732-F
  misc_feature: Encodes the peptide sequence at SEQ ID NO. 30269
  misc_feature (250)..(250): n is a, c, t, g, unknown, or other
  misc_feature (283)..(283): n is a, c, t, g, unknown, or other
  misc_feature (305)..(305): n is a, c, t, g, unknown, or other
  misc_feature (330)..(330): n is a, c, t, g, unknown, or other
  misc_feature (371)..(371): n is a, c, t, g, unknown, or other
  misc_feature (372)..(372): n is a, c, t, g, unknown, or other
gctctataactagtggatcccccgggctgcaggaattcgcacgagaccattacctagaacatcctaatcgaaaatcctgctcgccgccgggtctgggctgggtgacgctgcctcggatgaggccgcgctgaccggagccgtagccggaccacccgcccacccatggcgcgcccgcagcgcgtgtatgagtcttggaaagggaacaataaattcttctttggtgggaggctcatattcggacctgacgccnagtcactgatcctgtctgtttcgctcattgtgnccccggtattggtcttctgcgnattcgttgctcggcatctttcgcancacttttccggcttacaatgctggatatgcgattcctgcgnnagctgtagtgtttatgatttatgggctaggcctgctcttgattactcagcgcaggatcctgggatcgtttccccgggaacccacccggcgggagatgagtttcttatgcaaccctttgtcgggggcacccctgggaggctaaattcccccgggaaagggaatatcggttaatgggaaggccgggaaaggaaaaattgggcccccggcttgatttttcgccccctccgagggtaccgggggg

SEQ ID NO: 30269 - protein, 126 aa, Zea mays
  misc_feature: Ceres CLONE 1405732-F
  misc_feature (30)..(30): Xaa is any aa, unknown, or other
  misc_feature (41)..(41): Xaa is any aa, unknown, or other
  misc_feature (48)..(48): Xaa is any aa, unknown, or other
  misc_feature (56)..(56): Xaa is any aa, unknown, or other
  misc_feature (70)..(70): Xaa is any aa, unknown, or other
MARPQRVYESWKGNNKFFFGGRLIFGPDAXSLILSVSLIVXPVLVFCXFVARHLSXHFSGLQCWICDSCXSCSVYDLWARPALDYSAQDPGIVSPGTHPAGDEFLMQPFVGGTPGRLNSPGKGNIG

SEQ ID NO: 30270 - DNA, 667 bp, Zea mays
  misc_feature: Ceres CLONE 1405733-F
  misc_feature (452)..(452): n is a, c, t, g, unknown, or other
cgcggtggcggccgctctagaactagtggatcccccgggctgcaggaattcgcacgagaccattacctagaacatcctaatcgaaaaaaaaaaaaactggtcccctccgccctccgccgtaccaccgcgcctccgcatttcgcatcaagccggagcgggggcagaggcgcctctcccgccggagacccgagcgagaaccgccgcttccccctccttctcctcattttgaaatcgcgttttggcggtctatctcctccgcaccgcgcaccatctctcctccgctgcaacgctacttaaccgcctcgatttgctccccatttccccgtccagcctagatagacctgagccgaaaccctaggaccccgcgcctccgcttccgcttccccctctcccgcagctgacgaggccgacgatgggtgacaaggagaacgcacttccttgggcccgggggnccgcggcggcccccctgcttacgcgggccgcgtcaagggaggctcagcccccgaagtggatccttacggccccgttagacccctccgggcgcggatggggggcttaggggccccttcgggaacccagaagggcgggcgcccgccacccggtcccggccgtcacggccgccgccgctgcccggagtcctttctgggccgcgggaatgggggggccg

SEQ ID NO: 30271 - DNA, 662 bp, Zea mays
  misc_feature: Ceres CLONE 1405735-F
  misc_feature: Encodes the peptide sequence at SEQ ID NO. 30272
  misc_feature (323)..(323): n is a, c, t, g, unknown, or other
  misc_feature (352)..(352): n is a, c, t, g, unknown, or other
  misc_feature (454)..(454): n is a, c, t, g, unknown, or other
tccccgcggtggcggccgctctagaactagtggatcccccgggctgcaggaattcgcacgagaccattacctagaacatcctaatcgaaaagaaaatctctgctcatttcacatcgaacgctccgcctacaatcctgtactgcacgcgctccccatccgcacaacttcccgcctccaatggcggcgcccggcgccgggggccacccgcctccaccccccgttcctcctgcttccttccccgccgcgaccccatcctccactccggctccgcttcctcctgccgtccccgccgcctctccgcctccgccgccgcttccggctgnctcgcttgccgccgccgtctccgccgganggcggcggtggagagtgaggaagccgccggcaggaaggccgataaggccaggcagctgcagaagcgtgtcctcgtgggcgtcgccatcggcatgtggcagcntacatcgtgatcggctcaaacagtagatggctagctagcagcgcacatgctggccgagggatcgcatggtagggtgagcaccaaggctgagtgtttagcaatcctattttgaccacgccaattttaaagtgggcctactaaatattccgtcccctggcataatgaatgataactcccaactctattgaataggaagaaaggggtaaca

SEQ ID NO: 30272 - protein, 122 aa, Zea mays
  misc_feature: Ceres CLONE 1405735-F
  misc_feature (108)..(108): Xaa is any aa, unknown, or other
  misc_feature (117)..(117): Xaa is any aa, unknown, or other
PRGGGRSRTSGSPGLQEFARDHYLEHPNRKENLCSFHIERSAYNPVLHALPIRTTSRLQWRRPAPGATRLHPPFLLLPSPPRPHPPLRLRFLLPSPPPLRLRRRFRLXRLPPPSPPXGGGGE

SEQ ID NO: 30273 - DNA, 510 bp, Zea mays
  misc_feature: Ceres CLONE 1405736-F
  misc_feature (223)..(223): n is a, c, t, g, unknown, or other
  misc_feature (239)..(239): n is a, c, t, g, unknown, or other
  misc_feature (255)..(255): n is a, c, t, g, unknown, or other
  misc_feature (257)..(257): n is a, c, t, g, unknown, or other
  misc_feature (281)..(281): n is a, c, t, g, unknown, or other
  misc_feature (283)..(283): n is a, c, t, g, unknown, or other
  misc_feature (288)..(288): n is a, c, t, g, unknown, or other
  misc_feature (375)..(375): n is a, c, t, g, unknown, or other
  misc_feature (417)..(417): n is a, c, t, g, unknown, or other
  misc_feature (476)..(476): n is a, c, t, g, unknown, or other
  misc_feature (486)..(486): n is a, c, t, g, unknown, or other
  misc_feature (496)..(496): n is a, c, t, g, unknown, or other
aagctggagctccccgcggtggcggccgctctagaactagtggatcccccgggctgcaggaattcgcacgagaccattacctagaacatcctaatcgaaaaactacaacatctgtcaccgtgaaatctcggctacctccttctgacttctggtacctcgccgccggggaacccaactccgaatccccaccccccacccaataccaaaaggcccacccgccggngcttggcggggctggncggggccttcccggcnantccaattcaaatgggggtgggctngnaaaanaaacctttctccggggtgcgcggcgggaaaaaaaactctttccaaaacccgcgggaagtggggttttcctccccaaaagaaaaaaantcccccccctcgggggggaaaaagtgaagaaaaaaggggggnccccccctccccggggggggccccccccccgggagaaaaaacccccccccccccccccnaaaaaaaaanacacccccgnttggtggggttggg

SEQ ID NO: 30274 - DNA, 712 bp, Zea mays
  misc_feature: Ceres CLONE 1405737-F
  misc_feature: Encodes the peptide sequence at SEQ ID NO. 30275
  misc_feature (398)..(398): n is a, c, t, g, unknown, or other
  misc_feature (561)..(561): n is a, c, t, g, unknown, or other
  misc_feature (574)..(574): n is a, c, t, g, unknown, or other
  misc_feature (578)..(578): n is a, c, t, g, unknown, or other
  misc_feature (645)..(645): n is a, c, t, g, unknown, or other
  misc_feature (646)..(646): n is a, c, t, g, unknown, or other
  misc_feature (669)..(669): n is a, c, t, g, unknown, or other
aagctggagctccccgcggtggcggccgctctagaactagtggatcccccgggctgcaggaattcgcacgagaccattacctagaacatcctaatcgaaaagctcaattccactgccaagattcgccactccgtccgttaccttcactcgctcactcacaatgcggcgccatggcgaggtacgcgtgatcttagctatggccgccgccgccgccgccgcgctcttggcgtcggcggccgtggccggacgagacggccggcagacctacatcgtccacatgtcccattccgccatgccggacgagttcgcggagcatgaggaatggtacgccgcgtcgcttcaggcggtgtcggatgccgccaccgtgctgtacacctacagcaccctcctccacggcntactcggcgcggctgacgcgcgcggaggccgcggcgctggagtcgcagccaggggtgatcgtcgcaaacccgggaggtgcggtacgagctgcacaccacccggacgcccgagttccctggggctggacggcacggacgcgttgttccccgcagtcggcccccnggaccgaaatccnttcnttttgggggtgctcgaaaacccgggctcttggggcccggagaggcccgagctacgaacgacaccggnntttcggcccccgtgccggggggncctgggaaaaggggcaaaggggcgaaggacgggcaacgacttt

SEQ ID NO: 30275 - protein, 184 aa, Zea mays
  misc_feature: Ceres CLONE 1405737-F
  misc_feature (80)..(80): Xaa is any aa, unknown, or other
  misc_feature (134)..(134): Xaa is any aa, unknown, or other
  misc_feature (140)..(140): Xaa is any aa, unknown, or other
  misc_feature (162)..(162): Xaa is any aa, unknown, or other
  misc_feature (170)..(170): Xaa is any aa, unknown, or other
MRRHGEVRVILAMAAAAAAALLASAAVAGRDGRQTYIVHMSHSAMPDEFAEHEEWYAASLQAVSDAATVLYTYSTLLHGXLGAADARGGRGAGVAARGDRRKPGRCGTSCTPPGRPSSLGLDGTDALFPAVGPXDRNPFXLGVLENPGSWGPERPELRTTPXFRPPCRGXLGKGAKGRRTGNDF

SEQ ID NO: 30276 - DNA, 599 bp, Zea mays
  misc_feature: Ceres CLONE 1405739-F
  misc_feature: Encodes the peptide sequence at SEQ ID NO. 30277
tccccgcggtggcggccgctctagaactagtggatcccccgggctgcaggaattcgcacgagaccattacctagaacatcctaatcgaaaaatctctctcgctttctctagccatgacgctggtgaggatgccttgccgcctctgctgcttcctgctcgtcgtcgccgcctccgccgtctccgggcgggggcgggtggtcaccaccctcccgggctacgagggccgcctccccttccacctcgaaacagggtatgtggaggtggacgaggacgccggcgcggagctcttctactacttcgtccgggccgagtccggcgccgacgacagcgacaccccgttcgtcctccggatccccggcggccaacgctgctccgccttcagcggcctcgcctaacgagataggtcccatcatgggttccggccggggggagaccccaaaaaaaggagttttggggggcttgggtaaaaccaaaattgggggaaaaagggggcaatattttttttggggaatccccaaggggggggcgcggtttttttctcccaaaaaaagaaggggaaaaaaccggggggggggttaaaccccccgcggttgtgggga

SEQ ID NO: 30277 - protein, 93 aa, Zea mays
  misc_feature: Ceres CLONE 1405739-F
  misc_feature: SWISSPROT Homolog: EC 2.3.1.91 Sinapoylglucose--choline O-sinapoyltransferase
MTLVRMPCRLCCFLLVVAASAVSGRGRVVTTLPGYEGRLPFHLETGYVEVDEDAGAELFYYFVRAESGADDSDTPFVLRIPGGQRCSAFSGLA

SEQ ID NO: 30278 - DNA, 764 bp, Zea mays
  misc_feature: Ceres CLONE 1405740-F
  misc_feature: Translation starting site: 260
  misc_feature: Pfam Name: PseudoU_synth_1 Pfam Description: tRNA pseudouridine synthase
  misc_feature (1)..(1): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (24)..(24): n is a, c, t, g, unknown, or other
  misc_feature (25)..(25): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
ntttccccccccnnnnnnnnnttnntannnnnnnngtctcgggctccccctttagctggcactccccgcggtggcggccgctcttccatagcggatcccccgggctgcaggttttcgcacgagaccattacctagaacatcctaatcgaaaaggcggaagctcccttcatttctttcacctccgattcgattccttgtcccctcttgatccgagccgccaccaaaccctaactatctaaaacccccgtctcgctgtccgatggccgccgcctcgccgccgccctccccaccccacgcaaagcgccccaagatgtcctcctcctccgacccggaagccgatgctgagcccacctcggcctccgccgccgttgagggcgccgatcctgcgcagcgtcgtcccaggtacaagcgccgcaaggtcgccatccttctcgggtacctgcggcgcggggtatcagggcatgcagaagaatccgggcgcgcgccccattcgagggggacctcgaggaggcgctctaccaggggggcgccgtgcccgaggtcgaacggttcgtgccgggcccgctacaattggtcacgcgctgcgggcaccggacaaggcggccagggccagaaggtaaggggcgggccccaccccccatcaacggacgaaggccccggggttatactctgaagaaggcggggagacgccgcaacacaacggcgccgacacacaccccggcccacaacgcaggaacccggggccccgccttcctcgcctctct

SEQ ID NO: 30279 - DNA, 676 bp, Zea mays
  misc_feature: Ceres CLONE 1405741-F
  misc_feature: Encodes the peptide sequence at SEQ ID NO. 30280
  misc_feature (416)..(416): n is a, c, t, g, unknown, or other
  misc_feature (417)..(417): n is a, c, t, g, unknown, or other
  misc_feature (433)..(433): n is a, c, t, g, unknown, or other
  misc_feature (445)..(445): n is a, c, t, g, unknown, or other
  misc_feature (512)..(512): n is a, c, t, g, unknown, or other
  misc_feature (538)..(538): n is a, c, t, g, unknown, or other
  misc_feature (658)..(658): n is a, c, t, g, unknown, or other
acccgcggtggcggccgctctagaactagtggatcccccgggctgcaggaattcgcacgagaccattacctagaacatcctaatcgaaaaaattcacgcccccaccacgacttccgtgctcgccgccttctcggactaggggggttcggctcgagatctgatttcgggcgccggaggactacatggaggttagggagatggcgatggccgcggcggctgcggctgcggcgtccggcgggggaggcgtcaagctgccgccgcccaatcccaacctgccctacagggaggactgctggagcgacggcgagacggcagctctcgtctccgcctggggcagccgctacgtcgagctcaaccgcggtaacctgcgccagaagcagtgtcaggaggtggcggacgccgtcaactcgcgccgnngagcctccgcgtcggngcccgccgcgtngcacgacatccagtgcaagaaccgcgtcgatatccctcagaagaagtacaagggcgagctcgcccgnaacgcgcgtccgcctgttcctacttncccgagctcgacccggcttcgtgggccaacccttaaggcctccgcctccagaaaacccctggggggcccggcccccccaatcgttttgcaaggatccacaacgggggggggggccccggnggctttcgcggtattttc

SEQ ID NO: 30280 - protein, 164 aa, Zea mays
  misc_feature: Ceres CLONE 1405741-F
  misc_feature (79)..(79): Xaa is any aa, unknown, or other
  misc_feature (84)..(84): Xaa is any aa, unknown, or other
  misc_feature (88)..(88): Xaa is any aa, unknown, or other
  misc_feature (119)..(119): Xaa is any aa, unknown, or other
  misc_feature (159)..(159): Xaa is any aa, unknown, or other
MEVREMAMAAAAAAAASGGGGVKLPPPNPNLPYREDCWSDGETAALVSAWGSRYVELNRGNLRQKQCQEVADAVNSRRXASASXPAAXHDIQCKNRVDIPQKKYKGELARNARPPVPTXPSSTRLRGPTLKASASRKPLGGPAPPIVLQGSTTGGGAPXAFAVF

SEQ ID NO: 30281 - DNA, 641 bp, Zea mays
  misc_feature: Ceres CLONE 1405744-F
  misc_feature: Encodes the peptide sequence at SEQ ID NO. 30282
  misc_feature (434)..(434): n is a, c, t, g, unknown, or other
  misc_feature (548)..(548): n is a, c, t, g, unknown, or other
  misc_feature (549)..(549): n is a, c, t, g, unknown, or other
  misc_feature (641)..(641): n is a, c, t, g, unknown, or other
tggagctccccgcggtggcggccgctctagaactagtggatcccccgggctgcaggaattcgcacgagaccattacctagaacatcctaaaaaaaaactatcggatcttgcgaaggcatcgtcctcttcgtctccttcgtcgtcctatcttataatcgcatttcgaaatccccaaacggaagcatcgccactcttccgaacctgaacaatcaccaccgttattaagaagatgatgcgctgcgctgcaacgggcggcgggtgcgtcgcttcgtggagcggcgatcggagattgccggcggtcaacccctgcagcgtgcggatgccgacgggcaacgatgggtggtgcgccggcctgaggtcgcgggcggcggatctcgccggcctcgagatggcaacctgcgcggcggcgtcggggggctcttccgcgcgagccngcgctacgggcgcttgcagccacggcggcagttgaccctgaagatattccattggagaaggttcaagttaatcctcaggacatggtctggcatatgttggcgttgcttggtggnnggcaattctgtttggtaccatctttgtgtgggcaatggcgcacttgatatctcgccaaggaacttgggatgctgaaatgctgcttgaagggn

SEQ ID NO: 30282 - protein, 79 aa, Zea mays
  misc_feature: Ceres CLONE 1405744-F
  misc_feature (69)..(69): Xaa is any aa, unknown, or other
MMRCAATGGGCVASWSGDRRLPAVNPCSVRMPTGNDGWCAGLRSRAADLAGLEMATCAAASGGSSARAXATGACSHGGS

SEQ ID NO: 30283 - DNA, 691 bp, Zea mays
  misc_feature: Ceres CLONE 1405747-F
  misc_feature: Encodes the peptide sequence at SEQ ID NO. 30284
  misc_feature (582)..(582): n is a, c, t, g, unknown, or other
cgcggtggcggccgctctagaactagtggatcccccgggctgcaggaattcgcacgagaccattacctagaacatcctaatcgaaaacattgaatttggccgagtaacagaaccgtgtctgtttttaattcctgacggttagagatggcccacccctccgccgccgccgtatcctccacggggctcgctgcaaaccctagctctggcgccagcgaggaaggaggcgcccgctctccgccgtcgccgtctcatagggcgcggtccaaggtggtgatcgttatgggcgccacgggcgccggcaagttcgcggatggccgtcaacctcgcggcccacttcgccggcggctaggcgccccccgccggctccatgcagatctaccggggcctcaacatgttaaccaaaaggctcgcctccagggggagaacgggggtccgccttatccacttcgggcattggacccgcccaggcgacgttctctagtccgtacgcccgcgaccgcggcctgccccaccataaggaaaattgggcatccggcgtgcctttcctctgagccatacgcccttaacctctatcccgaccanacgcggcggccgtggccctccgtcctccgcgctaatatacgttcctacccgcctccccagcgcccccgcccccccccactccccgccactccgccctcctcctcccccc

SEQ ID NO: 30284 - protein, 37 aa, Zea mays
  misc_feature: Ceres CLONE 1405747-F
MQIYRGLNMLTKRLASRGRTGVRLIHFGHWTRPGDVL

SEQ ID NO: 30285 - DNA, 644 bp, Zea mays
  misc_feature: Ceres CLONE 1405750-F
  misc_feature: Encodes the peptide sequence at SEQ ID NO. 30286
gctctagaactagtggatcccccgggctgcaggaattcgcacgagaccattacctagaacatcctaatcgaaaacttcttcttttttccctacccctccgccggtgctctgcaaggcacgcgtcctgcacgcgccaaagctaggcgataaactggaaaggagcgcgcagcgcacgcttcgggctcctgtctccgccgcggcgtcctctcgctttttcaggactttcaggacttgcaggctctgcgcagcgcgatctgacatctgaccgggtcagacgatacagcccatatacgacgttacgtcgagtcctcaaagttcaattctacctggaccattgcacccatcttggcccaaagtacttgcgcgccgcgctacgaacgaggccatccgccgccacacgccgtcggccatgccgcagaggtcagaggcggtcactgctggggagggcgacgaggagcagcggctgcgggctgctctgcgtccctgcaggcggaaaggggggggttgctgggagcgcctggtgtacaagcaccggaaccagcaccgcgggcgccgcctatttccatacctcttcaaagggggaggagggacctgaagcttctggctcggcgcccgaacctcgctgaggtcctccaaggccgttg

SEQ ID NO: 30286 - protein, 61 aa, Zea mays
  misc_feature: Ceres CLONE 1405750-F
MPQRSEAVTAGEGDEEQRLRAALRPCRRKGGGCWERLVYKHRNQHRGRRLFPYLFKGGGGT

SEQ ID NO: 30287 - DNA, 794 bp, Zea mays
  misc_feature: Ceres CLONE 1405751-F
  misc_feature (1)..(1): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
naacccccccccccnncnnnaaaccaccaacacaaaaaagagtattttttcaaaagtggaactccaccgcggtggcggccgctcttccatagtggatcccccgggctgcagtatttcgcacgagaccattacctagaacatcctaatcgaaaaagtcgtccctgtccctccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcggccccgagccgtcgcgcggtcgcctccacatctcgtcgtgctttaaggtctttggcctccgccgttcttggacaggggcacaccactgtccaccggtgcccactacgcgaaatacgagtccctcgtgcggctccgtagggtggaagagatccatcaggcggcgagtgggaggcccggcgtccacacaaccggaagcggaggggtccaacgctgtccgtgtcacgctcccctctggcacgtggctatctccccccgctgcctacccccggaaggcaacgccgaagaggcccaagccaaataccttatactgaccaccgagaaaagccgcgaaataacatacctcccccacattggcctccctcccgtgcctcgccatgccacatgggagccgtgactgccacccctgctctgtgcgcggcgccacccggccgccaggcctcatctccgtccgccgtgtccgctctaacgacaacatacacct

SEQ ID NO: 30288 - DNA, 637 bp, Zea mays
  misc_feature: Ceres CLONE 1405753-F
  misc_feature: Encodes the peptide sequence at SEQ ID NO. 30289
  misc_feature (447)..(447): n is a, c, t, g, unknown, or other
  misc_feature (593)..(593): n is a, c, t, g, unknown, or other
  misc_feature (620)..(620): n is a, c, t, g, unknown, or other
aagctggagctccccgcggtggcggccgctctagaactagtggatcccccgggctgcaggaattcgcacgagaccattacctacaacatcctaatcgaaaaaacaaagaaagtcgcggcggagcaatgtgctgcaacgcgaaggtctcgccactgccggttgagatggacacctccgcctccaaagtgctcaccaacgacgatctccttcacgacatccttctccgcctaggatgcccgagctgcctcgtcagtgccgcgctcaccagcaagtgctggctgcgtggcgcctccgatcaggtcttcgcgcgcgacttctgcgcggaccaccagccgcgcctacttgggatctacgtctccagcagcggcatctctggggtcggagttcatcccattcaggcaacctgctggtggtctaggcccgaggtgagtactgtcctcaccatgncgattttcgggtttgggcgacctgccggcgccaagcggtttgggactgtccgaaacggatggtctcttctccagttcggggggcagactttaaaaccccgtgggctctccttgggggttcccccgtggtggttccaaaatggcccnaaaaaggggggggtttccccccgtttncccaaacgcgcaatatt

SEQ ID NO: 30289 - protein, 170 aa, Zea mays
  misc_feature: Ceres CLONE 1405753-F
  misc_feature (108)..(108): Xaa is any aa, unknown, or other
  misc_feature (165)..(165): Xaa is any aa, unknown, or other
MCCNAKVSPLPVEMDTSASKVLTNDDLLHDILLRLGCPSCLVSAALTSKCWLRGASDQVFARDFCADHQPRLLGIYVSSSGISGVGVHPIQATCWWSRPEVSTVLTMXIFGFGRPAGAKRFGTVRNGWSLLQFGGQTLKPRGLSLGVPPWWFQNGPKKGGVSPRXPKRAI

SEQ ID NO: 30290 - DNA, 790 bp, Zea mays
  misc_feature: Ceres CLONE 1405754-F
  misc_feature: Encodes the peptide sequence at SEQ ID NO. 30291
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (48)..(48): n is a, c, t, g, unknown, or other
ntggccccccnnnnnnnnnnnccctactatcggttcccctaccccccnccaaagctggagctccccgcggtggcggccgctcttaactagtggatcccccgggctgcaggaattcgcacgagaccattacctagaacatcctaatcgaaaaaaacacaacaatctctctcccctcactccctctctgcagcgcgcagctttcaaagcgttgggagagatggcagaggagacgcaaccagaggccgccgcagccgccgccgcgcccgccgcggacgaggtagtcgtgaccgaagctgcgccggcggaggcggaggtgcctgcggcgcaggaagctgaagccgaggccaaggatgagacaaaaggtgacgagctggagctcgccgccgatgacgcgggaatgcatgaccggagtcctccaggaggggggggcgcggggggaagaccccgcccgagccgcgaaataaaggagctgggaaaggcacacggaggggaggggctggcggcccctccgccgggaaggccgcctccatcccctgacctccccccgatgactcccgcctacattccgagggcacccaaagtccccacaggctacctttcgcccggggtgccccggctatgagtggcggcgcgcggtcccccgcgctttacccggcgagggtgaggggggggaggggggtcccacagtggggcgccgcggcccctcccccacccacccagcggcagcccgcgaaacccaagcgaccgccggtggccgcgcccacgggcccccccgacaccactccccccg

SEQ ID NO: 30291 - protein, 134 aa, Zea mays
  misc_feature: Ceres CLONE 1405754-F
MAEETQPEAAAAAAAPAADEVVVTEAAPAEAEVPAAQEAEAEAKDETKGDELELAADDAGMHDRSPPGGGGAGGRPRPSREIKELGKAHGGEGLAAPPPGRPPPSPDLPPMTPAYIPRAPKVPTGYLSPGVPRL

SEQ ID NO: 30292 - DNA, 657 bp, Zea mays
  misc_feature: Ceres CLONE 1405755-F
  misc_feature (595)..(595): n is a, c, t, g, unknown, or other
cgctcttaactagtggatcccccgggctgcaggaattcgcacgagaccattacctagaacatcctaatcgaaaaagagagagagagagatagacaggagagagagagagaggggaagagagagagagagagagagagagagatagatgtggtaactcaagaactgttcttatgcatgcagcagccataagcattgctactaggtgccgattcccctcttctttgttttttattcccctcttgctcttctttgatgatgattggctgggaactacatcttggaattccttttttttctctctctcactcgatttctttgtttgattattggccatggtgggtgattcctcgcctgttttatctcgaaactggattagctgcgagttttttttttcttctttcaacccgctgcgttattctaagctcggtctactcgttgcatcaggccaacaatggcaagtggcttccatgaacatggctgtccatgaaaaatcccccgtatgcatgctcggtctaatctcctcaagctagcgaaccgaaatttcctaaaaagccggtctggcccctcaaaaacggctggttgcctgaaccgctgngagtcctatgaaggaacaaagttcttccctttcttttgcgcgcgataacggttacccggctc

SEQ ID NO: 30293 - DNA, 622 bp, Zea mays
  misc_feature: Ceres CLONE 1405757-F
  misc_feature: Encodes the peptide sequence at SEQ ID NO. 30294
gctctagaactagtggatcccccgggctgcaggaattcgcacgagaccattacctagaacatcctaatcgaaaaccccaaataacaccaaggcaccaagcccagcgaggccaccagctgtccagctccacctcgtcgactcctccccgcacaagacaaaaaaaccctcgccttggagggtggaggcgcgtgagcccgacacccagagcgaaaaaagcaaggggtctgaccgccggcgatggcgtccatctccggagcggcggcggcgccatcttccgctgcgtgccggctgcggctgcgtaggcacatcctgctgcggccctcgcacctccgcctccgcgcgccccactccatcgccgacctctcccgctcctccagctcctctagttccgccccgacccgggcccagccgctgggctccaggccggagaacggcggcggcgtccgcgcggtggagaaggacccgatcaagctgtgggagcgctacgtcgagtggctctaccagcacaaggagctcggcctcttcgtcgacgtcagccggatggggttcacggaggacttcctgcgccagatggagccgcggatgcagcgggccttcgccgccatgcgggagctcgagaagg

SEQ ID NO: 30294 - protein, 128 aa, Zea mays
  misc_feature: Ceres CLONE 1405757-F
  misc_feature: SWISSPROT Homolog: EC 5.3.1.9 Glucose-6-phosphate isomerase
MASISGAAAAPSSAACRLRLRRHILLRPSHLRLRAPHSIADLSRSSSSSSSAPTRAQPLGSRPENGGGVRAVEKDPIKLWERYVEWLYQHKELGLFVDVSRMGFTEDFLRQMEPRMQRAFAAMRELEK

SEQ ID NO: 30295 - DNA, 672 bp, Zea mays
  misc_feature: Ceres CLONE 1405762-F
  misc_feature: Encodes the peptide sequence at SEQ ID NO. 30296
  misc_feature (592)..(592): n is a, c, t, g, unknown, or other
ggagctccccgcggtggcggccgctctagaactagtggatcccccgggctgcaggaattcgcacgagaccattacctagaacatcctaattgaaaacttccaatttttctcccaaataaaaaccagccgcagcgggaggtggcgcgacgcgaacccacccaccctgcgaacccggccgcaaaattctcctctcggattccgccgccgcgaaccgtcccctcgacgaggctgctgcgatagatttttcttaccattcgaatagttgatgagcgagaatacagagcaagaatcttgatggtgcgtgtggtacaacttggttaaggaaagctgactgcttgaagtgaccatgttggaccatcttgctatcattgcgtctgagttaggggacgacgcaacggattttgaggttgatggcatcgacaacctcagcgagaacgatgtcagcgactaggagatcgatgctgacgagctcgcccgacgaatgtggaaggacaaggtcaagctaaagaggatcagggagaggcagcagaagcttgccctgcagcggctggaggctggagaagaccaagacaaagaagatttcagaccaagncctcccggaagaagatgacgagggccccaggacgggatcctcaagtactgctcaagtttggaatggaggtggaaattgcc

SEQ ID NO: 30296 - protein, 34 aa, Zea mays; identical to SEQ ID NO: 21831
  misc_feature: Ceres CLONE 1405762-F

SEQ ID NO: 30297 - DNA, 665 bp, Zea mays
  misc_feature: Ceres CLONE 1405764-F
  misc_feature: Translation starting site: 174
cgcggtggcggccgctctagaactagtggatcccccgggctgcaggaattcgcacgagaccattacctagaacatcctaatcgaaaagactcccgtgctctctctctctctctctctcggatccgaattgccagcgcaccagtcgagctcgcgggaactcgccggcaccggcgatggcctccgccctactggccggacagggcggggcgcgccaccacggctggggggagacgcgcgccccactcgcgcccatacctcccaaccctaaccccagccagccccacccgcgcgccgacgggtccaagtccaagccgcgggcggcagcctcctcgccggcggccggatacgtgacgttccgcccggcgtccctgggcccgcgcgaggcccgcgcgctccgggaccgcctcgcgggagagctcacccaggtgagcgccctcctctcccgcatcgacgcctgtcatgaggaggcgccgccgcccgcggggttccgcggagaggcgcggaagcggtgcgaccacatcctcaccaggatgaacgaggacaatgcgaagcgcggggaatatcgggccagccgcagtggagcgcctcggcctccactactactacgccgtgatcaatggccccttgcatctcgattggggtctggggggacctcgccgacgaga

SEQ ID NO: 30298 - DNA, 633 bp, Zea mays
  misc_feature: Ceres CLONE 1405765-F
  misc_feature: Translation starting site: 297
  misc_feature (390)..(390): n is a, c, t, g, unknown, or other
  misc_feature (607)..(607): n is a, c, t, g, unknown, or other
  misc_feature (617)..(617): n is a, c, t, g, unknown, or other
gctctataactagtggatcccccgggctgcaggaattcgcacgagaccattacctagaacatcctaatcgaaaactacatgccaaatctggaggcaagagaaccgggagagggcgtgttgggttgctcgtcgtgatcccggacggcaatacctgcccttgcctacttgccactgcttgcgtacactgatgtccttgttcaatcccctctagaaagtagaaacattgcttaattggcttggctattgctgttagctccacacaaaagagagaaccggcggcgagctaggagctagccatggacggacacggcgcggtctcaccgtggagcgtgctaggcggggcggcggctgtgctgctcctgtggttggcgtcgcaggtgctggaggggncccttggtgggcgccccggcgcgtgaaccgtgcgcttgagggcgcagggccctgaggggcacccggtaccgcctcctctgcggcgacctcatcgaggagcagcgtctccgcgcggcggccctggcaagcccgtcccccgtggatcggccacacgacttcgtccctcgcgtcgcgcctttccttcaccgcgtcctccaagagcacggcaagctctcgntttacatggnttgggccgaccccaag

SEQ ID NO: 30299 - DNA, 622 bp, Zea mays
  misc_feature: Ceres CLONE 1405766-F
  misc_feature: Encodes the peptide sequence at SEQ ID NO. 30300
gctcttaactagtggatcccccgggctgcaggaattcgcacgagaccattacctagaacatcctaatcgaaaaacgccctccgtgccgtgcccactcctctccccgcagcttcgggcccctgccatgccgtcctcgtcgtcgctgatccatggcatctccatctccgtctccgacgacgacgaggccaccggcaaggtgcgcgtccgcgtccgccgcaagcgctcccgcggccccgcatccgcttcggcgcgccgccgccgcatcctcttccgcgccgcgcgggctgggcgtgccgctcctcctcgccgccctcgccgtgtgcctcctcctctacgagtcctaccgcctcacgccttcccgctcctccacactgcctccgccgtccttcgcggacatcagccgcctctcccgcacgcccgcgccgccgatggcgccaggaagcatgcctgaagtttcttgatcctgagaagcttcaaaatttggaactccagaaattctgaaacaatttgcgaatgaaggagttctgtacagatcaagtctgcccatatcgtcatgatacacacacattacgagaattcccggtcaatttttcacaggataccgaactccctgacgagagaa

SEQ ID NO: 30300 - protein, 108 aa, Zea mays
  misc_feature: Ceres CLONE 1405766-F
MPSSSSLIHGISISVSDDDEATGKVRVRVRRKRSRGPASASARRRRILFRAARAGRAAPPRRPRRVPPPLRVLPPHAFPLLHTASAVLRGHQPPLPHARAADGARKHA

SEQ ID NO: 30301 - DNA, 658 bp, Zea mays
  misc_feature: Ceres CLONE 1405768-F
  misc_feature: Encodes the peptide sequence at SEQ ID NO. 30302
  misc_feature (320)..(320): n is a, c, t, g, unknown, or other
gctctacaactagtggatcccccgggctgcagttaattcgcacgacccattacccataacatcctaatcgaaaagtgacctgggagtgggagggttggtgcctataggatcgtcatggacaccatcgaggagtgcggcgacggaggccgccacctgctgctgggcctcggcaccaggatactcgtcggcgtgccggacaactcccgcggctgctccgagctgctgtcgtgggcgatcggcgccgtcgccaagcccagcgactccgtcgtcgccgtgcacgtcctcggagggagggggaggaagcggaggctgcagaaggncaacgccttcgtcatctacatgctcggcgaattcgtcgaagcttgtgaggccaagcagattaatttggaggccaaggtgatatgcagctcaaacattgggagagccctgacccaagaagctgcactgactgatgggaacatcctcattgttgggagatcaagaaatgcgcaccataggagccattttgagattgcaaactactgcttgatgcatgcttcaaaaaactgctgggggatcgcttgtggaaggaaggggtagcacagaggaacacctccggtgagaccccaggcattttgatggaagcaccatctccctcaagttcaagatgggaccagag

SEQ ID NO: 30302 - protein, 154 aa, Zea mays
  misc_feature: Ceres CLONE 1405768-F
  misc_feature (19)..(149): Pfam Name: Usp Pfam Description: Universal stress protein family
  misc_feature (69)..(69): Xaa is any aa, unknown, or other
MDTIEECGDGGRHLLLGLGTRILVGVPDNSRGCSELLSWAIGAVAKPSDSVVAVHVLGGRGRKRRLQKXNAFVIYMLGEFVEACEAKQINLEAKVICSSNIGRALTQEAALTDGNILIVGRSRNAHHRSHFEIANYCLMHASKNCWGIACGRKG

SEQ ID NO: 30303 - DNA, 668 bp, Zea mays
  misc_feature: Ceres CLONE 1405770-F
  misc_feature (372)..(372): n is a, c, t, g, unknown, or other
  misc_feature (496)..(496): n is a, c, t, g, unknown, or other
  misc_feature (530)..(530): n is a, c, t, g, unknown, or other
  misc_feature (643)..(643): n is a, c, t, g, unknown, or other
tggcggccgctctagaactagtggatcccccgggctgcaggaattcgcacgagaccattacctagaacatcctaatcgaaaaggccagcgtttcaacagtaatctctctgtgcctgcgacgacgactaggtgggttaccgccgtcgcgccgccgccgccgccgccgtcatactacaggtgcgaggccttcatcggtatcttaacaggcgacgaacaccaaccaggtaacttcgtcggtatcttcacttcaccgacggcgacgagcacgaactcgaaccttttttttccccaaaaattagccccctccctgccctgcggaccctgccccagtctgcactctacgatggcggcgcctccggccacggctcccgncggcctcccggtgtctctccggtgccaagtcgtgctggactgctgagcggagctccagctcgtttgccgtctcggcgccttctactgacctccggcaaagtaggagccgcatcctcagcgccgntgccaaggttgccactggcgtgcagagagccgcnactggtggatgatggagcaaaaaggccgtggaagctcagtgatgctcgctttgtcctgaaaaaatgttcaaagggtggaggcccaagtcttttggcgcttcagaacacaaganccgggggaagttgttttcaacacat

SEQ ID NO: 30304 - DNA, 662 bp, Zea mays
  misc_feature: Ceres CLONE 1405774-R
cgattgggtaccgggccccccctcgaggtcgacggtatcgatatttttttttttttttttatttttttttttttttttttttttttttttttttttttttttttaaaaggaaaatcctaactctaattgggttgaaagtatttttttttaagcggagtaattgaaccaagacctttaccctaaaagtttacaattaaatacccatagactagccccgaaaccctaacaatactctaacaaatttccccaaaatcccaaaaaccaagggccaggcaggcccccaccaaaatataaatatttttgaaagggacttctttactggaaaaactgtctttggcgcgagctttggcctgaataaacttgctcaaaactcggatctgaattaaacatgttcaaaactcttgaattaagagtacaccctacacaacccgccaaaacttgtaagtcaaatggcaaatcatctatgaactaaacctaggggggggacattccccctcgaactaaagcttataattgattaatgttgggatacgtatatcatcacaaaatttatttgggctaccattgcttttagaaggcgagctccatttattatttcttacaacccccctgtgggatggattgcatccatgaatttgtaccgtttctctttgaacacaaaa

SEQ ID NO: 30305 - DNA, 637 bp, Zea mays
  misc_feature: Ceres CLONE 1405775-R
cgattgggtaccgggccccccctcgaggtcgacggtatcgataagcttttttttttttttttttagtaacttaacagcatgccattatttggtggtgtccacacatcacataacagcacaaagcacagtcaaagaaccactcgctactattacacaacaggtctcgcaaactcactcactacctaactaaatgtacacattccatcatctgtctggcacggatcagaaccaaactccagccccattcagcggccgatggcggtccttccagaatcaagcatcgagtgccaaacgcgccgatgatcgcatcggctctgacttgcaccttttcagaacaaatggagcataggctgccgcattggtaactggcggcaactccaacttcaccttctgttctgtggtaactggtttgagtgatggtgtcttctggacaactggacatggcatgggcacacctgagttcaccgctgatagatctttgctctcttgtacatcattctcaatggtggtgccttcagcattctccttttccttagtctccactgttccagcagcacaatccttctgttgccactgattgccgttattcttgacctggtaagacttccaatggacgaaatcggtgctgcagacccat

SEQ ID NO: 30306 - DNA, 687 bp, Zea mays
  misc_feature: Ceres CLONE 1405775-F
  misc_feature: Encodes the peptide sequence at SEQ ID NO. 30307
  misc_feature (390)..(390): n is a, c, t, g, unknown, or other
  misc_feature (391)..(391): n is a, c, t, g, unknown, or other
  misc_feature (394)..(394): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (451)..(451): n is a, c, t, g, unknown, or other
  misc_feature (506)..(506): n is a, c, t, g, unknown, or other
  misc_feature (562)..(562): n is a, c, t, g, unknown, or other
  misc_feature (563)..(563): n is a, c, t, g, unknown, or other
  misc_feature (589)..(589): n is a, c, t, g, unknown, or other
  misc_feature (602)..(602): n is a, c, t, g, unknown, or other
  misc_feature (619)..(619): n is a, c, t, g, unknown, or other
  misc_feature (665)..(665): n is a, c, t, g, unknown, or other
  misc_feature (666)..(666): n is a, c, t, g, unknown, or other
  misc_feature (687)..(687): n is a, c, t, g, unknown, or other
tccccgcggtggcggccgctctataactagtggatcccccgggctgcaggaattcgcacgagaccattacctagaacatcctaatcgaaaaagagaagtgactacagcagcacgatggcaagcccgctgctgtgcctggccgccgcggcgctggccgtagccgtcctcgtctccgcgacagaggcgtgacgcgcgactcacccgccgctgccggtgctgccgatcccgtcgctgccgcacctgatagtggctgaggcgcgaggagatcatgtgcgtatccgcttcggcatgaacaccttcacggactccgagtggggcacggggtcggaggacccgtccctgttccgccccgcggggctcaacgccacccagtggatggacgcggcgcgnncgncgnnnncctcgctcgtcatcctcgtcgccaagcaccacgacgggttctgcctctggncgtccgactacacggcccactccgtgcgcgccagcccctggcgcggggcccgcgncgacgttgtttggttgttttgtggcctctccccccgtcctggccactcgctccctnntttgtcctccttgccggtgtggggcncccgcttgggggncccttcccgtttccctntcctcggcgcccctctgcgctcccccctcttcccccctctccctcnnccggctggcgggccccgggcn

SEQ ID NO: 30307 - protein, 133 aa, Zea mays
  misc_feature: Ceres CLONE 1405775-F
  misc_feature: SWISSPROT Homolog: EC 3.2.1.51 Alpha-L-fucosidase
  misc_feature (35)..(35): Xaa is any aa, unknown, or other
  misc_feature (36)..(36): Xaa is any aa, unknown, or other
  misc_feature (37)..(37): Xaa is any aa, unknown, or other
  misc_feature (38)..(38): Xaa is any aa, unknown, or other
  misc_feature (55)..(55): Xaa is any aa, unknown, or other
  misc_feature (73)..(73): Xaa is any aa, unknown, or other
  misc_feature (92)..(92): Xaa is any aa, unknown, or other
  misc_feature (101)..(101): Xaa is any aa, unknown, or other
  misc_feature (105)..(105): Xaa is any aa, unknown, or other
  misc_feature (111)..(111): Xaa is any aa, unknown, or other
  misc_feature (126)..(126): Xaa is any aa, unknown, or other
MNTFTDSEWGTGSEDPSLFRPAGLNATQWMDAARXXXXSLVILVAKHHDGFCLWXSDYTAHSVRASPWRGARXDVVWLFCGLSPRPGHSLPXLSSLPVWGXRLGXPSRFPXLGAPLRSPLFPPLPXPAGGPRA

SEQ ID NO: 30308 - DNA, 781 bp, Zea mays
  misc_feature: Ceres CLONE 1405776-F
  misc_feature: Encodes the peptide sequence at SEQ ID NO. 30309
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (36)..(36): n is a, c, t, g, unknown, or other
  misc_feature (38)..(38): n is a, c, t, g, unknown, or other
aaaaccccacnnnncnnncccctcccttcctacccnanggatgctgaggaaacaggtggagctccccgcggtggcggccgctctataactagtggatcccccgggctgcaggaattcgcacgagaccattacctagaacatcctaaaaaaaactctcgtctctatcgccgcatcgcttctctgccggagctccaacaacctcgcctcgcgcagcactccgctgaccctccctgactccctccctgccgctgggatggccgggaaacgagttacgggccgcgatgggcaagacgagggcggcgccaaggtcgggctcccggcgatggacctctccctcgcgttcccgcaggccacacctgcctccattttcccgccgtccgcttcggattattaccagtctgatgatttgctgaccagtgaagagcgctctatcaggatgaaagtcaggggtattatggaaaaagaattgctcccattatgtcagcggactgggaaaagggaaagtttcaatttaatgccattcctaaattgcaaagccttggtggttggtgggcggaaaaaaaaggggggtatgggggggccaaggactttccatttaaaggcagggggtggttaccaattggccaaaatttggccgcgggaagaagggaaggtgggtgccccctatttaaacgtgggggcccccccctccccttgggggaggggggccacaaagtccccctttgggggaatcccaagggtcccgaaaaaaaaacaaaaaaactcggccccccccctcggc

SEQ ID NO: 30309 - protein, 176 aa, Zea mays
  misc_feature: Ceres CLONE 1405776-F
  misc_feature: SWISSPROT Homolog: EC 1.3.3.6 Acyl-CoA oxidase
MAGKRVTGRDGQDEGGAKVGLPAMDLSLAFPQATPASIFPPSASDYYQSDDLLTSEERSIRMKVRGIMEKELLPLCQRTGKRESFNLMPFLNCKALVVGGRKKKGGMGGPRTFHLKAGGGYQLAKIWPREEGKVGAPYLNVGAPPSPWGRGATKSPFGGIPRVPKKKQKNSAPPLG

SEQ ID NO: 30310 - DNA, 747 bp, Zea mays
  misc_feature: Ceres CLONE 1405777-F
  misc_feature: Encodes the peptide sequence at SEQ ID NO. 30311
  misc_feature (11)..(11): n is a, c, t, g, unknown, or other
  misc_feature (13)..(13): n is a, c, t, g, unknown, or other
  misc_feature (14)..(14): n is a, c, t, g, unknown, or other
gtgccctcccntnnttctttttcctctttccccctcccatctcccccaaccaaagttggagctcaccgcggtggcggccgctctatactagtggatcccccgggctgcaggaattcgcacgagaccattacctagaacatcctaatcgaaaaaccaaaatgtaagaaaacgcacgccccggcgctggccgctagtcaccccaaagctccgcctccgcaccttctctcactcgcccagccgcggctatggcggccaccacatccacggcggcggcggcagtatccttctccctcccctcaccaccgcactgccgcggggcccggcgccgccgcgcgccttccctcctccgtgccgcctccaccgccgcgcccccctcccccgacctctccatccagctctcgccccgcgcgtccccgcccgcgtctaccaacggcgccgccaccgcgcttggaccccccgtgtccgcctcctttgcccgtgaccgcgccgaggacctgcaggccgaggcccgcgcgatggcccgcgccgctggcgccacagtctacagtcccgagctcctcgccgcccgctacggctcccgccccttcaaggtggggctccgggacaggggaggtgctgcccaagttggccgccgttccgggtcggaaggtcctactgggacgaagcggaggaaggggaagccgtcttcgggaaaaaggagtgggtcgcccaaggccgggtggtagcttcccccaacactctatcccc

SEQ ID NO: 30311 - protein, 69 aa, Zea mays
  misc_feature: Ceres CLONE 1405777-F
MARAAGATVYSPELLAARYGSRPFKVGLRDRGGAAQVGRRSGSEGPTGTKRRKGKPSSGKRSGSPKAGW

SEQ ID NO: 30312 - DNA, 620 bp, Zea mays
  misc_feature: Ceres CLONE 1405781-F
  misc_feature: Encodes the peptide sequence at SEQ ID NO. 30313
  misc_feature (296)..(296): n is a, c, t, g, unknown, or other
tccccgcggtggcggccgctctataactagtggatcccccgggctgcaggaattcgcacgagaccattacctagaacatcctaatcgaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcngtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacacctccccgggctcgcccgcgcagcgcttcgtgtcggaggacggcgtcatcaactcgcgcccgcgggtgttgggcggcggcagctgcatccaaggccggcttctacacgcgggccaacgaagactacttgcgggcggtcgggtggtacctgggccccgccgggtgcggagacccgctgcttga

SEQ ID NO: 30313 - protein, 70 aa, Zea mays
  misc_feature: Ceres CLONE 1405781-F
MARFADTLSDTSPGSPAQRFVSEDGVINSRPRVLGGGSCIQGRLLHAGQRRLLAGGRVVPGPRRVRRPAA

SEQ ID NO: 30314 - DNA, 706 bp, Zea mays
  misc_feature: Ceres CLONE 1405782-F
  misc_feature: Encodes the peptide sequence at SEQ ID NO. 30315
cgcggtggcggccgctctagaactagtggatcccccgggctgcaggaattcgcacgagaccattacctagaacatcctaatccaaaagttggtgacaccataaccactcctgttcgtcgtgcacccacgcgggcgaacagtgaaaggcatcgtctcgacgtctcgtgaccgctggactcgccgccgccccaggctagctcgatgattgtgtgcgctcaagccgctcgcgtagccgctgcaggcatgcgctcgcccgccgtctcgcgccggtcgtcgcctccccccctcgttctgcgcccctgacacctcctcagatctcacccgcgtcgtcgagagcccaggccagtctcagtctgactacgccccagcaccacgctcggttgacgtcgcctcgtccctgtcggcgggcgcgagctcgcatctcgattgatggcccccggccggggccgtctgggccccgaccaccgtccggttgttaacaagagcgggtttccccttgggcttcgaattgggggcccccggagttaaaaaccccccagattttaaaaccttcctaggccgggtccccccgggacctgtaaaggaatcccccccctctttacaaaattggcccccccgaggaaaaaaacaaaaattttccgctcccgcgccgggggggatcctgttttttcccggggagggtccttctcctataggtaccaccacc

SEQ ID NO: 30315 - protein, 32 aa, Zea mays
  misc_feature: Ceres CLONE 1405782-F
MAPGRGRLGPDHRPVVNKSGFPLGLRIGGPRS

SEQ ID NO: 30316 - DNA, 797 bp, Zea mays
  misc_feature: Ceres CLONE 1405787-F
  misc_feature (169)..(169): n is a, c, t, g, unknown, or other
  misc_feature (170)..(170): n is a, c, t, g, unknown, or other
  misc_feature (265)..(265): n is a, c, t, g, unknown, or other
  misc_feature (284)..(284): n is a, c, t, g, unknown, or other
  misc_feature (395)..(395): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
caaagctggagctccccgcggtggcggccgctctagaactagtggatcccccgggctgcaggaattcgcacgagaccattacctagaacatcctaatcgaaaaatcttttcctttcccctcctccctcctcggctcgtctctgttcccctttccctcctggcgcacccnngtcttctcctccccgcgtcaaaccccagcacaaaaagcaaccgcccgccgcctcctcgttcctctcccgaatcagccgtcgcggtgcctaatccnggcgatcccccctccgatnccgcggtgcccgccgcagaggcggcgccctcggggctcccccgatgtatagcaactttcaggagcaaggcgatcgagtacgtcaggcaggcgggtccaggaggacattgcngggaactacgtacaggggtttccttttctaaatggaagggggtcggagtacttcaaaacccacctcagggtcaaaaaaaaaccccaaaaatcagggggggcccttcccgccaggttttcccgaaaaacctcccccccgggccaaaggaaaaccggggggcccctctaaaggggggggggagaagggccttgggaccaaaagggggggaaaaaaattttggtccccccgcccccccaaaaaaaaagggaaaagggcggggacaaagggacccagggggggttttctcccccacaacccccggtgtgagggggggtgtttactcccccccctcctcccgggagaaaccccattatttgggggnnnttttttgcgctctcagaagaaccaaaaagttttgtggga

SEQ ID NO: 30317 - DNA, 769 bp, Zea mays
  misc_feature: Ceres CLONE 1405788-F
  misc_feature: Encodes the peptide sequence at SEQ ID NO. 30318
  misc_feature (556)..(556): n is a, c, t, g, unknown, or other
  misc_feature (562)..(562): n is a, c, t, g, unknown, or other
  misc_feature (637)..(637): n is a, c, t, g, unknown, or other
  misc_feature (662)..(662): n is a, c, t, g, unknown, or other
  misc_feature (728)..(728): n is a, c, t, g, unknown, or other
  misc_feature (729)..(729): n is a, c, t, g, unknown, or other
ctggagctccccgcggtggcggccgctctagaactagtggatcccccgggctgcaggaattcgcacgagaccattacctagaacatcctaatcgaaaagccgcttccaaatcccaataataccatcgcgtaaatccagatatcagggcagctggaactgaaggtggcgggagccgagtgatccggcggtgagctgagcggggcgggatggcggcggagcaggggcggtcgctggcggagacgcccacctggtccgtggcaaccgtcaccacgctcatggtcgctgcctgcttcctcgtcgagcgctccctctcgcgcttcgccaagtggctgcgcaagaccaagcggaaggccatgctcgccgcgctcgagaagatccgcgaagagctgatgctgctcggagtcatctcgctgctgctcagccagacggcgcgcttcatatcggagatctgcgtgccgtcctcgctcttcaccagccgcttctacatctgctccgagagcgactaccaggacctgctgcgcaacacggacgccaaccagacggcgctcgacagaancatggntcggtggcaacggctgcacgtccttgtggcgagggcatggaacctttttgtttcgtacgagggccttgagcagcntgcaccggtttctcttcatcctggnatcactcatgggggtggacgttttggtaaaaaaaagggggtcctgtccatgatcagaatctaaaannggggggaggaagtggaaaaccctaagcaggtccaattggg

SEQ ID NO: 30318 - protein, 172 aa, Zea mays
  misc_feature: Ceres CLONE 1405788-F
  misc_feature (4)..(169): Pfam Name: Mlo Pfam Description: Mlo family
  misc_feature (117)..(117): Xaa is any aa, unknown, or other
  misc_feature (119)..(119): Xaa is any aa, unknown, or other
  misc_feature (144)..(144): Xaa is any aa, unknown, or other
MAAEQGRSLAETPTWSVATVTTLMVAACFLVERSLSRFAKWLRKTKRKAMLAALEKIREELMLLGVISLLLSQTARFISEICVPSSLFTSRFYICSESDYQDLLRNTDANQTALDRXMXRWQRLHVLVARAWNLFVSYEGLEQXAPVSLHPGITHGGGRFGKKKGVLSMIRI

SEQ ID NO: 30319 - DNA, 652 bp, Zea mays
  misc_feature: Ceres CLONE 1405789-F
aaagctggagctccccgcggtggcggccgctctagaactagtggatcccccgggctgcaggaattcgcacgagaccattacctagaacatcctaatcgaaaagattttcttcacccgtccacctcgtcttgcgctcctctgtctcggcgacgactgtgctaccgccgccgccgccgcaagacttcgtcgggcactttgccggcgacgatttcccaccagcccaacaggatcagaggaggtgatggcgaggagtgacagctgcctggcgcgcgtgggtgccggaattgctatcggtggcgcggtcggcggagccgtcggtaaccttcgtccctaaacccctaaacactaggcttgcagcatcaatccgtccgtgcgagccgcttcacccgtcggtgtttttttttttggttggaagtagattagtgtgcgatttcaggaatcttctcgagctagctagtagctacatccctggtttgtgtggttagctagcggcagatgtaataactaggtggcttttgttaggagttactagtgcttaggtagcatcatctggaggtggaagatatcgatgctcgagttggagtttgttggcccccaattgcttgtgctctaggggctgttgctgattcgggctgcccgggttttggtcact

SEQ ID NO: 30320 - DNA, 746 bp, Zea mays
  misc_feature: Ceres CLONE 1405790-F
  misc_feature: Encodes the peptide sequence at SEQ ID NO. 30321
  misc_feature (584)..(584): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
gctggagctccccgcggtggcggccgctctagaactagtggatcccccgggctgcaggaattcgcacgagaccattacctagaacatcctaatcaaaaaatatcccttcctcgtatatcctttcctgagtaggagagagagttgagttaggagttgttgtgctgatcatctcggtcgaccgagagatggaccaccacttcactgagatagaggggaagatggcgcacgagccactggcacacagctccaccttctccgatgagacgaaagacaaaatggagcacgattcactggtgtacagtccacgcagcatcgcgagggccacaaccaccggcatccctgtcggcgatcaaggcgtggccgtgctacgtgggccgcttatcgtgggtgcagggccggcgggtctggcatgcgcggcgttgctcaccatgttatacattccctacgtgctcctagagcgcgacgtgtgcgtagcctcaatgtggcaccgccgcacgtacccgcagggttgtgtctgcacctacccaagcgctactgtgagctcccgctcatgcacttcccacgcacctaccccacatatccancccggcagcagttccttgtctacctcaatgagtacatgcgcgcatttggcatccgcccattttcannncctcgaggttgtcgctgccgagtacacggggaaatacacgggtgtggtcggcaccaaagatgtcatccccactggcactctcaacggcaaaagg

SEQ ID NO: 30321 - protein, 187 aa, Zea mays
  misc_feature: Ceres CLONE 1405790-F
  misc_feature (133)..(133): Xaa is any aa, unknown, or other
  misc_feature (155)..(155): Xaa is any aa, unknown, or other
  misc_feature (156)..(156): Xaa is any aa, unknown, or other
MDHHFTEIEGKMAHEPLAHSSTFSDETKDKMEHDSLVYSPRSIARATTTGIPVGDQGVAVLRGPLIVGAGPAGLACAALLTMLYIPYVLLERDVCVASMWHRRTYPQGCVCTYPSATVSSRSCTSHAPTPHIXPGSSSLSTSMSTCAHLASAHFXXLEVVAAEYTGKYTGVVGTKDVIPTGTLNGKR

SEQ ID NO: 30322 - DNA, 675 bp, Zea mays
  misc_feature: Ceres CLONE 1405792-F
  misc_feature: Encodes the peptide sequence at SEQ ID NO. 30323
aaagctggagctccaccgcggtggcggccgctctagaactagtggatcccccgggctgcaggaattcgcacgagaccattacctagaacatcctaatcgaaaaattccgcgccgcatctgggaaggtctcgtcttgctcgctcccgtccgtcgccgcaccctgcgtcgtcgccatggccacgacgcagggtgcggcggcggccggagtgttcgtctcttgctccgccgggaactccggcccatccggatccaccgtctcaaactccgctccgtgggtcgccaccgtcggcgccgggacactggaccgcgacttcccggcatacgtgatgctccccacgggtgcgcgcctggccggcgtgcccctctacgcggggccttctccctccccacgccccgccatgctcccgctcctctacggcagcgggcgtgacaacgccagcaagctctgcctctccgggacgctcgacccggccgccgtgcgcggaaaaatagttgtgtgcgaccgcggcgtcaacgcgcgccgtggagaagggcgccgaccatgaaggcgggcggcgacgccccaatgatactggcgaaaaacgcagccaagggaaaagaaattcgttgagggaaaaacaactgctccccgacgggggagatgaagaccctacgattgggctaataaaaaacgcg

SEQ ID NO: 30323 - protein, 123 aa, Zea mays
  misc_feature: Ceres CLONE 1405792-F
  misc_feature: SWISSPROT Homolog: EC 3.4.21.25 Cucumisin
MATTQGAAAAGVFVSCSAGNSGPSGSTVSNSAPWVATVGAGTLDRDFPAYVMLPTGARLAGVPLYAGPSPSPRPAMLPLLYGSGRDNASKLCLSGTLDPAAVRGKIVVCDRGVNARRGEGRRP

SEQ ID NO: 30324 - DNA, 677 bp, Zea mays
  misc_feature: Ceres CLONE 1405793-F
  misc_feature: Encodes the peptide sequence at SEQ ID NO. 30325
  misc_feature (677)..(677): n is a, c, t, g, unknown, or other
aagctggagctccccgcggtggcggccgctctagaactagtggatcccccgggctgcaggaattcgcacgagaccattacctagaacatcctaatcgaaaaagttaagtctcgttcactgcctgtgctgctcagtgctctgctcacacatcctcgtcgccaatggcggctcccgtccgggccatcccgctcccgtcgcccgtcctgtacccccgcatgtccttatggggccgcagcagctgcagccggcgacgtgcccccggagttcgcgcagcagtggaggcggcggagggtgcttcgcgggcgacggagcccgtggaggtggtcggcgtaggcagccggaaggacgccgtcatcgacttctgcctgggctcacgcacgctgtcctccacccccatccgcttctggacagtacatgtgatggataattctaaagtttcagtaatacaaaaaggtcatggaactgatgcaggggtcaaagacttggaacctcccttatttcttcatccctgcccacctgcggttattcttggttccagtggaggaaaggatgctgatcatattacttgcaagggaggtaccttaggggtggccaaacctggtggggaatcgggctgcaacaaaatttttgaaaccccttctgcttctaggggaaaaaaaaaggcaaaataaagggcn

SEQ ID NO: 30325 - protein, 169 aa, Zea mays
  misc_feature: Ceres CLONE 1405793-F
MAAPVRAIPLPSPVLYPRMSLWGRSSCSRRRAPGVRAAVEAAEGASRATEPVEVVGVGSRKDAVIDFCLGSRTLSSTPIRFWTVHVMDNSKVSVIQKGHGTDAGVKDLEPPLFLHPCPPAVILGSSGGKDADHITCKGGTLGVAKPGGESGCNKIFETPSASRGKKKAK

SEQ ID NO: 30326 - DNA, 672 bp, Zea mays
  misc_feature: Ceres CLONE 1405794-F
  misc_feature: Encodes the peptide sequence at SEQ ID NO. 30327
acagctggagctccccgcggtggcggccgctctagactagtggatcccccgggctgcaggaattcgcacgagaccattacctagaacatcctaatcgaaaagtttcttggatagtccgtagccgcttgccctgttcgcatcttcgcgcgtggcgcacaccgctccagctctccttcgacgggcacggccgagccgccttcgtcttggccgcagcggtgcgcgctctccatggcgtcctaattagcctagccgcaacgccgcgcccgtgcctgcggcatggatgaaccccttcttggcaatggtcttaagaccagcgggaaaagagagagcctggtagtggccgaggtcagaaaacagatgtaccttgctcggccactcatgggtggatggatcctacagaacattgtccaaatgatatctatcatgtttggccggcaccttggggagcttgccctctccagtgcctccatcgccacctcctttggagggggttactggcttcagcttattgtctgggcatggcaaacaacttggacacactgggtggggcaatcgttccggggaaagcaataacattcttcttgggcatctacaaaggaaaggggaaaccctggggctccctccaaccagccctgggggttgcgaataatcggggcaaaccctgggaagaac

SEQ ID NO: 30327 - protein, 98 aa, Zea mays
  misc_feature: Ceres CLONE 1405794-F
MDEPLLGNGLKTSGKRESLVVAEVRKQMYLARPLMGGWILQNIVQMISIMFGRHLGELALSSASIATSFGGGYWLQLIVWAWQTTWTHWVGQSFRGKQ

SEQ ID NO: 30328 - DNA, 652 bp, Zea mays
  misc_feature: Ceres CLONE 1405805-F
  misc_feature: Encodes the peptide sequence at SEQ ID NO. 30329
  misc_feature (397)..(397): n is a, c, t, g, unknown, or other
  misc_feature (518)..(518): n is a, c, t, g, unknown, or other
tggagctccccgcggtggcggccgctctagaactagtggatcccccgggctgcaggaattcgcacgagaccattacctagaacatcctaatcaaaaaacatatccccactctagccaagtagtcagtcctctccaatctccactctcctctcgcaccaccaaaaaaccggtcccaccgttcgccatgagctccgaagccggatgctcagctccagccgccgccgcgccggatggggcgggtggcggcagggtggagatcgacacgtccgcgccgttcgagtccgtgcgggaggccgtcgaccgtttcggtggcagcgccgcctggagctccgacctcgtcaggcgcatgttcgcgccctccaagaaaacatgaacactctgaccaagctgcagaggncccatcacgcgaggagcaagctgcacagctagagaacgagctggcagttaaggaagggagactcttgatgtgctcaaggaggtggaggcacccagaagatcctagcagacctgaaactgangaaaccggagggagcccctgaaacctccctgaaaaaggtgttgaacagttttctgagggggagttcaacggcagaacctgaaacccaactttgagggggggggggaaatgaaagggaaagaaaaactcttttcg

SEQ ID NO: 30329 - protein, 62 aa, Zea mays
  misc_feature: Ceres CLONE 1405805-F
MSSEAGCSAPAAAAPDGAGGGRVEIDTSAPFESVREAVDRFGGSAAWSSDLVRRMFAPSKKT

SEQ ID NO: 30330 - DNA, 682 bp, Zea mays
  misc_feature: Ceres CLONE 1405806-F
  misc_feature: Encodes the peptide sequence at SEQ ID NO. 30331
  misc_feature (395)..(395): n is a, c, t, g, unknown, or other
  misc_feature (472)..(472): n is a, c, t, g, unknown, or other
gctccccgcggtggcgaccgctctagaactagtggatcccccgggctgcaggaattcgcacgagaccattacctagaacatcctaatcaaaactttctgctgcccagccgccgtccgtccgcgcttcactatccttcattccctcccctgtcagcgacgactgggtaggctaccgccgccgccctacgctaggtgcccatctcttcgccggcgaagagcgcccaccaagctccggccaagggcgtgatggcggctgtaggcagcttgaagccggggatggagactcttcatgtgcaggactacaaggacgcgcctccggccaaggccgcggtagagagcctccagccggcgatggagagtctgcatgtgcaggattacaaggacgcgcctccggncaagggcgtggccgccgccgccgtagggagcttgcagccgggggcggagaacctgcaggtgcaggactacaaggacnggtacatgtattatggtgcttacccggcttatgctatgaagcctatgttggcttggggggagtacccatacctgagccatgatggagcacagacaccaactgctggtacctatgctgacatgtactatggctagcccccaatatgggtggtgcacccatggggcatggatgcccaaatttattgggtcctaaaaattacaggacccagcc

SEQ ID NO: 30331 - protein, 119 aa, Zea mays
  misc_feature: Ceres CLONE 1405806-F
  misc_feature (50)..(50): Xaa is any aa, unknown, or other
  misc_feature (76)..(76): Xaa is any aa, unknown, or other
MAAVGSLKPGMETLHVQDYKDAPPAKAAVESLQPAMESLHVQDYKDAPPXKGVAAAAVGSLQPGAENLQVQDYKDXYMYYGAYPAYAMKPMLAWGEYPYLSHDGAQTPTAGTYADMYYG

SEQ ID NO: 30332 - DNA, 721 bp, Zea mays
  misc_feature: Ceres CLONE 1405808-F
  misc_feature (313)..(313): n is a, c, t, g, unknown, or other
  misc_feature (317)..(317): n is a, c, t, g, unknown, or other
  misc_feature (348)..(348): n is a, c, t, g, unknown, or other
  misc_feature (390)..(390): n is a, c, t, g, unknown, or other
  misc_feature (637)..(637): n is a, c, t, g, unknown, or other
  misc_feature (638)..(638): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
tccccgcggtggcggccgctctagaactagtggatcccccgggctgcaggaattcgcacgagaccattacctagaacatcctaattgaaaacttccaatttttctcccaaataaaaaccagccgcagcgggaggtggcgcgacgcgaacccacccaccctgcgaacccggccgcaaaattctcctctcggattccgccgccgcgaaccgtcccctcgacgaggctgctgcgatagatttttcttaccattcgaatagttgatgagcgagaatacagagcaagaatcttgatggtgcgtgtggtacaacttggntaangaaagctgactgcttgaaagtgacatggtgnaccatcttgctatcattgcgtctgaggtaggggacgacgcancggattttggagttggaggcattcaccaacctcaggaaaacgatgcccgggactaggaaatcaatgctgaccacctccccccaaaaaagggaaaaggacaaggcccagctaaaggggttcggggaaaggccaaaaaaattttccccttggcgggggggggtgggaaaaaccacaaaaaaaaaattttcacccccccccccccaaaaaaaaaggaggggcccccgaggggcccccccaaaaactccannggcgggggggggggcccccccccccctttttttttnnntttttttttcctagaaaaaaacccctcgggggggggggccgcaaa

SEQ ID NO: 30333 - DNA, 611 bp, Zea mays
  misc_feature: Ceres CLONE 1405810-F
  misc_feature: Encodes the peptide sequence at SEQ ID NO. 30334
  misc_feature (371)..(371): n is a, c, t, g, unknown, or other
  misc_feature (373)..(373): n is a, c, t, g, unknown, or other
  misc_feature (380)..(380): n is a, c, t, g, unknown, or other
  misc_feature (381)..(381): n is a, c, t, g, unknown, or other
  misc_feature (407)..(407): n is a, c, t, g, unknown, or other
tccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacgggcttcgtgtggctccggcagcgccgcaaggtggacactacttcgncnaggccgnncgccacgtgtcctagggcgccgaggntgttcggcgtgggccgacaagggcggctcaagagaatacgggcgtcaaggcaaagaaattgctctggggtccccctccaggaaactgggtcgaagaccccccaggggtaagtctcctgggagggccttgggggccggccccgaatttccccggggggcccttaaggccaaagaacccggcccccccaaaacgggggtggtttcc

SEQ ID NO: 30334 - protein, 117 aa, Zea mays
  misc_feature: Ceres CLONE 1405810-F
  misc_feature (70)..(70): Xaa is any aa, unknown, or other
  misc_feature (73)..(73): Xaa is any aa, unknown, or other
  misc_feature (82)..(82): Xaa is any aa, unknown, or other
MTLTIPDEVRAKAEVYVGDAAGQEKTRLLLQETGLPSGLLPLRDIIECGYVEETGFVWLRQRRKVDTTSXRPXATCPRAPRXFGVGRQGRLKRIRASRQRNCSGVPLQETGSKTPQG

SEQ ID NO: 30335 - DNA, 675 bp, Zea mays
  misc_feature: Ceres CLONE 1405812-F
  misc_feature: Encodes the peptide sequence at SEQ ID NO. 30336
  misc_feature (424)..(424): n is a, c, t, g, unknown, or other
  misc_feature (634)..(634): n is a, c, t, g, unknown, or other
tccccgcggtggcggccgctctagaactagtggatcccccgggctgcaggaattcgcacgagaccattacctagaacatcctaatggaaaaactctcgcttccttccctccctccctcccacgcaaatggtggccgctcgcctccgcctcgcgctgctactctccgtctgcctctgctccgcgtgggcgcgcccacgcctcgagacggccatccgcctgccgtcgcagcgcgcggcggcggccgacgaaacggacgacggcgccgtcgggacccgctgggctgtgctcatcgcaggctccagcggctactacaactaccgccaccaggcggacatctgccatgcataccagatcatgaagaagggcggactcaaggatgagaacatcattgtcttcatgtacgatgacatcgcgcatagcccgnagaatccgaggggctggtgtcatcatcaccatccccaggggtggcgacgtctattgctggggtgccaaaggattacactgggcgagatgtcacgtcgacattttcttcgctgttctgcttggcacaaactgctccccagggtgggaagcggcaaggttggggacaggggcccccaaggacttatcttggtttctacggggacctgggggncccgggtgcctttaaaaggccaactatccctaccttaaggg

SEQ ID NO: 30336 - protein, 181 aa, Zea mays
  misc_feature: Ceres CLONE 1405812-F
  misc_feature (50)..(180): Pfam Name: Peptidase_C13 Pfam Description: Peptidase C13 family
  misc_feature: SWISSPROT Homolog: EC 3.4.22.34 Legumain
  misc_feature (100)..(100): Xaa is any aa, unknown, or other
  misc_feature (170)..(170): Xaa is any aa, unknown, or other
MVAARLRLALLLSVCLCSAWARPRLETAIRLPSQRAAAADETDDGAVGTRWAVLIAGSSGYYNYRHQADICHAYQIMKKGGLKDENIIVFMYDDIAHSPXNPRGWCHHHHPQGWRRLLLGCQRITLGEMSRRHFLRCSAWHKLLPRVGSGKVGDRGPQGLILVSTGTWGXRVPLKGQLSLP

SEQ ID NO: 30337 - DNA, 674 bp, Zea mays
  misc_feature: Ceres CLONE 1405814-F
  misc_feature: Encodes the peptide sequence at SEQ ID NO. 30338
tggagctccccgcggtggcggccgctctagaactagtggatcccccgggctgcaggaattcgcacgagaccattacctagaacatcctaaaaaaaaccttaatcctatactttcatcgggcgcggcgtgccccctcgcctccaaggctccaacgcatcaatcaatagagcgagcgcgctgtggcatggagcacaaggatgggggcacagcttctgctggtggtctgcccgccggaagcagcttgtgctcgggctcgccgttgctcgacgcgccgatcctccgccgcctctacgccgggcaaatccttgccagatggggcgcgagacatcctctctcgtggtgctcggtcccgtggtggggacgctcgttggaaggccacataccttcaggttttgggcatctggctgctgtcgcaaagatatccttgattgtcgctggaacctcggtgacaccctgctcatgtatgccaacctgagagccacaagcttcccggcattcatgggcgctggtcgccgttaccaacgtctccggcgctctagctgccctctcagctctcgccgcacatactgatcagaggaaatgggggggggtggtgatctcgagcggcatcctccgtcgggggcggacggattaaacctcctcgggggcccggggaatacaacctggctggctcg

SEQ ID NO: 30338 - protein, 85 aa, Zea mays
  misc_feature: Ceres CLONE 1405814-F
MGRETSSLVVLGPVVGTLVGRPHTFRFWASGCCRKDILDCRWNLGDTLLMYANLRATSFPAFMGAGRRYQRLRRSSCPLSSRRTY

SEQ ID NO: 30339 - DNA, 653 bp, Zea mays
  misc_feature: Ceres CLONE 1405815-F
  misc_feature: Encodes the peptide sequence at SEQ ID NO. 30340
aaagctggagctccccgcggtggcggccgctctagaactagtggatcccccgggctgcaggaattcgcacgagaccattacctagaacatcctaatcgaaaactccttcccctccctctttgcacgacaccaaaagaaaccgaagaccatcgaagcgctccgtccaccctaccctacgccgagtgctcctcccctacgcctcccagcccagaggtaaaacctaaccctagatgggcgccgtcacctctacggccgcgctgcgctttgcctttttcccgacgagcccgccgtcatacgggctcgagcaaccggagccgcttccggccgctgccacacccgagcctccggacacagacacatcgaagccgccgcctccggtcgcggccacatgcgaggcgccgcctcaggtcccggccgcagctaagtagccttgaaatcaggatgataaggaagtagcaatgccgatggagataactgatgccccatgcagggttaacgtggaggctaggagtggtgttcataaaccgccttgcggaggagctcgctgatggactggcgcctagtttggggccatacttgacggtgaatcacttcctagacaacatccgcctgacctcaagcagtatgttaccaagctcttctgaaaaagctca

SEQ ID NO: 30340 - protein, 65 aa, Zea mays
  misc_feature: Ceres CLONE 1405815-F
MGAVTSTAALRFAFFPTSPPSYGLEQPEPLPAAATPEPPDTDTSKPPPPVAATCEAPPQVPAAAK

SEQ ID NO: 30341 - DNA, 653 bp, Zea mays
  misc_feature: Ceres CLONE 1405816-F
  misc_feature (182)..(182): n is a, c, t, g, unknown, or other
  misc_feature (233)..(233): n is a, c, t, g, unknown, or other
  misc_feature (270)..(270): n is a, c, t, g, unknown, or other
  misc_feature (274)..(274): n is a, c, t, g, unknown, or other
  misc_feature (275)..(275): n is a, c, t, g, unknown, or other
  misc_feature (334)..(334): n is a, c, t, g, unknown, or other
  misc_feature (496)..(496): n is a, c, t, g, unknown, or other
  misc_feature (504)..(504): n is a, c, t, g, unknown, or other
tccccgcggtggcggccgctctagaactagtggatcccccgggctgcaggaattcgcacgagaccattacctagaacatcctaatcgaaaaaaacctgggcgtattcctctctctttcctcatcctcatccgagtggctctctccttgtgctgtggcggcggcggcgcccggctctgctcgnacggactccaccgaaggcgctcggctcccctcgggctgcacctgcgacggnccggcctctgactggcacgaacgtgcccgcccccccntcgnnattccacagggttggccggttccccagaatcccccgcgccactccggacggcctctagnagttccgtccggggggtccggccaagttgctaaattcccctcgaacgtgtctgcaagaacggcccctggtgctggggttcccccaattcctccggcctccgtgggaacaaaaaaattgtgggggggaggggaccccacaagatgttggggggggtttgttgncccccccnttaaaaaaaccccaggaattgtgggggaaaaaaacaacctttaaaaaattaggggggcgggggtttttttttttgtaaaaaaatggcccaacccgcctttttctaacaaaaaaaatgggagaaatatattttttttttttttgaaaact

SEQ ID NO: 30342 - DNA, 816 bp, Zea mays
  misc_feature: Ceres CLONE 1405823-F
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (48)..(48): n is a, c, t, g, unknown, or other
attccccccccccnncnnncgccccccgttgtgtgataggaactcctncacagtggtgctccccgcggtggcggccgctctagaatagtggatcccccgggctgcaggaattcgcacgagaccattacctagaacatcctaatcgaaaaagtttcagaccccgtgtggattagtcgctgtcacgatcgaggcggggcgccaattgcggtggccaccacctccaatccactccccgcggtggcctcgccgagctgttcttgctccgtcctccctccaactccaagatttgtttcgcacccgattcctgagcttccgcggcgcttcttgctgaaagaaagctccgagtccttcagttctggatcgatagagaggcgtttcctttgggggctctgaggttcagctctcgctcttgatttgcctcatcgacgcataagtggggctgcaggcttaaaagctggaaaggaataatttgactaaagaaaatgggggcagtggttgatataaaagcttccccgcccgggactttctggcacgggaagccccccaacgggctttatggctatttccaaaccggtccaagccccgcggacaaaccccccttccgaggttaccaaccccctcctcaacaatccgggcctgcaggtgtgagcaaacacgcccgcgccgggccacaaatacccccctcggaatattccacaccctcgtggcaccggggggcctggggccctcccacgcaccctcggcggagggactgaggatctacttgtaaaaaacaacataaaacgaatgcacattcaccgcccgcgctgcaactcg

SEQ ID NO: 30343 - DNA, 653 bp, Zea mays
  misc_feature: Ceres CLONE 1405824-F
  misc_feature: Encodes the peptide sequence at SEQ ID NO. 30344
  misc_feature (360)..(360): n is a, c, t, g, unknown, or other
  misc_feature (436)..(436): n is a, c, t, g, unknown, or other
  misc_feature (541)..(541): n is a, c, t, g, unknown, or other
  misc_feature (581)..(581): n is a, c, t, g, unknown, or other
  misc_feature (582)..(582): n is a, c, t, g, unknown, or other
cgcggtggcggccgctctagaactagtggatcccccgggctgcaggaattcgcacgagaccattacctagaacatcctaatcgaaaagtccgaaagtgtgtggagaacctgcccgattcctcccgccgcctccgacctcaccgtcggcgggctcagcttgttcctggggtctgatcagccatgttcaagaaacctgttgatgtgaaaaccatacagcgcttgtctggggcagacaaaaagaagctaagaagaactgccaagggaaggtttccacaggcttctgatgctgaccttgatgccattcttcctcccaaggctgagataacagttgctaagtacccgaaccatgttcttgtatantggcatagagggagagttcccaatgattttcaacactgacgcaagaggtcatgaactgtttcctacagtttatgcngctttggaaggtcccccatctgttgccagctttacgcttagaggtggtgaggtttcacgtttcgtgattggtgcgctgatctgatgtttcctgtatcagataccnttccagaaggtttccatctttttgaagctgccaacatggnncagtaaaagttctggtacctgctgaaattggggttggagccaactttgagtatactggagctttgaaggag

SEQ ID NO: 30344 - protein, 72 aa, Zea mays
  misc_feature: Ceres CLONE 1405824-F
  misc_feature (60)..(60): Xaa is any aa, unknown, or other
MFKKPVDVKTIQRLSGADKKKLRRTAKGRFPQASDADLDAILPPKAEITVAKYPNHVLVXWHRGRVPNDFQH

SEQ ID NO: 30345 - DNA, 676 bp, Zea mays
  misc_feature: Ceres CLONE 1405826-F
  misc_feature: Encodes the peptide sequence at SEQ ID NO. 30346
ggagctccccgcggtggcggccgctctagaactagtggatcccccgggctgcaggaattcgcacgagaccattacctagaacatcctaatcaaaaaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggcggaatctcccgggacgcctctccgtccgcgcctccgcgacggtggtagcggcaccgcggcgggagacggatcccaagaagcgggtggtgatcacgggggatggggctggtctccgttttcgggaacgatgtagacgcttactacgaccgcctgctagtcggggagagcggcatcgggcccatcgaccgcttcgaacgcttctaagttccccacccgcttttgcggcccagaatccggagctttctcctccgaggaatacatcgaacggaaagaacgaccgcccgcccttggaggattgcctccgaatactgcatccgccaggggaacaagaaggctctccaaagggcctcggtaaacgtccaacggctttaaggccctttggaaaaaattgaacagaacc

SEQ ID NO: 30346 - protein, 34 aa, Zea mays
  misc_feature: Ceres CLONE 1405826-F
  misc_feature: SWISSPROT Homolog: EC 2.3.1.41 Beta-ketoacyl-acyl-carrier-protein synthase I
MGLVSVFGNDVDAYYDRLLVGESGIGPIDRFERF

SEQ ID NO: 30347 - DNA, 668 bp, Zea mays
  misc_feature: Ceres CLONE 1405828-F
  misc_feature: Translation starting site: 160
  misc_feature (582)..(582): n is a, c, t, g, unknown, or other
  misc_feature (608)..(608): n is a, c, t, g, unknown, or other
tccccgcggtggcggccgctctagaactagtggatcccccgggctgcaggaattcgcacgagaccattacctagaacatcctaatcgaaaaaatccactccactccatcatcccgtgcctcacgagtcacgagtcactccaggtccaggctgagcagcaatggcgccgcgaacgctcggcttcaacgcggccccgctcctccagattctgcggtccctgtgcctcctggccctcgccgcggcggcggcggtgtccgggcggcgccacggggcctccccggcgcgcggcagcgggcagagcatgtacctggcgccggcctgccgggcgcacacggcgtcggtggcggacttcggcggcgtgggcgacggcaccacttccaacaccgcggcgttccggtccgcggtggaccacctgtcgcagtactcgggcgagggcggcggcggtggcatgctgtacgtgcccgggggcaagtggctgacgggccccttcaccctgaccagccacttcaccctctacctccacaagacgccgtcatcctcgggctccaggacgtaggcgagtggccaatcgtggatccctggncttcttacggaagagggaggacaggnccgggagggagttcgctagcctcatcggcggatcgaacctgacgacgtagtctcactggg

SEQ ID NO: 30348 - DNA, 666 bp, Zea mays
  misc_feature: Ceres CLONE 1405830-F
  misc_feature: Translation starting site: 148
  misc_feature (203)..(203): n is a, c, t, g, unknown, or other
aaagctggagctccccgcggtggcggccgctctagaactagtggatcccccgggctgcaggaattcgcacgagaccattacctagaacatcctaatcgaaaacttgtgaacatcgcagtgctgtagcctccttcgtcttgagcgagcatggagatgtcagccatggaggaagccctcccaagggcgatggagaggaggaaggnaggcctcaaaaccattccgttcatcatcttaaacgagatattcgagaaggtggccacgttcgggctgtcggccaacatgatcctgtacctcaccgagcggtatctcatgaccaacgcctttgccaccgtcgtcctctacttctgggatgccttctccaacttcctgcccatcttaggcgccgtgctcgccgacgcccgcctcggccggttccgggtcatcaccctcggctcctgcgttagcctcttcgggatgtgcctgctgtggctgacggcgatccttccggtgtacaagaacaccccggagtgcgcgccggggcggccggtaagggtgcgcggtgctgccgtggcagctgccgctcctcttcacgtcgttcgcgttcatgtccctcgggtcgggcgggatccgggcctgcacgctgaggttcggggccgaccagttggaccagcgggacaacagcgccag

SEQ ID NO: 30349 - DNA, 577 bp, Zea mays
  misc_feature: Ceres CLONE 1405833-R
  misc_feature (233)..(233): n is a, c, t, g, unknown, or other
  misc_feature (329)..(329): n is a, c, t, g, unknown, or other
caattgggtaccgggccccccctcgaggtcgacggtatcgataagcttttttttttttttttttgcgcgggttttaatatacagtaattttttcatgtaccgagaaaatccagatcacattgccaccgccggagaacagggggtgggcagttccagaatccagagtaacaagagcatctcacattaaccacagcaaaagctcagacctgatgggaagaaacttatttagattngaatggcaggggaatagaactcctcgcttcttgtatcggtcctgtacgaccggaatttgtccccaccaatggtgagccctcggtctctccctgaantgaaacttccttgccctgccaataaggtttgcccaccaaattgcccccgaagcccggaacaaaacccttgggaccaaaaatccccattccctaaatccgtgaaccccccttaaaagggggtggaaagggccctttcccgggaaaaaatgggtccccctttgaaattttggggaaaaaaaaaggccccctaaaaaactggaaacccccggggggaaacttgggccccaaaaggggttggagggtcaaaa

SEQ ID NO: 30350 - DNA, 821 bp, Zea mays
  misc_feature: Ceres CLONE 1405835-F
  misc_feature (14)..(14): n is a, c, t, g, unknown, or other
  misc_feature (15)..(15): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (49)..(49): n is a, c, t, g, unknown, or other
  misc_feature (821)..(821): n is a, c, t, g, unknown, or other
ttttgtcccccccnnccccccccctnnnncccccgtctccacgcccccncacaaaagtggggctccccgcggtggcggccgctctagaactagtggatcccccgggctgcaggaattcgcacgagaccattacctagaacatcctaatcaaaacatccagagagagacacggaggccctgggttcggttgcgctgcttgactcgctccgtgttccaagcgccttttgagcatgcaggcatatataaaattcctcttgttacctacaatccccgcttgaatcagtagcagccaactctctccctctccgttcttggagagccgagatccttgaccgtccgctctgcctcacctcctccggatctagcttcccttgccggccggcttcccgaggtgtcagctgcgggaccggcctctagaaggaaggagttctagaccaccgccccgggctacaacaggccccggtatcctttgcccccccgacggaggggggtccgcttccgggggaacttttcggggcgggccccttacacggcctgcccgggggtggccccccccgacgtttccccgcccccccggtgggccccggcgggtcccccgggcgccccattggcggccgggggtatacactagcggcccccccccccgggtctgttcgggcccctccctgcccccaaggcggccccacacgggcccgagagtacttcctcgtccggggggggcatctcccctccacccccgcctccctcttcccccccgcgccccccctcttctcttaggcgcccatcgaccccgcccgccgccggcccccttcccacccccn

SEQ ID NO: 30351 - DNA, 640 bp, Zea mays
  misc_feature: Ceres CLONE 1405836-F
  misc_feature (155)..(155): n is a, c, t, g, unknown, or other
  misc_feature (307)..(307): n is a, c, t, g, unknown, or other
cgcggtggcggccgctctagaactagtggatcccccgggctgcaggaattcgcacgagaccattacctagaacatcctaatcgaaaaaacagaaccttcgttccctgccgtctcttgtcggtctggccggccgaggtgggtgatctgtagagcgnaacgccgagccgggagaggagggaggccgcaccggcgattgtagaagcagaaccggtggaggagtagaggagggcgccgaatcgatgcgcggctccgcggacgccgtcgtggttgctcgggacgtggtggcctcgtcgagcccgtcccaggncgcgtcggcgttggacatgacgaggtacgcgaatccaccaccaatcccgttcgcctgccgctgcagctgcagctgcagcgttgtgttcgtcggtgttctttcctgagaccaaagccgcgaatttgcgctctcgtttccgcagtcagaggttgttgccggctcctgcggggctgattcgaacaagtttctccctttcgtgccgtgttcgcggcccttctctgctgttctcttcgcaagctcttcaaggcgccgtttgatctgcgggcaaggcatttgttctcgcgtctcgcaagcctgtggctcaccgcccacctgtggtgggtggatcttccg

SEQ ID NO: 30352 - DNA, 694 bp, Zea mays
  misc_feature: Ceres CLONE 1405839-F
  misc_feature: Encodes the peptide sequence at SEQ ID NO. 30353
  misc_feature (346)..(346): n is a, c, t, g, unknown, or other
  misc_feature (349)..(349): n is a, c, t, g, unknown, or other
  misc_feature (352)..(352): n is a, c, t, g, unknown, or other
  misc_feature (356)..(356): n is a, c, t, g, unknown, or other
  misc_feature (388)..(388): n is a, c, t, g, unknown, or other
aagctggagctccccgcggtggcggccgctctagaactagtggatcccccgggctgcaggaattcgcacgagaccattacctagaacatcctaatcgaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgcccgggcctccgggttggncgntgntggngaacctgttccaggtgatcctgcagcgacggnccctcatgtacgtggtgcgcgaccttccggaagagtacggccccatcttcaccatgcggatggggcaacgcaccctcttcgtgggcccctccgggggactcatcaggaagcgctggggaaacagggccccctggtcgggggccggccggagaaacccccccccgcttccttttcgggtgggaagagggaccgtaaatttggggcccaaaggccccttggggggtggtcttggcccccaattcctcccccgaaagatgggcccccccccccggagagggccttcccctcgggcccccgacggggacc

SEQ ID NO: 30353 - protein, 155 aa, Zea mays
  misc_feature: Ceres CLONE 1405839-F
  misc_feature (40)..(40): Xaa is any aa, unknown, or other
  misc_feature (41)..(41): Xaa is any aa, unknown, or other
  misc_feature (42)..(42): Xaa is any aa, unknown, or other
  misc_feature (43)..(43): Xaa is any aa, unknown, or other
  misc_feature (54)..(54): Xaa is any aa, unknown, or other
MDVNDVLLVVLAAALAAMWWRRCSKTGGVDGLPPGPPGWXXXXNLFQVILQRRXLMYVVRDLPEEYGPIFTMRMGQRTLFVGPSGGLIRKRWGNRAPWSGAGRRNPPPLPFRVGRGTVNLGPKGPLGGGLGPQFLPRKMGPPPRRGPSPRAPDGD

SEQ ID NO: 30354 - DNA, 613 bp, Zea mays
  misc_feature: Ceres CLONE 1405840-F
  misc_feature: Encodes the peptide sequence at SEQ ID NO. 30355
ctagaactggtggatcccccgggctgcaggaattcgcacgagaccattacctagaacatcctaatcgaaaaagcagagggccatcttctactcttctctcccagccaacccccttgtccaacggttcagcctgctcaattttagtgaccagttacggcaaatgcagccctcggcggacagcaggaagaagaagcggcggcggcggaggaggaggaggctggcggcatgctactcatcgagacctgctgccggcgccgctcaaggccagtgtcagtgcggctcctctagccccggtggcggcggcggaagcggcagcctcgtggcaagaacaccgcgcgcgttctcgagctgctccagctacgccgcctcgtctgcctgcgcgccggcggcggccgtccatctcggcacccagcacaagctgacggcgctcctcgtcgcgctcgcgctcctcctcgtcctccctcgccctcttctctcagggggtccccgggtggtgtccgccccgcaaggatgggcgagggatccgccagcccccgtgggagagggatcaaacaagacccccccgtggggcttcaatttgaggaggccagggacgggcgaccacccatcgaac

SEQ ID NO: 30355 - protein, 151 aa, Zea mays
  misc_feature: Ceres CLONE 1405840-F
MQPSADSRKKKRRRRRRRRLAACYSSRPAAGAAQGQCQCGSSSPGGGGGSGSLVARTPRAFSSCSSYAASSACAPAAAVHLGTQHKLTALLVALALLLVLPRPLLSGGPRVVSAPQGWARDPPAPVGEGSNKTPPWGFNLRRPGTGDHPSN

SEQ ID NO: 30356 - DNA, 912 bp, Zea mays
  misc_feature: Ceres CLONE 1405842-F
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (15)..(15): n is a, c, t, g, unknown, or other
  misc_feature (16)..(16): n is a, c, t, g, unknown, or other
  misc_feature (20)..(20): n is a, c, t, g, unknown, or other
  misc_feature (21)..(21): n is a, c, t, g, unknown, or other
  misc_feature (738)..(738): n is a, c, t, g, unknown, or other
gcccccgnnnaattnnttgnntttcaatacaacttttcatcccctaccaaagttggagctccccgaggtggcggccgctctataatagtggatccaccgggctgcaggaattcgcacgagaccattacctagaacatcctaatcgaaaacttccgtccttggcaaccaggcccaggcatcgtttcaccgctattcctcctgccccatctcctcccgatccatccgagcccaaaccctagcccagccagatctccgccgccgccggcgagagcacggcatcagatccgcggcgatggcgttccgccgcatcttatccacagaggcgcgccgtcgttcgttcatcgccgcggcaagcgcagaaaactgcgcgcgagtgcatccacggcccagtagccgcgaaagcctcgaccggttagccacccgacgcccaccccgccggcgggtctccccgtggttggctcgtacgtcctctccctcgcccgcatatgccgattaacgcaccaggtcccccaaccccacgctgcaacacccacacaaccacaccgctattacttcctttttaattggaatggtatatatatatatctacaatacctattacgtttacccccatacccttaattccatctcttctacaaaatcacctaactacaattaaataacaattaactccctctcctccccaccacacacacatatacctcaacgagcatgggcagcacggttcctcttgtgtgnttcctcccgtgtgacagttcgttgtgtgtgcctacccataaggcgtatacaactgcacgctgccgcccgcgacccctctccgcgctgccccatcgcgattctcttcagtatgtgggacaggtcgtcggtgggtggggcggcaagccgccctacccgtccaccaacgcccccaag

SEQ ID NO: 30357 - DNA, 534 bp, Zea mays
  misc_feature: Ceres CLONE 1405843-F
  misc_feature: Encodes the peptide sequence at SEQ ID NO. 30358
aagctggagctcaccgcggtggcggccgctctagaactagtggatcccccgggctgcaggaattcgcacgagaccattacctagaacatcctaatcgaaaaaaagaagaatccaaagcggaagggtctctcccccatctctgttcaccaggtgcggcgggcggcgatgggggcgcggaggcggctgcaggcagacgcgccgccggggcatcgccacaggcagggcgcgccggcgccggactggagcgccgggtacctcaacgggtggctgtcgcagccgacgcccgtcttcggcctccgcctctgggtgctatcgcatcgccggcggggcgcatggggtcgggtcccctaatctcgtaggctcccgggggggccggaaggcttccgcgaaatgaaaaggccggggaaaagaccggcccaaagtcgcgggaagaggggggaacccggggccaaaaacgcgagaaagttgggggggggggcccggccccacgggacgggggggaccccgaaaagtcccggggccagagccactttt

SEQ ID NO: 30358 - protein, 61 aa, Zea mays
  misc_feature: Ceres CLONE 1405843-F
MGARRRLQADAPPGHRHRQGAPAPDWSAGYLNGWLSQPTPVFGLRLWVLSHRRRGAWGRVP

SEQ ID NO: 30359 - DNA, 636 bp, Zea mays
  misc_feature: Ceres CLONE 1405845-F
  misc_feature (238)..(238): n is a, c, t, g, unknown, or other
  misc_feature (239)..(239): n is a, c, t, g, unknown, or other
  misc_feature (244)..(244): n is a, c, t, g, unknown, or other
  misc_feature (301)..(301): n is a, c, t, g, unknown, or other
  misc_feature (320)..(320): n is a, c, t, g, unknown, or other
  misc_feature (322)..(322): n is a, c, t, g, unknown, or other
  misc_feature (426)..(426): n is a, c, t, g, unknown, or other
  misc_feature (605)..(605): n is a, c, t, g, unknown, or other
tggagctccccgcggtggcggccgctctagaatagtggatcccccgggctgcaggaattcgcacgagaccattacctaagaacatcctaatcgaaaaaggctggatttgagcctgtttagcagcgctatccgcttggcccaattcgtctactgctcctccagctcctccgctgcgccgccggtcgccgcccgacaccgccgaagaagagcagacgccgagtccaggacgtcgccgcgnngctcngggaaacgcgtgttgcatcgcgagaaggtcggaaagtcgctgtcgccccgcgatcgnacccgtcgcacgccatggnancgtcgccccgtcgctcgactcgtcacttctcacgcgcgccacgctttcacgcgtgacagcaagcgcgctgaaggcgcggttcctgcactgcgacggaggatggncgtctcagccgggaagactcttaaccaccctcctattgcctttgcatgggaaaaaaagtgggggaagggttcccatatggggacactgacgccttcgaaattagcctccacggaaccaagggttcctggggggtgccaaacaggggggggggttggccactggttgcccctttttcggnggaggggttataggaaaaaaagggggccctt

SEQ ID NO: 30360 - DNA, 644 bp, Zea mays
  misc_feature: Ceres CLONE 1405847-F
  misc_feature: Encodes the peptide sequence at SEQ ID NO. 30361
  misc_feature (466)..(466): n is a, c, t, g, unknown, or other
  misc_feature (644)..(644): n is a, c, t, g, unknown, or other
ggagctccccgcggtggcggccgctctagaactagtggatttcccgggctgcaggaattcgcacgagaccattacctagaacatcctaatcgaaaagtctcttttccagttccagacctgaagaaactccgaccggtggcggcaggatctgtgccgcgatggcgacgtcgaacaccgctcggatggaggacggcggcggtgacctgcggagcaccatcaagaagtggaacatcatctaccctgtctacctcaactccaagaagacggtcgccgagggccgccgcatcgccgctgccaaggcctgcccggaccccacctgcatcgagatcgctgactgctgttcgcacctcaagatcccccacgccatcgagttggataaggcgtaccctcgggatttcttccaggtggggagggtcagggtgcagcttaagaaagatgacggctcccccgtcaatcctgctattanaacaaagaagcagctgatgatccaagtagcagagctagttcccaagcatcacggaaggacaaagaagcaagagttcaatttgaggaaacctccatccttccactatgatttgcttctcttaggcttcctgacgttaatgtgtggccttattggtatccctccatcagatggtgtcatn

SEQ ID NO: 30361 - protein, 161 aa, Zea mays
  misc_feature: Ceres CLONE 1405847-F
  misc_feature (24)..(120): Pfam Name: SRP19 Pfam Description: SRP19 protein
  misc_feature (103)..(103): Xaa is any aa, unknown, or other
MATSNTARMEDGGGDLRSTIKKWNIIYPVYLNSKKTVAEGRRIAAAKACPDPTCIEIADCCSHLKIPHAIELDKAYPRDFFQVGRVRVQLKKDDGSPVNPAIXTKKQLMIQVAELVPKHHGRTKKQEFNLRKPPSFHYDLLLLGFLTLMCGLIGIPPSDGV

SEQ ID NO: 30362 - DNA, 722 bp, Zea mays
  misc_feature: Ceres CLONE 1405850-F
  misc_feature (265)..(265): n is a, c, t, g, unknown, or other
  misc_feature (635)..(635): n is a, c, t, g, unknown, or other
tggagctccccgcggtggcggccgctctagaactagtggatcccccgggctgcaggaattcgcacgagaccattacctagaacatcctaatcaaaaaacatcgattttcctccggaatcgtaacctcagaaagccaaatctcattctccggcgctcaggcccacccaagcgtcgactctcccgatccaatcggtacctcctagttcctcgccggcggtagcggcgtcgggcgaacagcggtgacttggcgagggcgcttggccgncgacaatcatccactaggatggaaggtgaggcagagaccgtggttggttcttgttctaaccatgtgggcctctggaggactactacattccagattacattctgaagccaggtgcccaacaagtacttgttgatcatggcgcaccctgccccgttgtagtggtcatcaactcaagatctggagggcaacttggaagtagtttaatcaaaacatatcgtgagcttctcaatgaaagcacagggtttttgatctctcaaaagaggctcaggataaggtattgcatcgtttatatgccaccttgaaaggctgaagatgaaggagacattcttgcagttcaattggaggacctgaggtaattgttgcaaggcgngatgaacactactggctggttggggggaatcaggactttagcttcccaccactccggggaactgttcttgggaacggaatactcctt

SEQ ID NO: 30363 - DNA, 762 bp, Zea mays
  misc_feature: Ceres CLONE 1405851-F
  misc_feature (329)..(329): n is a, c, t, g, unknown, or other
  misc_feature (369)..(369): n is a, c, t, g, unknown, or other
  misc_feature (378)..(378): n is a, c, t, g, unknown, or other
  misc_feature (407)..(407): n is a, c, t, g, unknown, or other
  misc_feature (433)..(433): n is a, c, t, g, unknown, or other
  misc_feature (447)..(447): n is a, c, t, g, unknown, or other
  misc_feature (532)..(532): n is a, c, t, g, unknown, or other
  misc_feature (557)..(557): n is a, c, t, g, unknown, or other
  misc_feature (587)..(587): n is a, c, t, g, unknown, or other
  misc_feature (609)..(609): n is a, c, t, g, unknown, or other
aaagctggagctccccgcggtggcggccgctctagaactagtggatcccccgggctgcaggatttcgcacgagaccattacctaaaacatcctaatcgaaaaactcgcatcagaagcggcgccggcctacaaccgttttcgtgctcacacacccaaaccttagtcgcgatcaggccccaaggactcgagatgaagtcgagggcacggtccaccgccggcgactccaggcttctcggtgaggaagaccaaggctgagaaggacccaaacaagcccaagaagcctccgagcgcgttcttcgtcttcatggaggagttcaggaaggactacnaggagaagcaccccaatgtgaagcaagtctccctgattgncaaggctgntggtgacaagtgaaagtccctgtctgatngcgagaaggctccctacgtgtctaangcagagaagctcanggctgagtacaccaagaagatcgacgcttaacacaacaagcagtctggagacccccacgccgtctgttgattcccgacagtcccnagtccgaggtgaaacgacgaggacnaggaggggtgacgaagtgattgtatgacgnatgaaactcctgtccaaggtgnttgcagtcaggaaaaaaaatttccgtcgttgcggcccaaaaacgggttttttcctcgaaggactttctagatggccagaaaaattaagtgccgtttttcctgagtagtttcccttttgaaagtgtgtccccgtcctggggggggggggaaaat

SEQ ID NO: 30364 - DNA, 667 bp, Zea mays
  misc_feature: Ceres CLONE 1405854-F
  misc_feature: Encodes the peptide sequence at SEQ ID NO. 30365
  misc_feature (353)..(353): n is a, c, t, g, unknown, or other
  misc_feature (667)..(667): n is a, c, t, g, unknown, or other
gctctagaactagtggatcccccgggctgcaggaattcgcacgagaccattacctagaacatcctaatcgaaaaatgaccgactagcccatggtctctctccgctccgacgcgcccgacccaccaccacatccctcatggctgccctcgccgacatcgactcctcggcacttccgccgtccgagtcatccaaaggcaagggcaagatggacaaggaggaggaggacgaggcgaagggcgcggagaagatgtgcggcatctgctatctcgacggccggcgggccatccgcggcgagctcgactgctgcgcccatttcttttgctttgtctgcatcatggcttggggccgcgtcnagtcccgctgtcccttctgcagggcccgcttccacaccatccgccgccggcccgtcgccggccggttccccgacgagcgaatcgtctccgatcaagagcgcaaccaggtacaccatcctcagggcaacgggagcaagataggggggcggaagatcctttacgggaacccatatatgcaccgtttgcaccagtttccagcgatgaatagctggtgctactcggcgagttctgggaatcagctgcaacaactaaatggggtaggggttggcaaacacccgcgcaagagaggcgcaaggcccccacaccagactcan

SEQ ID NO: 30365 - protein, 176 aa, Zea mays
  misc_feature: Ceres CLONE 1405854-F
  misc_feature (73)..(73): Xaa is any aa, unknown, or other
MAALADIDSSALPPSESSKGKGKMDKEEEDEAKGAEKMCGICYLDGRRAIRGELDCCAHFFCFVCIMAWGRVXSRCPFCRARFHTIRRRPVAGRFPDERIVSDQERNQVHHPQGNGSKIGGRKILYGNPYMHRLHQFPAMNSWCYSASSGNQLQQLNGVGVGKHPRKRGARPPHQT

SEQ ID NO: 30366 - DNA, 697 bp, Zea mays
  misc_feature: Ceres CLONE 1405855-F
  misc_feature: Encodes the peptide sequence at SEQ ID NO. 30367
  misc_feature (310)..(310): n is a, c, t, g, unknown, or other
  misc_feature (334)..(334): n is a, c, t, g, unknown, or other
  misc_feature (349)..(349): n is a, c, t, g, unknown, or other
  misc_feature (387)..(387): n is a, c, t, g, unknown, or other
  misc_feature (394)..(394): n is a, c, t, g, unknown, or other
  misc_feature (411)..(411): n is a, c, t, g, unknown, or other
  misc_feature (413)..(413): n is a, c, t, g, unknown, or other
  misc_feature (673)..(673): n is a, c, t, g, unknown, or other
ctggagctccccgcggtggcggccgctctagaactagtggatcccccgggctgcaggaattcgcacgagaccattacctagaacatcctaatcgaaaaatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccggggtggagattatcgccnacgaccaggggaaccgcaccacgnccgtcctatgtcggncttcaccgacaccgagcggctcatcggcgacgctgccnagaaccnagtcgcatgaaccccancnacaccgtctcaatgccaagcggtgatccgggaggaggtctcttgatcgtcggtgcgagtgactgaaattttgggccgtacagtcatcccagggcctggtgaaagccccggtttgattgactacaaggcggggaaaaacattggtgggtgagaaactccccccgggccccacaaagaggaaggaatttggaagcctacttggtcccattaaaaaacggggggggggaaggggggctattcaaagcttcgaggggcgccaanggggccggggtggttttggggcct

SEQ ID NO: 30367 - protein, 63 aa, Zea mays
  misc_feature: Ceres CLONE 1405855-F
  misc_feature (33)..(33): Xaa is any aa, unknown, or other
  misc_feature (41)..(41): Xaa is any aa, unknown, or other
  misc_feature (46)..(46): Xaa is any aa, unknown, or other
  misc_feature (59)..(59): Xaa is any aa, unknown, or other
  misc_feature (61)..(61): Xaa is any aa, unknown, or other
MAKSEGPAIGIDLGTTYSCVGVWQHDRGGDYRXRPGEPHHXRPMSXFTDTERLIGDAAXNXVA

SEQ ID NO: 30368 - DNA, 702 bp, Zea mays
  misc_feature: Ceres CLONE 1405857-F
  misc_feature (204)..(204): n is a, c, t, g, unknown, or other
  misc_feature (216)..(216): n is a, c, t, g, unknown, or other
  misc_feature (246)..(246): n is a, c, t, g, unknown, or other
  misc_feature (267)..(267): n is a, c, t, g, unknown, or other
  misc_feature (277)..(277): n is a, c, t, g, unknown, or other
  misc_feature (289)..(289): n is a, c, t, g, unknown, or other
  misc_feature (313)..(313): n is a, c, t, g, unknown, or other
aagctggagctccccgcggtggcggccgctctagaactagtggatcccccgggctgcaggaattcgcacgagaccattacctagaacatcctaatcgaaaagcgaccgcgactcggatcggatctctctcctgtgtagagccatgctgtgctgtgctggtagtagcagcagcagtagcaatgagtagtccagtccacagctccnagaacacgtggncgtcctttccttttgctctcctatcggtancgggtaacgcaggggggaggncgccaccggnctttaccatggnctgtcgcttttgcctcgtctgggncgttggtccctctgctctattccatccccctttgagcaggctgttgagcaagctgaactcatacgaacctcgatttctcccggccggggggttttttttcctcagtttttggagggatttctcccccttttctttctccctccctcccaagagatcttcacggccccggggatttgaacaaaagggccgggtcaaaaaaaggggggggtcccctcaattgggggaaaaaaaagccccggttttgggtgaaaaaataaaaggctacaccgggttggtgtgctttcccccgcccaggatggaatccccagtttctggaggggccccccgtgccccccaaaaaaaaacccggggaaaacccccttggggggtgggaacaaaaaaaggggggg

SEQ ID NO: 30369 - DNA, 780 bp, Zea mays
  misc_feature: Ceres CLONE 1405858-R
  misc_feature (30)..(30): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (39)..(39): n is a, c, t, g, unknown, or other
tttgttggctctgcgtcgtctctccactgnataannngnagtgtgatatgaggataggaccgaaagagagagggggcccccctcgaggtcgacggtatcgataagcttttttttttttttttttccgaggcgtgaatttctattcttggatacatataaagtataacaaatagaatgtgcaaatccttacaaattagcagcttcagattacgggactggcaggcgcatcctgcctccttatttaaccttactcttgcaacaaagaaaacaagattctaatccttttacattcaatttgtagactatagggcaatatgaaagggaaggggggaaaaaaccaaaaattagattagcccacacagacggggtctaaaacaaaactgttacccattggctttcaccaaggctactactccgactgtttagcccggagagataacgcacgatatcaagtgctgctcgttgcgtcgcaacttgactgacagtgaaaggtggggaggtgattctcaccaacgatgatagctggaagccaccggcagatgcgaagaagaatccaccccatttatgaaaacgaaaacagctgccttgcgtgactgtatgataactcgctaaaaaaagtcaagaagcatcttggacgcactcccatcatagcaaaattatgtcaaatgaataatctttggatagatccaactcgtatcccagtcgtttgacattacaaacctattgcaatagcttcttcccctttcctatcattgtggaacctagaagcgcgcactgtta

SEQ ID NO: 30370 - DNA, 660 bp, Zea mays
  misc_feature: Ceres CLONE 1405858-F
  misc_feature: Encodes the peptide sequence at SEQ ID NO. 30371
  misc_feature (496)..(496): n is a, c, t, g, unknown, or other
  misc_feature (567)..(567): n is a, c, t, g, unknown, or other
tccccgcggtggcggccgctctagaactagtggatcccccgggctgcaggaattcgcacgagaccattagctagaacatcctaatcgaaaagtttttctctcgagtctctcccggttcggatccaaattctaatcaaccgaagcaatccgacctgagaccaagacccgcaccacgcggctcgccgccgatggcgaacgccgacgccgacgaagcgccgctgctctctgtggaacacctccgtccaggatcctgcagccgcgagctcgagctgcgggagttccgcgaccgctacgtgatccgttcgctcgacggcgccgccgctttcgccgtccttcgctccggcggctccatccgccctctctccccagaggaagccgtagctgagagcgactgcaaggtttcagaatatacgggggtggtaggcaccataagattgctcgctggaagctatgtactcgttatcacttctcagaaagatgctggctcttatctggnctcccctgggtacccagtggactcattgaaattcttatgctggcaacgaggctattcagcactggactcancggaaaagaagggatggggcttacttcctgcccctcccggaaattgcaaaaactaccttgggggttgggattattcaacccacacggggtttt

SEQ ID NO: 30371 - protein, 157 aa, Zea mays
  misc_feature: Ceres CLONE 1405858-F
  misc_feature (103)..(103): Xaa is any aa, unknown, or other
  misc_feature (127)..(127): Xaa is any aa, unknown, or other
MANADADEAPLLSVEHLRPGSCSRELELREFRDRYVIRSLDGAAAFAVLRSGGSIRPLSPEEAVAESDCKVSEYTGVVGTIRLLAGSYVLVITSQKDAGSYLXSPGYPVDSLKFLCWQRGYSALDSXEKKGWGLLPAPPGNCKNYLGGWDYSTHTGF

SEQ ID NO: 30372 - DNA, 692 bp, Zea mays
  misc_feature: Ceres CLONE 1405860-F
  misc_feature: Encodes the peptide sequence at SEQ ID NO. 30373
ggagctccccgcggtggcggccgctctagaactagtggatcccccgggctgcaggaattcgcacgagaccattacctagaacatcctaatcgaaaagctagggtttactgcttgtcttcctttctcggcagtcggcaccttcgcggcttcgcctgatcgcctacgccgcttcgtcctgattctgattctctggtgctcccaagaagaaagtcagggaatgaaggaccgccacctctcgctgaaccagacccagcgggtccgcctcgaggccgcgcttcaagagctccagtccgttgcgcccgccgccgcgtccgccgccgccgtcaccgtcgcggacaccattcccgtcaatcaagaggacaacatcctcaaggggcatgggacgtcggatcaggacgccgaggtgcccgccaccctctgcggggagtcgaatgggttcttcaatccgtctacttcccaacccccaccgcagttaccttgccgcgctcttcctctcatcaaccctccccctccaccaaccctcttcacacaactctatatactacatccacacattaacacaaactctccgctcgccccccactcacttcccgctcagcactatacactcatctgttttacataaccacaacacgcccggcgagagtccagcctgcgaacgcacctccctccccccaccctcaaccccccac

SEQ ID NO: 30373 - protein, 135 aa, Zea mays
  misc_feature: Ceres CLONE 1405860-F
MKDRHLSLNQTQRVRLEAALQELQSVAPAAASAAAVTVADTIPVNQEDNILKGHGTSDQDAEVPATLCGESNGFFNPSTSQPPPQLPCRALPLINPPPPPTLFTQLYILHPHINTNSPLAPHSLPAQHYTLICFT

SEQ ID NO: 30374 - DNA, 715 bp, Zea mays
  misc_feature: Ceres CLONE 1405861-F
  misc_feature (354)..(354): n is a, c, t, g, unknown, or other
  misc_feature (358)..(358): n is a, c, t, g, unknown, or other
  misc_feature (468)..(468): n is a, c, t, g, unknown, or other
aaagctggagctccccgcggtggcggccgctctagaactagtggatcccccgggctgcaggaattcgcacgagaccattacctagaacatcctaatcgaaaagaggattcagaagaagcaggcttccgctgctgcttcccccactcgaatccaagcaaccacgcccccacgcccagtccaaccccaacccgcgaagctggcgcgcgaggcggccgacgcgagcgcccgctagcgcaaggagggggacgaggtagaggtccccgacgccaccgcctcgtaagaggtggccgcagcgtcgacccccggagaggacagcgacatgtgtgacgttccacagtcgccgcacgctgcggnaggngtacaaaagtgagcgatgccggaccctatccctagtccgagcctcgtcgtctgctcggaccccgtgtcagtgaagatctccatgggcgtgaatactaccgcagctgctgnggggagcacgatcctacatcccctagagctcaagctgacgagtagtggggacaaggaactctctcttcttagaatctgatttgcatctggcgccccattttacagagaaataaggtgttgccgagcaaaaggtgctttagacccacactggaaacggaactgctttatcgaacttgatggtttcctactggagcaatctacagaactagaaagttgagctgatcctcaggaaaaaattgggcagcaa

SEQ ID NO: 30375 - DNA, 866 bp, Zea mays
  misc_feature: Ceres CLONE 1405862-F
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (27)..(27): n is a, c, t, g, unknown, or other
  misc_feature (30)..(30): n is a, c, t, g, unknown, or other
  misc_feature (805)..(805): n is a, c, t, g, unknown, or other
gggccacccccnncnncnnnnnacccncantacccccttccgcaccgcccacgcctacccctctccgcggaggcggccgctctatactagtggatcccccgggctgcaggaattcgcacgagaccattacctagaacatcctaatcaaaaagcaattgtttccaggtaatctcgcatcagcaaacagcaccgggctccgttcaccgccttgccttctcttctccggttcctcccccgcgcgttcgctcgctctcgtggcgcaactcgtagaccgccgccgcctccgctctacgccaggtgcctaggtctagcttcgtcggtcccttcgccaacgacgagcaccccacccgaagttcagctaggagcgcatcttgcttaacctggttgcttaaatcatggacaattctcagaatcaaccaccacccaccttggtgttggaacaatggccgcaaggcaccctcctagccaccccgccacaatggccatggctgaatccacagaccttattaatccaccaattttgctgcttagaccctgaaaaatggctaggggcaaataattaagggggcaagcttcgacccaaacatttggaaacccaaccctcggaccagggggaggtcttgcctccttccccccgcggcaggacacttttggcgaacctccacccaaagttaattaacgcgaaatccacgacagcatggcaaaaacacaaaacaaagtgaaaccctaaccaaattatcaagtggcggaaagataatttaaactacaacccaaaacacgacccgcacctcccaaatatacgacnccctcaataacgagaacaagttaataacaaaacatatacgacaccggaccgcgcagccatg

SEQ ID NO: 30376 - DNA, 646 bp, Zea mays
  misc_feature: Ceres CLONE 1405866-F
  misc_feature: Encodes the peptide sequence at SEQ ID NO. 30377
aaagctggagctccccgcggtggcggccgctctagaactagtggatcccccgggctgcaggaattcgcacgagaccattacctaaaaacatcctaatcaaaaaagggtggatttgagcctgtttatgcagcgctatccgcttggcccaattcgtctactgctcctccagctcctccgctgcgccgccgggcgccgcccgacaccgacgaagaatagcagacgccgagtccaagacgtcgccgcgcatctcggggaacgcggagttgccatcgccaggaaccgcggaagtacgctgatcgcccgacgaatcggcaccgtcgccaccgcccatggaaaccgtcgcccccgtcgtctccgacctcgacgacttcctgatgggtcgcccaccgactttcacgccgatgaccacgcgaagctgcgtgtgaaggcgtggagctcgtgcactgcctcatcgccacgaggggctgctccctagctcggggggaagtacttcttcaccagcaccaccacactattggccgcttttgccatcgcggcaaaaaaccctagctgcccattggggtccaccgtcctccggtgcaaaacaactgaacagaccccttgcccaggaagcctccaagcccctgccgtccaaagggaaaaccca

SEQ ID NO: 30377 - protein, 31 aa, Zea mays
  misc_feature: Ceres CLONE 1405866-F
METVAPVVSDLDDFLMGRPPTFTPMTTRSCV

SEQ ID NO: 30378 - DNA, 763 bp, Zea mays
  misc_feature: Ceres CLONE 1405868-F
  misc_feature (233)..(233): n is a, c, t, g, unknown, or other
  misc_feature (272)..(272): n is a, c, t, g, unknown, or other
  misc_feature (273)..(273): n is a, c, t, g, unknown, or other
gctggagctccccgcggtggcggccgctctagaactagtggatcccccgggctgcaggaattcgcacgagaccattacctagaacatcctaatcgaaaagacaatcgacgatcgccgcttctcttggccattgtagagggagagagagagcgcgagcgacctaggtcagtcggtttcggttttgggcgtcagcttcagctatccgcgaccgcgacgatgggtctgcgcgtggncgccaccgcgccagctccggccggcgtgcgcgtgctcgnnaggggcgccgcgcgtgtgacccgacaacgttgggcgttgtcgtggccagaaactcctctccgggcggatggccgtcgggacccccgaggccaccaccccctcgccggggcccgctcgaaggacaggggctggtgcttaggacccccaaaagggggggggggtcttccctgggggggggggcgggaaccgggttttcccggttaccaaacgggggcccaacccccgggggcatttggggggccgcagggttcctttaagtgggcggggggcatttctccccctccccccccacgggagaaatttttttcagaattttttgggggggccgcgggggccccctcccaagaaaaattttttttggggggggggcccaccaaaagaaatttttttttttccccccccccccccgggggcggagtgggggggggtacccccctccctccctcgcgggggggccccccccccccccccctcttcaaaaaaaaaaaat

SEQ ID NO: 30379 - DNA, 716 bp, Zea mays
  misc_feature: Ceres CLONE 1405870-F
  misc_feature: Encodes the peptide sequence at SEQ ID NO. 30380
  misc_feature (392)..(392): n is a, c, t, g, unknown, or other
  misc_feature (397)..(397): n is a, c, t, g, unknown, or other
aaagctggagctccccgcggtggcggccgctctataactagtggatcccccgggctgcaggaattcgcacgagaccattacctagaacatcctaatcaaaaaccgaaccaaacaacacacgtcaaagcggaaaacctcagaaaaccacaataaatcatcctcgtccaccactgcccccgctctgctgcaactccactcggcccggccgccctttccacccaccttgatcctctgatccgttggtgcttgaccgatccatggacacccatatcggatccgtgaacggggcggcgtcgaaccagacggttggctgcccggcgtcggcgccggggtgcccgatggcgtccacgccggcgcagcccgcggcgaccctgtcggaggaggaggcgtcnctganacgccacctctcgcgtccactcgtgcaggccggattgaaccaagaattcccccaacaccaaggactacgatcaaggcggtgaaacaccatgcacgattacgatgccgggaaggtggccccacccggtgatgcaaagccaggtacaaccgcctcacaccccaaaccacaatacacaaaaagattacccacctccactccctctgtatatacacaaaaccccacaaaagaccaaacccgccccccccctccccccccacacaccggccacaactacaaactctccaaacaaccaatcccatctcccctcccccacgccgcc

SEQ ID NO: 30380 - protein, 73 aa, Zea mays
  misc_feature: Ceres CLONE 1405870-F
  misc_feature: SWISSPROT Homolog: EC 4.1.1.1 Pyruvate decarboxylase
  misc_feature (47)..(47): Xaa is any aa, unknown, or other
MDTHIGSVNGAASNQTVGCPASAPGCPMASTPAQPAATLSEEEASLXRHLSRPLVQAGLNQEFPQHQGLRSRR

SEQ ID NO: 30381 - DNA, 732 bp, Zea mays
  misc_feature: Ceres CLONE 1405871-F
  misc_feature: Encodes the peptide sequence at SEQ ID NO. 30382
  misc_feature (578)..(578): n is a, c, t, g, unknown, or other
  misc_feature (629)..(629): n is a, c, t, g, unknown, or other
aagctggagctccccgcggtggcggccgctctagaactagtggatcccccgggctgcaggaattcgcacgagaccattacctagaacatcctaatcgaaaacaggatgacaaaatttcccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgccgccgccatgatctgcgcgatctccggtgaggtgccggacgagccggtggtgtcgaagaagtcggggcttctcttcgagcggcggctcatcgagcgctacattgaggaccatggcaagtgccccatcaccaaggatgagcttactatggatgatatcgtgccggtcaataccaacaaggtcgtgaagcccaggcctttgcaggctgcaagcattccaggactccttgggatttttcagaacgagtgggatgctctcatgctttctaattttgctttggagcagcagctacacacagcaagacnagaacttagtcatgcactctaccagcatgacgctgcctggcgtataatagncagggtgaagaaggaaagagatgaggctagagcacttttggctcagctgagagacgattcagcatcagtttgagagctgctcctccggcagctgttgtttcca

SEQ ID NO: 30382 - protein, 139 aa, Zea mays
  misc_feature: Ceres CLONE 1405871-F
  misc_feature (64)..(133): Pfam Name: Prp19 Pfam Description: Prp19/Pso4-like
  misc_feature (99)..(99): Xaa is any aa, unknown, or other
  misc_feature (116)..(116): Xaa is any aa, unknown, or other
MICAISGEVPDEPVVSKKSGLLFERRLIERYIEDHGKCPITKDELTMDDIVPVNTNKVVKPRPLQAASIPGLLGIFQNEWDALMLSNFALEQQLHTARXELSHALYQHDAAWRIIXRVKKERDEARALLAQLRDDSASV

SEQ ID NO: 30383 - DNA, 793 bp, Zea mays
  misc_feature: Ceres CLONE 1405872-F
  misc_feature: Encodes the peptide sequence at SEQ ID NO. 30384
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (40)..(40): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (497)..(497): n is a, c, t, g, unknown, or other
  misc_feature (553)..(553): n is a, c, t, g, unknown, or other
  misc_feature (576)..(576): n is a, c, t, g, unknown, or other
  misc_feature (578)..(578): n is a, c, t, g, unknown, or other
  misc_feature (637)..(637): n is a, c, t, g, unknown, or other
  misc_feature (638)..(638): n is a, c, t, g, unknown, or other
  misc_feature (669)..(669): n is a, c, t, g, unknown, or other
  misc_feature (692)..(692): n is a, c, t, g, unknown, or other
nnnnnnnnnncccnnnnnncccccaccacccccccgcccnggggcgcnnnnnntcaagctggagctccccgcggtggcggccgctctagaactagtggatcccccgggctgcaggaattcgcacgagaccattacctagaacatcctaatcaaaaaggaccagtaagttgccaccacccgcctccaagtaagccatagctgctggaaagcaacggcagcaagaaaccttggaaacctcggagcctacatcccgcgggagatggcggacaaggggaggacagagctggacgaggacgccgacggggtggctcgtgtcacaatctacaaccggctgctcgcccgccatcgacgaccttactaggttaaaaaaaaggtatgaaaaaacacgggggcgaaacgatgataaacgctattgccggccaccgggtaagggggggaaaatatacaggggggtttcgaatttaatttcacttggggccggctcaagggaggcgcanacacatggaaaccaaaagggcagggaaaggcggcactcagatctttctccacccanaatctcgtaataaaccagagagngnccccccaccccgggggcccaaaattcgagggaacaatgcctgttggacggcaaagtatnnagaagagatcccaatggccaatgcgagtggnaagagaaaagcgcagatttcagnaaaagacccaaaactagagatataccaacaaaactcacgcccgcgcaaaaaaattacgaccccaatctcgagaggaaaaaaaaagtctatcctcacacgga

SEQ ID NO: 30384 - protein, 33 aa, Zea mays
  misc_feature: Ceres CLONE 1405872-F
MADKGRTELDEDADGVARVTIYNRLLARHRRPY

SEQ ID NO: 30385 - DNA, 673 bp, Zea mays
  misc_feature: Ceres CLONE 1405873-F
  misc_feature (256)..(256): n is a, c, t, g, unknown, or other
  misc_feature (479)..(479): n is a, c, t, g, unknown, or other
  misc_feature (501)..(501): n is a, c, t, g, unknown, or other
  misc_feature (502)..(502): n is a, c, t, g, unknown, or other
  misc_feature (639)..(639): n is a, c, t, g, unknown, or other
  misc_feature (640)..(640): n is a, c, t, g, unknown, or other
tggagctccccgcggtggcggccgctctagaactagtggatcccccgggctgcaggaattcgcacgagaccattacctagaacatcctaatcgaaaaaagccgtgccacagcatcggtcgtgcgacgaggcgtacgagccgcagcgtcggtcatgcgacgtgcgcgggcggagcactctctggagagaaccgctcgccgacccacccaccgcactgctctcccacccaaatcgccgaccgataggagagaacccgnagctgagaagagagagggcagcaggcggcggcgcggagtaacacgcggaagggaatgcacagcccgtgtgagcctctcgcccccgcgaaaccccaccgattctgattccgccggcgaaatcgggcgcctcgcggctcggccggctaagcggtggacggcggcgccgaggggctcgttcgacacggtggggtgagctcgtgaggagcagcaccacgcgaagggnatgatgaaggggagggcgccgnnaaagaaaacgctcctccgctttctcctcctggttctcccacccctcacggccctctacttcttctacacgctgcacctcctcttcacctccggggtcgtcgggcgcctccaactgcgcggcctgacgccgtctcggnnctccccggatgtctgccaacctcccgggcgggg

SEQ ID NO: 30386 - DNA, 825 bp, Zea mays
  misc_feature: Ceres CLONE 1405874-F
  misc_feature: Encodes the peptide sequence at SEQ ID NO. 30387
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
gggggggnnnnnnnncggnnnntgtaagtgaggcgttccccaacaccccacaaatatggagctccccgcggtggcggccgctctagaactagtggatcccccgggctgcaggaattcgcacgagaccattacctagaacatcctaatcgaaaaactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgctgcgcaggacagtgcctgcagatgggatgcacaggctgttgccaggtgtccttcagaggttcagcactgcagcagcagtagaggagcccatcaccgccgtcagtccatgtgaaatacacaaagctccctcattaatggcaacctttgttgattccgcatcccggcaaagacctttcccaactctgggaccctcgtacagggggaaggtggattggtccatgctggcctggagggccgacgcagaagggacattcaaccggtggtaagaggctggcggtctccgcaagggtttttttgaaagaaagggcccctggcccgcaaagaggaactggcataaagggaagaggcccccggaatcccccaccgcgggagcttgggcaggccgttcactcgccgcaagacagggcccgtccccgccttgggcgtgcctttggaccagaaactcgggtccacaccgccgaccacccgcgcgacgcctggcagcccagcccccggggagggcaggcgcgcc

SEQ ID NO: 30387 - protein, 117 aa, Zea mays
  misc_feature: Ceres CLONE 1405874-F
  misc_feature: SWISSPROT Homolog: EC 1.2.1.3 Aldehyde dehydrogenase (NAD(+))
MARRAASSLVSRCLLARAPAGAPPAAPSALRRTVPADGMHRLLPGVLQRFSTAAAVEEPITAVSPCEIHKAPSLMATFVDSASRQRPFPTLGPSYRGKVDWSMLAWRADAEGTFNRW

SEQ ID NO: 30388 - DNA, 672 bp, Zea mays
  misc_feature: Ceres CLONE 1405876-F
  misc_feature: Encodes the peptide sequence at SEQ ID NO. 30389
  misc_feature (500)..(500): n is a, c, t, g, unknown, or other
  misc_feature (515)..(515): n is a, c, t, g, unknown, or other
  misc_feature (584)..(584): n is a, c, t, g, unknown, or other
  misc_feature (590)..(590): n is a, c, t, g, unknown, or other
  misc_feature (621)..(621): n is a, c, t, g, unknown, or other
tggagctccccgcggtggcggccgctctagaactagtggatcccccgggctgcaggaattcgcacgagaccattacctagaacatcctaatcgaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgcccccttcgcgcccccgatcgcccgattccttcagggccaaagatattccagtgtttaccaacagagtttctcgtacgtaccgggcaaaatcagtgacagttccagatcagcggagttgatgtgtgtcctttggaatacaatgagtatgtcccctgccatgatggagcctatataagcagcttgaagagcctggatacatctanggcatgaggatcttngaaagtatttgtcctcctggggaagaagccggttgtttttgttttggtgcccccctccaaatgactacnagatanccaataagatggccaacaagccgagactacngtatggccgtagtaatgtcaaccattcacattcttgctggaggtcaaggga

SEQ ID NO: 30389 - protein, 86 aa, Zea mays
  misc_feature: Ceres CLONE 1405876-F
MRRWWSPALAAVEPRSVQLLLLGVALVAASFYAGTLFGSSASPALVLPPSRPRSPDSFRAKDIPVFTNRVSRTYRAKSVTVPDQRS

SEQ ID NO: 30390 - DNA, 648 bp, Zea mays
  misc_feature: Ceres CLONE 1405877-F
  misc_feature: Encodes the peptide sequence at SEQ ID NO. 30391
  misc_feature (545)..(545): n is a, c, t, g, unknown, or other
tggagctccccgcggtggcggccgctctagaactagtggatcccccgggctgcaggaattcgcacgagaccattacctagaacatcctaatcgaaaaaaggcttcgttctgctctccggctctcccgcatccaccccgtctcatccccaatccgaccacctcatccctcgcctccatggccctacccctcgcgtcaccggcgggggcatgagccggtgactgctcacgcggcctcgtctgtctgcgcacgcgcgcggggtcggcgagtgagcattgcggcggtccgcgatcgcccgtgggggagcatggcgtcggcggcggggtcggccggcggggccggcgcggggtctggcgggctgaagacctacttcaagacccccgaggggcggcacaagctgcagtatgagaagacgcactcccccgccgtcgtgcactacagccacagcggcaagaccgtctcccagatgacagtggcatatttgaaggagaagccagcaggccagggttccacgccttcaacccaagtgctggtagtggggatgcgntctgcagctgcaaaacttctcggaactgggaaatgggagccgggcacttagcttcgggagaatggtacccaggcaggctgtctcaggaagcaccgaatgggtg

SEQ ID NO: 30391 - protein, 96 aa, Zea mays
  misc_feature: Ceres CLONE 1405877-F
MASAAGSAGGAGAGSGGLKTYFKTPEGRHKLQYEKTHSPAVVHYSHSGKTVSQMTVAYLKEKPAGQGSTPSTQVLVVGMRSAAAKLLGTGKWEPGT

SEQ ID NO: 30392 - DNA, 730 bp, Zea mays
  misc_feature: Ceres CLONE 1405878-F
  misc_feature (23)..(23): n is a, c, t, g, unknown, or other
  misc_feature (29)..(29): n is a, c, t, g, unknown, or other
  misc_feature (30)..(30): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (152)..(152): n is a, c, t, g, unknown, or other
  misc_feature (177)..(177): n is a, c, t, g, unknown, or other
  misc_feature (181)..(181): n is a, c, t, g, unknown, or other
  misc_feature (185)..(185): n is a, c, t, g, unknown, or other
  misc_feature (207)..(207): n is a, c, t, g, unknown, or other
  misc_feature (211)..(211): n is a, c, t, g, unknown, or other
  misc_feature (380)..(380): n is a, c, t, g, unknown, or other
  misc_feature (464)..(464): n is a, c, t, g, unknown, or other
  misc_feature (730)..(730): n is a, c, t, g, unknown, or other
ggtgggtgtgtgtggggttgttntgggtnnggtgttttnnntcacaacaaaaaaaacgacaccctacataatattttacacaaaaaacccccaacaacaccaaaaaaaaaaaacacaaaacccaaaaaaaaccccggggcaaaaacccacancaaaaaacctggaaacctccaccgncggntggncggcccggctctaataactaantggnaatcccccgggctgcaaggaattcgcacgaagaccattacctagaacatcctaatcgaaaaattttcctggggctgctgcgccgcgcttctctctctcgccttctccctcttcgcggcgatccgggttccgctgcaacggcccctgtcgactgtcgtcttctcctcccntcccccctcaaccgggggcggccctttcccaaaatcccccccctccccgggaaaaaattggccccgccgtacccgggatcagtngaatcaagctggttgaaacagaacaaggaaaaaaaaggccaaccaaaaaaagggaaaaaaaaaaaatgggccccaaaagaaaaccctttggccccgggggaaaaccggcaaaacaaaaaatcccgggggaaaaaaaaccaaaaaacggggggccccccccccaagggaaaaaaaggggccccccccccggaaaaaaagaaaacccacccccccaaaaagggggggcccgccccccccccaaaaaaaagcccccccccccccctaan

SEQ ID NO: 30393 - DNA, 675 bp, Zea mays
  misc_feature: Ceres CLONE 1405881-F
  misc_feature: Translation starting site: 506
  misc_feature (406)..(406): n is a, c, t, g, unknown, or other
  misc_feature (438)..(438): n is a, c, t, g, unknown, or other
  misc_feature (499)..(499): n is a, c, t, g, unknown, or other
  misc_feature (564)..(564): n is a, c, t, g, unknown, or other
  misc_feature (635)..(635): n is a, c, t, g, unknown, or other
  misc_feature (636)..(636): n is a, c, t, g, unknown, or other
tccccgcggtggcggccgctctagaactagtggatcccccgggctgcaggaattcgcacgagaccattacctagaacatcctaatcgaaaagtcatagagagccacaggccacaggcaagacaggcaggaggatcggacgagtcggcgaggaagctgcctgcttttcagatagagttattaagatggcgttgcttcggctgcttgccctgatctccctgctcttcgcagtggccactcctgtcagggacatcgcccacgatgcctgctcgtcagaagtgaaggatttccagcacctgaacaacagctcggggctccacctgacgctgcaccacccgcagagcccctgctccccggcgccgctgcccgacgacctccccttctcgcgtgtcgggcccaacgaacggngcgcgcatcgcgtcgctcgccgcgcgcctcgncaagacgccgtcctctcggcccactttgctgacagagccgcgcgggggccctcctcgccgncccccgatgacgaagtccctcgggccggggccggtcggccaagggacggcccggggggggggggnaaataacggcaccccggaggggcccgggccggccgggccaagtcgaaaggcctggggcgggggaaaccggnntcctccgctccccctgggttccaggggcccccccggggc

SEQ ID NO: 30394 - DNA, 642 bp, Zea mays
  misc_feature: Ceres CLONE 1405883-F
  misc_feature: Encodes the peptide sequence at SEQ ID NO. 30395
tccccgcggtggcggccgctctagaactagtggatcccccgggctgcaggaattcgcacgagaccattacctagaacatcctaataaaactgtcccgccgagttcggagcgcagcgcaaggcggggggaggagcaagaagccgccggcctccctcctccggctcaccaccaggcttactccgcaccgcgctgccacgggtaggagcggcgtcaaattcgggattcccaagcggcttcagcccggaggttcagccaaagctattttctaagaaaaatggcggcaatgatggtggcgatgactgcgaggagcaagaacagcatattacccgtggagaagaagcagggctggtctattcagctaccagagctccggttcccttgggattccatgaagacaagggtttctctctgagtctgcaaggatctggacctttctcatggcggcctgtttgctagcgtgggtcttaaagtgtcgaaggtgccccagcagtggcgcccggacgggtgacaaggaattaagattccatccctgaacattgaatgaagacgggccgaaggagtggggtaccagttattacccggaaggacccaggggagggagggggtggtgctaagggaaaaacccccccaaaagcgggggtg

SEQ ID NO: 30395 - protein, 45 aa, Zea mays
  misc_feature: Ceres CLONE 1405883-F
MAAMMVAMTARSKNSILPVEKKQGWSIQLPELRFPWDSMKTRVSL

SEQ ID NO: 30396 - DNA, 617 bp, Zea mays
  misc_feature: Ceres CLONE 1405886-F
  misc_feature: Encodes the peptide sequence at SEQ ID NO. 30397
  misc_feature (158)..(158): n is a, c, t, g, unknown, or other
  misc_feature (159)..(159): n is a, c, t, g, unknown, or other
  misc_feature (435)..(435): n is a, c, t, g, unknown, or other
  misc_feature (451)..(451): n is a, c, t, g, unknown, or other
  misc_feature (467)..(467): n is a, c, t, g, unknown, or other
  misc_feature (469)..(469): n is a, c, t, g, unknown, or other
  misc_feature (514)..(514): n is a, c, t, g, unknown, or other
  misc_feature (556)..(556): n is a, c, t, g, unknown, or other
  misc_feature (558)..(558): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (580)..(580): n is a, c, t, g, unknown, or other
  misc_feature (591)..(591): n is a, c, t, g, unknown, or other
  misc_feature (604)..(604): n is a, c, t, g, unknown, or other
tccccgcggtggcggccgctctagaactagtggatcccccgggctgcaggaattcgcacgagaccattacctagaacatcctaatcgaaaaaaacccccggacatttctggtcgcaccctcctccggccctcccagccgctaagccctctgggaaccnnttcgagagctcgatcggatcggagcccctgccatggccgacgaggcgaaggcgaagggtaatgcggcgttctcagccggccgcttcgaggaggcggcgcggcacttcacggacgccatcgcgctcgccccgggcaaccacgtcctctactccaaccggtcggcggcgctcgcctcactccaccgctactccgacgctctcgccgacgcgcagaagaccgtcgagctcaagcctgactgggccaagggctactcccgcctcggcgcgcgcacccggnccctcggcgacgccgnccagcgccgtcgccgnantacgagaaagggccttgcgctcgacccaagcaacgaagtcctcanggcgggggctcgaggacccccaagaagggccgcgccgcccgncnggggnnngggggnnnnnncggnccccaggcccngggggcggagggncccggggccccgg

SEQ ID NO: 30397 - protein, 142 aa, Zea mays
  misc_feature: Ceres CLONE 1405886-F
  misc_feature (2)..(35): Pfam Name: TPR_2 Pfam Description: Tetratricopeptide repeat
  misc_feature: SWISSPROT Homolog: EC 3.1.3.16 Phosphoprotein phosphatase
  misc_feature (82)..(82): Xaa is any aa, unknown, or other
  misc_feature (87)..(87): Xaa is any aa, unknown, or other
  misc_feature (93)..(93): Xaa is any aa, unknown, or other
  misc_feature (108)..(108): Xaa is any aa, unknown, or other
  misc_feature (122)..(122): Xaa is any aa, unknown, or other
  misc_feature (123)..(123): Xaa is any aa, unknown, or other
  misc_feature (125)..(125): Xaa is any aa, unknown, or other
  misc_feature (127)..(127): Xaa is any aa, unknown, or other
  misc_feature (128)..(128): Xaa is any aa, unknown, or other
  misc_feature (129)..(129): Xaa is any aa, unknown, or other
  misc_feature (130)..(130): Xaa is any aa, unknown, or other
  misc_feature (134)..(134): Xaa is any aa, unknown, or other
  misc_feature (138)..(138): Xaa is any aa, unknown, or other
MADEAKAKGNAAFSAGRFEEAARHFTDAIALAPGNHVLYSNRSAALASLHRYSDALADAQKTVELKPDWAKGYSRLGARTRXLGDAXQRRRRXTRKGLALDPSNEVLXAGARGPPRRAAPPXXGXGXXXXPRPXGRRXPGPR

SEQ ID NO: 30398 - DNA, 668 bp, Zea mays
  misc_feature: Ceres CLONE 1405887-F
  misc_feature: Encodes the peptide sequence at SEQ ID NO. 30399
gctctagaactagtggatcccccgggctgcaggaattcgcacgagaccattacctagaacatcctaatcgaaaagaaatgcggcagacgcgtgggtggtcggagctggggcctcagcttgatcccaggctgccgttcgcggaatctctcttcccactggcgacgactgggcgacctccgccgccacactaaaccctattccaggtgcccaggtctgcgtcgggcccttgccggcgacgagcacccgctagttactactgtgcggtttccaagatggctcgccgtggattgatggaacaggacttaagcaaattggatgtgacaaagcttgacccactgtcacctgaagttatctcacgccaagcaacaatcaatattggtaccattggccatgtggctcatggaaagtctactgttgtgaaggctatatccggagttcagactgttcggttcaagaatgagctggaacgtaacattactataaagctgggctatgctaatgcaaaaatctacaagttgtgaggatgacagatgtccacgaccaatgtgctacaaggcctatggaaagcggaaagaagatagccttctatgtgatgtggcttggatttgaaaaaaccaaaaatgaagctcctgagaactgtttccttttgttgattgcccgggaacccg

SEQ ID NO: 30399 - protein, 82 aa, Zea mays
  misc_feature: Ceres CLONE 1405887-F
  misc_feature: SWISSPROT Homolog: EC 2.1.1.43 Histone-lysine N-methyltransferase
MARRGLMEQDLSKLDVTKLDPLSPEVISRQATINIGTIGHVAHGKSTVVKAISGVQTVRFKNELERNITIKLGYANAKIYKL

SEQ ID NO: 30400 - DNA, 752 bp, Zea mays
  misc_feature: Ceres CLONE 1405889-F
  misc_feature: Encodes the peptide sequence at SEQ ID NO. 30401
  misc_feature (658)..(658): n is a, c, t, g, unknown, or other
tggagctccccgcggtggcggccgctctagaactagtggatcccccgggctgcaggaattcgcacgagaccattacctagaacatcctaatcaaaaaatgccaggtcgccctctcccctacgcctggtacctagcgactacatcacccactccccacactcgacggcggaggccgacagcacaggtgcaccagccgccctcctctggtacgcgcctgaacccgtatagcgaagagccagagccgcagacagagagagcgaacccccgcggcgtcgagctgcatgtcttcaacacgccctgtgcggcggtgccgcccatcaggacgacgacctccgagcagctgactgcgggcaactctaggtcctggacgcgctcgtcgaggccgaccactctctccgccgccgcgccgcggtctaagatggcctctccgggctccacgtcgccagcgcgaatggaccgcctcgaggtgctgtcaatggtcttggatcacggggtgccgccggacgtggtgaatcggcacaagcagacgccgctgatgctcgcgtcgatgcacggcaagactgactgcgtgctgaagctcctgcaggccggcgccaatatcctcatgttcgattcccagcacgttaggacctgcctggaccacgcgtcctacttcggncacgtcggctgcctgcaggacatcactcacgggagcggggaccacgccggtggcagaactcatgaagcctcctccggtgcgtcatacgggaggg

SEQ ID NO: 30401 - protein, 100 aa, Zea mays
  misc_feature: Ceres CLONE 1405889-F
  misc_feature (23)..(55): Pfam Name: Ank Pfam Description: Ankyrin repeat
  misc_feature: SWISSPROT Homolog: EC 2.7.11.1 Non-specific serine/threonine protein kinase
MDRLEVLSMVLDHGVPPDVVNRHKQTPLMLASMHGKTDCVLKLLQAGANILMFDSQHVRTCLDHASYFGHVGCLQDITHGSGDHAGGRTHEASSGASYGR

SEQ ID NO: 30402 - DNA, 724 bp, Zea mays
  misc_feature: Ceres CLONE 1405891-F
  misc_feature: Encodes the peptide sequence at SEQ ID NO. 30403
  misc_feature (709)..(709): n is a, c, t, g, unknown, or other
tggagctccccgcggtggcggccgctctagaactagtggatcccccgggctgcaggaattcgcacgagaccattacctagaacatcctaatcgaaaagtctatctctccgtcccgttttatatctccctcttcgattcctccgcccgagcctgtctcctcatcgacttatacacctcgttctcttaactcgacgtactatggctcactcaattgacggatttcgctgatatggggcccacaggggtcgcctgcgtctccgcctcggcgatcgagtcccgcggttgcgccagatccgaggatgctctgacctccacgtgcgagtccgggtctgctgcactccgcagcaagcgcctcacgagtgactcgcttcggatactcagcatgcgcccgctaggctgacagacgcagaggacgacgccgccgtcgttgatgaacaatgacgcggcgccgttgacctgcgacatcaactacgatctcctgatcatcgacgcgcccgatctgggtcacgtgactccgctgctcagcgttgtagtaggtgtagctacaacaataatcttcgacgatagtgacgactgtgacttgtgaaaacagagtgctggtaccatagcatatctttcaggctgtcagagagcgcacgcagcagcttgactgtctacatgatatgacgtcctaggtgctgcaggatactcatctgaaatcacggacagnctgttcatgcatctg

SEQ ID NO: 30403 - protein, 56 aa, Zea mays
  misc_feature: Ceres CLONE 1405891-F
MGPTGVACVSASAIESRGCARSEDALTSTCESGSAALRSKRLTSDSLRILSMRPLG

SEQ ID NO: 30404 - DNA, 660 bp, Zea mays
  misc_feature: Ceres CLONE 1405893-F
  misc_feature: Translation starting site: 370
  misc_feature (460)..(460): n is a, c, t, g, unknown, or other
  misc_feature (624)..(624): n is a, c, t, g, unknown, or other
tggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgcccccgggagatggcnagccggaggttgccgccgctggcggcgctcggtgccgacgtggcggagcttccaggtcggctgcctcgacagcttcgagccatgcagggacctgcccgtgcttctcgcccagccccgctcgctccccgtcatcgtcacctacagggcgaatttgggagggaggncagtacgcaggcgaagatgagccacggtttgaggcg

SEQ ID NO: 30405 - DNA, 676 bp, Zea mays
  misc_feature: Ceres CLONE 1405894-F
  misc_feature: Encodes the peptide sequence at SEQ ID NO. 30406
  misc_feature (422)..(422): n is a, c, t, g, unknown, or other
ggagctccccgcggtggcggccgctctagaactagtggatcccccgggctgcaggaattcgcacgagaccattacctagaacatcctaatcgaaaaatcttcgccgccgctaaacgttccccccacgccccaacctatccacgcgaaaccttctttcccccgggagacgattcgtcagggagaggaaagaggcaagaggggccatggacgctgccaagttggtgacgccggtcgctgtgtctcacattctggcgcacccgtcggcgggctccgacggcgcagtgaccgatctcgtcgttcaggtcctcgacctgaagtccgtcggcacgggcagccggttcagttcacagcaactgaccggaagggatagatccaggcgatgcttcccaccaactccggggtcggaggtccgctctggcaanctgaaagaactcgggctcatccgcatcatcgactacccttggcacgtcgtcaaaggcaaggatgaaaaggtctgggttgccatcaaaagcaagtttggggggcaagcgcttgcacccaaaatcacggggagggccaaaaaagaggacctcccattggggttaactaaaagacaaaggggtggggcgggcaccccccccccctatgaacccccagcggggggggattcccgccccaaaaccgaaagggacacggg

SEQ ID NO: 30406 - protein, 157 aa, Zea mays
  misc_feature: Ceres CLONE 1405894-F
  misc_feature (6)..(103): Pfam Name: Rep-A_N Pfam Description: Replication factor-A protein 1, N-terminal domain
  misc_feature (73)..(73): Xaa is any aa, unknown, or other
MDAAKLVTPVAVSHILAHPSAGSDGAVTDLVVQVLDLKSVGTGSRFSSQQLTGRDRSRRCFPPTPGSEVRSGXLKELGLIRIIDYPWHVVKGKDEKVWVAIKSKFGGQALAPKITGRAKKEDLPLGLTKRQRGGAGTPPPYEPPAGGDSRPKTERDT

SEQ ID NO: 30407 - DNA, 683 bp, Zea mays
  misc_feature: Ceres CLONE 1405898-F
ggagctccccgcggtggcggccgctctagaactagtggatcccccgggctgcaggaattcgcacgagaccattacctagaacatcctaatcaaaaaatcaccaagttttagactccagcagcggcatccccacccacccatctgctcagcctcagctgccattcccgcgaagcgccgtctcccgggccctatcgatggaccgcgtagccgccctcgccgtcgcgctcctcgccctcttcttcgccgccggggccacggcgcaggccccggcctcgtcgcccaagcgcactccggcgccagcgccgcccaggacgaccttcctcccgccgccgccggctgacagggcgcctatgaccttcccgccgtcgcactccgagagggggacgttgcccgcttcctccgccgctgcgacctccacgaccccagactgcgacgagccgagcacctacagaaggcccccggaaaagccgcaatccatctgagcccccggatcgaccccaccccgttagaaagcccgttagcaccgcaactccagataaaaacgccccccgcgaaggcgcatcccacggtcgcctctacctagacgctaatggggcggcggccgcggaactgagactgagtacgccgcgtccttttaaaccccccctctccccccccccacccattcgattaatattttgtat

SEQ ID NO: 30408 - DNA, 880 bp, Zea mays
  misc_feature: Ceres CLONE 1405899-F
  misc_feature (10)..(10): n is a, c, t, g, unknown, or other
  misc_feature (11)..(11): n is a, c, t, g, unknown, or other
  misc_feature (15)..(15): n is a, c, t, g, unknown, or other
  misc_feature (31)..(31): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ggtccccccnncccncccccccccggcgccnacatttttagatnnnngaaaactggagctcaccgcggtggcggccgctctagaactagtggatcccccgggctgcaggaattcgcacgagaccattacctagaacatcctaatcgaaaaccatcagcacgccgaagaataaaccgtcgtcgaggaggaaggagggggccgcgaggtggacttcaggatgcaggcgcagaggtccccggcgatgacggaaggtgcgggcgccgccacggcggtggcgcctggggcggcggttggattgccgtcccagccacgctggcggtgcgcccctcgctctcactcacggccgtgggagccatctggtttggacctccggccgggggctcgggggcacgccccctcgccccccggggatggctgatattcggttggctcctacccccgagtaaccggggtaatctcgacaatttctagcggggcgcgggtccacaggtaaacatcccttcaccgcggggggtacccgccacaaggggcgggatgcgtttgggggcatctcaggccgctgccggttgcccattgctgcctttcggcgcgtgcgggccgcgtgggccgcgcgcggggctgccgccccacggccccaggtacagcagtgagaggacgccgagcccgcccgggccgccggcgcgtgtgcgtccggcgccgcagtggacggggaccgccgagccagaatggcacccaccgaccgccaccgcgcccgccttcactatcgaaggacgggaccacttttggagcatcgttgttaaacagattaatattgtcaatgcgacccaggggggcggcggcccccccggcgccgtcgtcgctcggctcaaaagacaaatgg

SEQ ID NO: 30409 - DNA, 698 bp, Zea mays
  misc_feature: Ceres CLONE 1405900-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (63)..(63): n is a, c, t, g, unknown, or other
  misc_feature (64)..(64): n is a, c, t, g, unknown, or other
  misc_feature (67)..(67): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (320)..(320): n is a, c, t, g, unknown, or other
  misc_feature (349)..(349): n is a, c, t, g, unknown, or other
nnnnnnnnnnnnnnnnnnnnnnnnnnnnnnnnnnnnnnnnnnnaaagctggagctcccnnngnnggngnnnnnnnnnnnnnnngnnnnnnnnnnnnnnnnnnnnnnnnnnnnnnncccaagctggagctccccgcggtggcggccgctctagaactagtggatcccccgggctgcaggaattcgcacgagaccattacctagaacatcctaatagaaaaaacttgttcagggagttccactccactctcccataatgaggataggggcaggggcgaacatggctgcgtgctcctccgttccctgctcctttcccgcgagnctgaccctcacccgccgaagcccagcggnatcttagctctcatcttcctcgggtcctggtacccaggttcggccggttcgattactcttttgccgcccgcctcgccggcggggagtcccccccgccaaaaaaccttccggggtcaggtcccccccccccgcgtttaaagggagctcaccaattttttctgggcgggaaaagggaaggggggggttttaaaaatggacctccaaaggtcgggtatagggggtaaaaaaagtgtttttggggggggggaaaaaaaccccccccctcctcaaaaaaaaattggtgggggaaaaatgggaatttttttttaaaccccccccccacccgtggtgagaaaaaaaaaacaccccc

SEQ ID NO: 30410 - DNA, 738 bp, Zea mays
  misc_feature: Ceres CLONE 1405901-F
  misc_feature (361)..(361): n is a, c, t, g, unknown, or other
  misc_feature (371)..(371): n is a, c, t, g, unknown, or other
  misc_feature (425)..(425): n is a, c, t, g, unknown, or other
aaagctggagctccccgcggtggcggccgctctagaactagtggatcccccgggctgcaggaattcgcacgagaccattacctagaacatcctaatcgaaaaactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggcaacagccggccccgccgccgcaggcgctccgctctacctctcccntctcgccggntgggcgcgcactctgctcggattgctggtgagatgcccaaagcccttgtgatcntagatgatgttgggcaacacaccctgactaatttgcacagatccccaaaagcttactattttggagggcaaggctggggggaccaattcccaaaaggggattttatgaatttgaaaaaggccaagggcctttggttggggccaattttcaaacccccacaaacccgggaaggggggccccccgcccaaaatttttgcttccccccccgaaggggggcaccaaaacccgcccccccgaaaaagaacacatgggggggcttttttttggaggggttctctttgaagaaaaaaagggggaggagataaaaaaaaat

SEQ ID NO: 30411 - DNA, 657 bp, Zea mays
  misc_feature: Ceres CLONE 1405903-F
  misc_feature: Encodes the peptide sequence at SEQ ID NO. 30412
  misc_feature (300)..(300): n is a, c, t, g, unknown, or other
tccccgcggtggcggccgctctagaactagtggatcccccgggctgcaggaattcgcacgagaccattacctagaacatccatcgaaaactaactacttccctgtacgtggacgaggaccaaggagacagagagaaagcctggccgcgccgcccaccgtcgcctcgtcagtcgcctcctccatcctccctccccatcgacttcccaaatcccagccagatctcctcgtcctctggcccattctcttcatctccatgcatggatgaacaagagacggagggagacagatgcaaacatcgangactggggttgttatctgtctttgtagcagaagaaacagtcctaaaaaagaatggagagctcctcagataggagcaacgtttctcaggggaaccacctgggttatgcgagaagacatccatggattcactggtcctcagttagctggtaggtctaagctcatgttgagtaggagaagtagcagacagggcttcaaggggatccatcagcctctcaaagggaagatggggggactccatactgagctcaatgaggcatttctcttcaggcggggggatccatttgctagaaactccccaaaaggctccagttctgggtccacctcaccgaaaaggggggtccaagttctattcacccc

SEQ ID NO: 30412 - protein, 37 aa, Zea mays
  misc_feature: Ceres CLONE 1405903-F
  misc_feature (15)..(15): Xaa is any aa, unknown, or other
MDEQETEGDRCKHRXLGLLSVFVAEETVLKKNGELLR

SEQ ID NO: 30413 - DNA, 705 bp, Zea mays
  misc_feature: Ceres CLONE 1405904-F
  misc_feature: Encodes the peptide sequence at SEQ ID NO. 30414
  misc_feature (273)..(273): n is a, c, t, g, unknown, or other
  misc_feature (430)..(430): n is a, c, t, g, unknown, or other
  misc_feature (579)..(579): n is a, c, t, g, unknown, or other
  misc_feature (613)..(613): n is a, c, t, g, unknown, or other
  misc_feature (614)..(614): n is a, c, t, g, unknown, or other
  misc_feature (616)..(616): n is a, c, t, g, unknown, or other
  misc_feature (650)..(650): n is a, c, t, g, unknown, or other
  misc_feature (652)..(652): n is a, c, t, g, unknown, or other
  misc_feature (653)..(653): n is a, c, t, g, unknown, or other
aaagctggagctccccgcggtggcggccgctctagaactagtggatcccccgggctgcaggaattcgcacgagaccattacctagaacatcctaatcgaaaagaaggcgaagaagaccaaccaaagcaaagccaacgggatctccctctcattccagaggactccgcgtcgtcaggcccgcttcgcgtgcgacgccggcatatagggtttcgccggcgccggcgatggacccaccccccgtgagccccgatcgctgggggcccagtcagggcngctggcgtcgggccctccggcctccgccgatatggcctcaatttctccgcctccagcctcctccaggcccccatcgcggccctccttgagtactccgggcgtagtccagtccggccctggccctggcggcgcacaccccgtccgcggggccctccgntcgccgttgtcgggcgtcgggaaggtcgatggtcttctctccgctgcgccgctggggaaccggggaaggggttccgatcccggaattcaggggcggcccaagccgacacggagggccacgggccgggcccgggatgcggggacctccgntcctggaggattttggatcgaagcgaccgcccgnncntcctgaggtttgaacagggcctcggctggcgggnannaagggggtgcaggtcgctaccgggatgccggaggaaaaactgggggggttac

SEQ ID NO: 30414 - protein, 105 aa, Zea mays
  misc_feature: Ceres CLONE 1405904-F
  misc_feature (92)..(92): Xaa is any aa, unknown, or other
  misc_feature (104)..(104): Xaa is any aa, unknown, or other
MASISPPPASSRPPSRPSLSTPGVVQSGPGPGGAHPVRGALRSPLSGVGKVDGLLSAAPLGNRGRGSDPGIQGRPKPTRRATGRARDAGTSXPGGFWIEATARXS

SEQ ID NO: 30415 - DNA, 649 bp, Zea mays
  misc_feature: Ceres CLONE 1405905-F
  misc_feature: Encodes the peptide sequence at SEQ ID NO. 30416
  misc_feature (310)..(310): n is a, c, t, g, unknown, or other
  misc_feature (403)..(403): n is a, c, t, g, unknown, or other
tggcggccgctctagaactagtggatcccccgggctgcaggaattcgcacgagaccattacctagaacatcctaatcgaaaacagtccaccttttcctcctctccgactccaccgccgtcacgccatctcgccgggggcggaaccccgaccgcgagtatggggaacatcttcgtgaagaagcccaagatcactgacgtcgatagggccatcctcaccctcaagacgcagcgccgcaagctcgcccagtttcaacagcagcttgagaaggtaatcgaagcagaaaaggaagctgcacggcagttggttcancagaagaagagagacagagctttgattgctctgaagaagaagaaagctcaggaagagctggtgaaaacaagtgacacatggcaaatgaatggntgaacacagctggcagattttgaactagcaagtaaccaaaggctgtatttgaaagcctgaaggctggaaatgctgccctgaagcctatacgggatgggtaaacctttgtgggtggccaaaaggtgagggatgacccggcccgaggttaagggttattaagaagaaataaaagggtggtttgggggagaaattttcacgcggaggaagaaaaacttgtgctgggcccaattttaaaaatttggaaag

SEQ ID NO: 30416 - protein, 82 aa, Zea mays
  misc_feature: Ceres CLONE 1405905-F
  misc_feature (51)..(51): Xaa is any aa, unknown, or other
MGNIFVKKPKITDVDRAILTLKTQRRKLAQFQQQLEKVIEAEKEAARQLVXQKKRDRALIALKKKKAQEELVKTSDTWQMNG

SEQ ID NO: 30417 - DNA, 679 bp, Zea mays
  misc_feature: Ceres CLONE 1405906-F
  misc_feature: Encodes the peptide sequence at SEQ ID NO. 30418
  misc_feature (442)..(442): n is a, c, t, g, unknown, or other
  misc_feature (492)..(492): n is a, c, t, g, unknown, or other
tccccgcggtggcggccgctctagaactagtggatcccccgggctgcaggaattcgcacgagaccattacctagaacatcctaatcgaaaacccgagagttctgaatcgaaaccgtcggccacgagagcagtgcgaggcgcccaccgcgatggctcgaaccaagcaccaggccgtgaggaagacggcggagaagcccaagaagaagctccagttcgagcgctcaggtggtgcgagtacctcggcgacgccggtgagcgcgtgcgtgcggggatcagttccctccttttgccttttttgtgggctgctcttacttgcttgcaagctgtttgatggaatgcaggaaagggctgctgggaccgggggaagagcggcgtctggaggtgactcagttaagaagacgaaaccacgccaccgctggcggccagggactgtagcgctgcnggagatcaggaagtaccagaagtccactgaaccgctcatcccctttgcgnctttcgtccggtgtggtggggtgcaaggcgtgtttgtctctgcataaaaaatggggtttgtcccgcattctgtctaatggaaaagttattcttctgagaaaaaaatgcagggggagggaagttaaccaattttcgtaacaaaccgagaaaggagaagcgctatacccgcagaagccccttctttgcg

SEQ ID NO: 30418 - protein, 129 aa, Zea mays
  misc_feature: Ceres CLONE 1405906-F
  misc_feature (98)..(98): Xaa is any aa, unknown, or other
  misc_feature (115)..(115): Xaa is any aa, unknown, or other
MARTKHQAVRKTAEKPKKKLQFERSGGASTSATPVSACVRGSVPSFCLFCGLLLLACKLFDGMQERAAGTGGRAASGGDSVKKTKPRHRWRPGTVALXEIRKYQKSTEPLIPFAXFVRCGGVQGVFVSA

SEQ ID NO: 30419 - DNA, 738 bp, Zea mays
  misc_feature: Ceres CLONE 1405907-F
  misc_feature: Encodes the peptide sequence at SEQ ID NO. 30420
  misc_feature (471)..(471): n is a, c, t, g, unknown, or other
  misc_feature (513)..(513): n is a, c, t, g, unknown, or other
  misc_feature (515)..(515): n is a, c, t, g, unknown, or other
  misc_feature (524)..(524): n is a, c, t, g, unknown, or other
  misc_feature (530)..(530): n is a, c, t, g, unknown, or other
tggagctccccgcggtggcggccgctctagaactagtggatcccccgggctgcaggaattcgcacgagaccattacctagaacatcctaatcgaaaaaaaaaccgcagccggaggtcgccggtcgccaccaccaatggggccacccgccatggcgttccaagccctcaccctcacgccactccccttctcactccacagctcgagccgccgcgtccgcgtgcttgccgttgcggccgaccagactcctccgcccgcccccccttcggagccggcgaacagccctagccgcctccttcgcgagctcgcgcagcggaagaaggccgtatcccctaagaagaagcatccgccgcgtcgcttcatcctgaagccacctctcgatgacgagcgccttacccggcggttcctcagcagcccgcagctgtcgctcaaggcgctcccgctgctctcttcctgcctcccctcccgcgcgntctcccacgccgacgggacctggatggacgagtacctctcgnangccaagcanggcgcntcggtaccccgctcgcgcccctcgagacgctcggcgaaagcgatgactgccccgccgttcatttcgatgtgctgttctacctcgcgtccagcatctggaccctctaggagcgcacgcgatgcgcacgtacgaacggcactcaggtctggttccggggccagacgtctgggagtccgggttcggcattcctctggagaggaacccagga

SEQ ID NO: 30420 - protein, 30 aa, Zea mays
  misc_feature: Ceres CLONE 1405907-F
MRTYERHSGLVPGPDVWESGFGIPLERNPG

SEQ ID NO: 30421 - DNA, 678 bp, Zea mays
  misc_feature: Ceres CLONE 1405909-F
  misc_feature: Encodes the peptide sequence at SEQ ID NO. 30422
tggagctccccgcggtggcggccgctctagaactagtggatcccccgggcttgcaggaattcgcacgagaccatttacctaaaacatcctaatcgaaaagacatcatagatcaccaactcgttgacgatatagagagcacgatcttcgtgtatttgagaacaatctagtaccgagcgagcgagcgagcgagagatgagtacgaggagctgcgtcttgagcctgcgcccggtggccccgggtcacggaatcctaccattaccaaccctagccttcgttgatcgccgtctcaggtcatggcaggaccggcgccggatcgcgccgccctgactgtgaggccgagcatgtacatgccaatcatgcacgacagcgaccggtacgagctcgtgcgcgatatcggctccggcaacttcggagtcgcccgtctcatgcgcgactgacgcacatgcgaactcgtcgccgtcagtacatcgagcgcgccgagagattgatgagaatgccagcgtgagatgattaccatagatcgtggagcaccctaacatattaggtttaaagaggttattttaacaccgaccatcttgctattgcatggatatggctctggggtgaccttttggaagggtatggaagaacgggcggttcggggaaaaagaggtcgttacttttcccggatgtttttt

SEQ ID NO: 30422 - protein, 47 aa, Zea mays
  misc_feature: Ceres CLONE 1405909-F
  misc_feature: SWISSPROT Homolog: EC 2.7.11.1 Non-specific serine/threonine protein kinase
MAGPAPDRAALTVRPSMYMPIMHDSDRYELVRDIGSGNFGVARLMRD

SEQ ID NO: 30423 - DNA, 715 bp, Zea mays
  misc_feature: Ceres CLONE 1405912-F
  misc_feature: Encodes the peptide sequence at SEQ ID NO. 30424
  misc_feature (403)..(403): n is a, c, t, g, unknown, or other
  misc_feature (467)..(467): n is a, c, t, g, unknown, or other
aagctggagctccccgcggtggcggccgctctagaactagtggatcccccgggctgcaggaattcgcacgagaccattacctagaacatcctaatcgaaaaacgcgcgcaccgtccctcaccgccggcctctgctcctcttccgccgccgcaggatctcgtatcgccggagaccatgtaccgcgccgccgggagccacctccgctccctcaagcatcatggtgcttctaggcttgccagtacaagtgttgcgaagcagtcctcaggtggtctgttcagctggcttcttggtggaaaatcagcgaactccctccccttgatgtcccactccaggcattagcattccctcaccctctacagattttgtagagcatctaagacaaagtcactactcttccaatggncgtcagatcgcctcggagaatcatcgagccagcagcatctgtgggtctgaacattgactggggntcatttaccaaacacctgctcatctggagatcacatctgtgggaagaatggcctcaagaaccggggatcggctcccttacggttagtccgggggaaaaaccattggaggaaaggccttgcataacctccccgggaaaaagggcctttcctttgggcggtggaaggttcccccaagaggggggaggttcccttggggggggggaacccacttcccccgtgggggggggaaaaaacccctccaaaaaaaa

SEQ ID NO: 30424 - protein, 54 aa, Zea mays
  misc_feature: Ceres CLONE 1405912-F
MYRAAGSHLRSLKHHGASRLASTSVAKQSSGGLFSWLLGGKSANSLPLMSHSRH

SEQ ID NO: 30425 - DNA, 699 bp, Zea mays
  misc_feature: Ceres CLONE 1405916-F
  misc_feature: Encodes the peptide sequence at SEQ ID NO. 30426
  misc_feature (547)..(547): n is a, c, t, g, unknown, or other
  misc_feature (557)..(557): n is a, c, t, g, unknown, or other
  misc_feature (573)..(573): n is a, c, t, g, unknown, or other
  misc_feature (660)..(660): n is a, c, t, g, unknown, or other
cgcggtggcggccgctctagaactagtggatcccccgggctgcaggaattcgcacgagaccattacctagaacatcctaatcaaaactaacctcggccttctcgatgtctgccgccacaaccgccccaacccctgcggtggccaccccgatggcgccgcctccgtcgtacccggcctcctccacgatctccgcctccgtggccgcgtcggtcgaggaagaggacgacctctatggccgcctcaagtcgctccagcgccacatggagttcgtcgagatccaggaggagtacgttaaagacgaacagaagaacctcaagcgcgaactcctccgtgcgcaggaggaggtcaagcggatccagtccgtaccgctcgtcatcggccagttttatggagatggtcgacggcaacaacggccatcgtggggttctactacgggcagcaactactaatgtgcggatcctcagcaccatcaaccgcgagctgctcaagccgtcagcaatctgtcgcgttgcatcgtcactccacgtttttaagtcgacgtgctggncgcccgaggncgactcagattctccnttgggtggggaaccggccggagaaacccaacgtcacctacacgaaatttttggaagaatgcgacatccaaaagcaagaataacgggnggggggggttgagttacccttgacttcatcatgagttga

SEQ ID NO: 30426 - protein, 114 aa, Zea mays
  misc_feature: Ceres CLONE 1405916-F
MSAATTAPTPAVATPMAPPPSYPASSTISASVAASVEEEDDLYGRLKSLQRHMEFVEIQEEYVKDEQKNLKRELLRAQEEVKRIQSVPLVIGQFYGDGRRQQRPSWGSTTGSNY

SEQ ID NO: 30427 - DNA, 677 bp, Zea mays
  misc_feature: Ceres CLONE 1405917-F
  misc_feature (443)..(443): n is a, c, t, g, unknown, or other
  misc_feature (453)..(453): n is a, c, t, g, unknown, or other
  misc_feature (490)..(490): n is a, c, t, g, unknown, or other
  misc_feature (579)..(579): n is a, c, t, g, unknown, or other
tccccgcggtggcggccgctctagaactagtggatcccccgggctgcaggaattcgcacgagaccattacctagaacatcctaatcaaaaaaggaaaagaatagtatatccgcccccatattgatcctccccacgtcgccgtgctcgttttgcgcgtccaccagcccgccccccaaccccacccagcgcgacgaagccggggggcgatcgctccagcgccgccggcgacctcgccccgggagccgccggcggtaccccgctctctgtcccgcctcaacgaaccctcaggtccaagtagttcgtttcgtgagttatccaaagttgcgccgcaaagatgagtactgctaatcgctaccaacacatcaagtcaacttaagcctgttgtaggcaaagcaagaaaaattgaaggatctcatgataaaaagtgacaataggatatgtgnctgactgtgntgcacctgatcccaaatggcatctgactaatattggnagtgtttctttgcttaaaatggtggagatgttcatagggcacttggacctgacatctcaagggtttatctgtaacttttggatgatggntctgatagtgaatcgactcccttggtgggagggtggtggaaactcatatgcaaattcattttatgaggctttttctcccaaagacacccaaaaccaaa

SEQ ID NO: 30428 - DNA, 688 bp, Zea mays
  misc_feature: Ceres CLONE 1405918-F
  misc_feature: Encodes the peptide sequence at SEQ ID NO. 30429
tggagctccccgcggtggcggccgctctataactagtggatcccccgggctgcaggaattcgcacgagaccattacctagaacatcctaatcgaaaaaaattaacctgtcccagccgcaccgatccaccccccctcggcctcggcctccctccggccatggaggtgttctactacgtcgtgttcggcgcgctggccgccgtcgtggcggggctcgagctcggcaagagcggcaaggaccgcgtcgccaccacctccgcattcaactccttcaagaacaactacgtcctcgtctactccctcatgatgtccggggactggctgcagggcccctacgtctactacctctacagccagtatggcttcgacaagggcgacatcggccgcctcttcatcgccggcttcggatcctccatgctcttcggcaccatcgtcggctccctcgccgacaaacagggccgcaagaagggcctgcgtcacctattgcatcagctacatcctcagctgcatcaccaagactcccccgaagtacagggtccctcatgatcggcgcaattcctcgggggcatcgccacctcgctgctcttctccgccttcgagtcctggctcgtcgccgagcacaacaaggagagcttttgaccccgaagtggcttgtccataacattctctaaggcctctttcctttgggag

SEQ ID NO: 30429 - protein, 128 aa, Zea mays
  misc_feature: Ceres CLONE 1405918-F
  misc_feature (4)..(129): Pfam Name: DUF791 Pfam Description: Protein of unknown function (DUF791)
MEVFYYVVFGALAAVVAGLELGKSGKDRVATTSAFNSFKNNYVLVYSLMMSGDWLQGPYVYYLYSQYGFDKGDIGRLFIAGFGSSMLFGTIVGSLADKQGRKKGLRHLLHQLHPQLHHQDSPEVQGPS

SEQ ID NO: 30430 - DNA, 824 bp, Zea mays
  misc_feature: Ceres CLONE 1405919-F
  misc_feature: Encodes the peptide sequence at SEQ ID NO. 30431
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (31)..(31): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
nnnnnnnnnnttttttggggggggttcaatnttgggggtnnnnnnaaaactggagctccccgcggtggcggccgctctagaatagtggatcccccgggctgcaggaattcgcacgagaccattacctagaacatcctaatcaaaaaaaacaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcggccggcaagcagcagcaggcggccgacatgccgagcggcagcgcgttctccgggtcggtgaacctcaagcacgtcaagctggggtaccagtaccggcggaaccacttcctgacgctgctgctggagccggcgaggccgcccacggtcccagtagccgcgcgcgctccccccccgaggcaactgctcccgcggaggcgaacgcttggagctgcggcccgccccacctccttccgctcgggccaccgcgggaccctctcccccaccctcccgggcatatcgcccaccccggccccccgccccgagtgactgcgggtggcaaccaccacaagcccaatacgacctcgcgttgcgggtgggcgcccccggctacccccccctacctacaaaataaacaacacaacagccaccgaagaagccatgatggccctgcgcccctgttatacgcgagctctcctatgcaggggagacgccgccccacgcacccctcggcggcaacccccctccggaaacccccaccgagacccaccgctaccg

SEQ ID NO: 30431 - protein, 92 aa, Zea mays
  misc_feature: Ceres CLONE 1405919-F
MPSGSAFSGSVNLKHVKLGYQYRRNHFLTLLLEPARPPTVPVAARAPPPRQLLPRRRTLGAAARPTSFRSGHRGTLSPTLPGISPTPAPRPE

SEQ ID NO: 30432 - DNA, 619 bp, Zea mays
  misc_feature: Ceres CLONE 1405922-F
  misc_feature (218)..(218): n is a, c, t, g, unknown, or other
  misc_feature (309)..(309): n is a, c, t, g, unknown, or other
tccccgcggtggcggccgctctagaactagtggatcccccgggctgcaggaattcgcacgagaccattacctagaacatcctaatcgaaaaattatccccagctttttctccaagcgtccgttcaggaagctgtccggcaacgagccgctcggcactgggcggttggcgtgcaagagcgatcgggaccgcatcgctcgtctgctcctccaggctccgncctcctctcatcactgcagcggcgagagaaaccaggacgggtcccggcggtgggctccactgacatcggctaccatggctacatgcctggnccgggatggcggaatctgcgccgctggcgctcttccggggggtccccaaaccgattttttttgaaagggccaaattttttaaaggggaaaaaattccacaaaggtttccccaaaaatcttaacagaaaggtgccccagggccccaaggaaaactttccctccgggaaaaaaggttttaaaaattgtttttgaaactttgggggggggggaccacttaatgggccctcccccgggggtataaaaccctccaataaaggggaaaaattttctttttttttttaaaaagaaaattcccaaaaggggttttttt

SEQ ID NO: 30433 - DNA, 617 bp, Zea mays
  misc_feature: Ceres CLONE 1405923-F
  misc_feature (241)..(241): n is a, c, t, g, unknown, or other
  misc_feature (250)..(250): n is a, c, t, g, unknown, or other
  misc_feature (463)..(463): n is a, c, t, g, unknown, or other
  misc_feature (587)..(587): n is a, c, t, g, unknown, or other
tccccgcggtggcggccgctctagaactagtggatcccccgggctgcaggaattcgcacgagaccattacctagaacatcctaatcgaaaagtcgccagatctcccccagggacgcgctcatccttttgcctccccactgtgctgtgcaggacctgcgggggaaaggcgtcgctcgctcgctgagaggatgcctctggggctgacctgggtcccttggggcggcgatgcccccaaaggggnttgcctccntcgaattccctcctccaggggggggccggggatttacaaaagggcaagaaatgcaaggcccccggggttccaccccccaaaggggggaattggggtttggtataaaaaaattcccaaaattggggggcccccccttttgggtgttcaggggggggggaaaagggggcaaaggggcggggggcccccccggggggaagaggtcccccctttttntaaaaaaacccgggagaaaaggggtttttttttttttttttgggggggggggccccccccccccagagggtgtttcccacaaaaaaccccgcgttgggggaggagaaaaaacccgctgtgcggnaaaaaaacacgcgaaagtagctttgggggg

SEQ ID NO: 30434 - DNA, 638 bp, Zea mays
  misc_feature: Ceres CLONE 1405928-F
  misc_feature: Encodes the peptide sequence at SEQ ID NO. 30435
  misc_feature (288)..(288): n is a, c, t, g, unknown, or other
  misc_feature (303)..(303): n is a, c, t, g, unknown, or other
  misc_feature (310)..(310): n is a, c, t, g, unknown, or other
tggagctccccgcggtggcggccgctctagaactagtggatcccccgggctgcaggaattcgcacgagaccattacctagaacatcctaatcgaaaaactctccaatctcgccgccaagcctcaccgcaccatggcgaccttcaccgcggcctcctccctctccctcctcttctcccacccgcactcccactcccgccaaccatccgcccaagggcccaccgccagctcccacctcccactgcatccgcgcgccagccgcgcgcgctgcgcctcttccacacgaacgncacgaagcaccgcgnccagcgnaggagacatccgcgagggagcggcgcggctccgagcccgggcccaggtttccctggcgggtaacgagccttcccgcccggggccgggggggaaccggacgaggctatccctggaaaaaaggcctctacgtccagatttggggggccccctcaaagggggcacaaatggaaaaggctgggcccctaccccggggccaaagggggggacctcttctcaccccgggggggcgccaccccgggccacaaaatttggggggtggggacaaaaaaaaaaatttccccccccaaaaaaattcccaaaaaattgtttcctctttttaagggaaacc

SEQ ID NO: 30435 - protein, 169 aa, Zea mays
  misc_feature: Ceres CLONE 1405928-F
  misc_feature (53)..(53): Xaa is any aa, unknown, or other
  misc_feature (58)..(58): Xaa is any aa, unknown, or other
  misc_feature (60)..(60): Xaa is any aa, unknown, or other
MATFTAASSLSLLFSHPHSHSRQPSAQGPTASSHLPLHPRASRARCASSTRTXRSTAXSXGDIREGAARLRARAQVSLAGNEPSRPGPGGNRTRLSLEKRPLRPDLGGPLKGGTNGKGWAPTPGPKGGTSSHPGGAPPRATKFGGWGQKKKFPPPKKFPKNCFLFLRET

SEQ ID NO: 30436 - DNA, 749 bp, Zea mays
  misc_feature: Ceres CLONE 1405929-F
agagctggagctccccgcggtggcggccgctctagaactagtggatcccccgggctgcaggaattcgcacgagaccattacctagaacatcctaatcgaaaaatccccatcgcgatcgcctctctccagctaagcgatgaagaaccctaaccctcctccctcgcgtccctccgccgcaggcaaggagccccccgcaggcatggcgccgccccgcaaatctcgctggggcccaccgccaccgggcgttgccggcgacaaggccgcgccatccacctccgcccgccgcaccccgaccccgacccccacccgcacagcggactccaggcgcccatcggggggcccctcacgcgccagcaccgcaggcccgcaacccccgggtcgcagggcggtcgctcttcggcccgaggggtcgtccgcaacctccgggggggggagactcctcccccggcagccgtacgggtttccacaccctgggacccgccgggtaatggccccttcgccgacgggaaccgtcccaaacctaccttccgccctgcccccccggactaaacggtttcaaagccgggtgccccctggccaaccccttccaaaaaacgggcctcctttcccccgcggggcgggcccggggaacttccgggccgcggcccccgccttaaattttgccacaaatgcccccccgccaacaaagggtttaaggcgccataaaaaccccttggccggaaaaagagagaagaagggggtctttcgcc

SEQ ID NO: 30437 - DNA, 681 bp, Zea mays
  misc_feature: Ceres CLONE 1405930-F
  misc_feature: Translation starting site: 357
  misc_feature: Pfam Name: DUF803 Pfam Description: Protein of unknown function (DUF803)
  misc_feature (458)..(458): n is a, c, t, g, unknown, or other
  misc_feature (479)..(479): n is a, c, t, g, unknown, or other
  misc_feature (512)..(512): n is a, c, t, g, unknown, or other
  misc_feature (533)..(533): n is a, c, t, g, unknown, or other
aaagctggagctccccgcggtggcggccgctctagaactagtggatcccccgggctgcaggaattcgcacgagaccattacctagaacatcctaatcgaaaaaaccggccggcttccctcgcccccggcgaggagtgaagacaagccgacaaggcaaaaccatcgcctgtacggtatccaaccgccgtcccgccgacaaccaaggatagggcgggagagggggatctcgctttcgctccgctgccgcatgcgcaccgcccctcctcatgacaccaactagggcaccaccagcccccttctcgtcgacctccgcgcggtgactctgctgagcatcatacccttatagggcccgacccatggatgtaacttcgaccgctgccgcctccgcctcaggcgggggtaggtggtacacgggcatgtccgcggatacatcaagggcctggtgctcgcgctctccntcagcctcttcatcggggccngttcattatcaagaaagaagggactcagaaggncgcatcctccggcgtcagagncggggggttggtggctattcttatttatatgaggctcttttggtgggttggcatgattacaatgattggtttgaagaatttgcaaattttcgcagtttatggatttgcacccggctatttttggcccctccctctcggggcgtctaag

SEQ ID NO: 30438 - DNA, 812 bp, Zea mays
  misc_feature: Ceres CLONE 1405931-F
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (19)..(19): n is a, c, t, g, unknown, or other
  misc_feature (26)..(26): n is a, c, t, g, unknown, or other
  misc_feature (34)..(34): n is a, c, t, g, unknown, or other
  misc_feature (40)..(40): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (812)..(812): n is a, c, t, g, unknown, or other
ggggcccccccnnnncccnccgcccnccccccancgatantcaaannntgacaaagctggactccaccgcggtggcggccgctctagaactagtggatcccccgggctgcaggaattcgcacgagaccattacctagaacatcctaatcgaaaaaaaaagcaatttttccccctgggagcccgagacgcagcgcgaggtgcggccccgtcccctcgccaccggaggagcaggacgacaaggtggcgtcggcgcgaggtaatcgcgcgccctggagagcggcggcatcggagtctcacgcggaggcgaggagtgaggtgagagccctatagccaccgccgcggggcgtcgtgttcgctgcacacactcccaccattttgtcccaacttgaagctcagattccgggctgacgtggctgggccctaccccctcccctagaatcccaaggctcctaaattggaaaaaaacaagaaaatggggaaagaaacggggaaaacagaattaagccgcccgggaacccgaaaggaatatccccgcggaaatccttccccccctcctgcggaggggaattcccggatataccctttcggactgtcccccaatccttcttccgaggcaagaaagacccctgggagcagcccggaaaccccgatcaccaattaaacccgggaaataagaaatctttcccttcaatacggcaccgggcccacaagcccggtcaaggaaaaaagggcgtccggggcttcgtcgagagagaacccccccagtaacaaagaaaccaccaccgcctcggacgccaaagaaaaaatggggn

SEQ ID NO: 30439 - DNA, 663 bp, Zea mays
  misc_feature: Ceres CLONE 1405932-F
  misc_feature (232)..(232): n is a, c, t, g, unknown, or other
aaagctggagctccccgcggtggcggccgctctagaactagtggatcccccgggctgcaggaattcgcacgagaccattacctagaacatccgaatcgaaaaatcgcagaaattctccgcaacttcacagcgtatcatcgttttccatcgctcctactcctatcatccagaaaatctgagcggtattgatggcgcccaaggcggagaagaagccgcggcgaagaagtggcgnaggaagagccctcggagaggcggctccggcggagaggcccccgcggggaagaaggccaaggcggaaaagcggcttacctggcggccaagtcccccggcaaggaggcggccacaagaaggggaggaaaaagcaaacaagaccggggagacctaccagactacttctcaaggcctccttctccccccattcgccctccccttcgcgttccctccttgaacgccaccgttgacgtccgctttcggggagggaagtccgccgaaaaaccccccctggaatttttccgaacgcccctcccaccccctttttaacccctccggagagggccccctggtttctagttttgggaaaccccccccattcctcggtttggtttcctgaaaaggcccctttccggcctttttttcggttttcgaaaaagggttcccttgggg

SEQ ID NO: 30440 - DNA, 744 bp, Zea mays
  misc_feature: Ceres CLONE 1405933-F
aaagctggagctccccgcggtggcggccgctctagaactagtggatcccccgggctgcaggaattcgcacgagaccattacctagaacatcctaatcaaaagaggctcttctcctcctcgcctcctctccctagcctccacgacgcaagggagagtgacgtaaagcgacgcggcgcgagcgaggagggccaaggggaagaggggaagcaccgcaccaggacccttgttcgccgccgccgcctctgatctcccgcgagggttgtcagggattccaatatggtcggaccaggaacatttcgcttactttccctggaacggtggttggggcaaaagggttaaaaaaacacccgggggggcctccccccaaaaaaggggcggggaaaaaaagccccctttccggtctcaaaaggtcccttttccccccccagatttctacaagggggtccccagggctctggaaaaacccccccccaaaaaaaacgggggggggcgcccccccccccgggggggggggtttaaaaaaaggggggagaaatttttttggcggggcccccctcaggagggggggaaaaaaaccccccccctttttttttttttttttttttcacaaaagaggcagcctctcttctatttcttttttttgtgggcgccgccccccggaagaacacggggaaaaatccttctcctccccgcggggggggagttttcccccccccaaacaaagaaatatattagacggggggg

SEQ ID NO: 30441 - DNA, 679 bp, Zea mays
  misc_feature: Ceres CLONE 1405937-F
  misc_feature: Encodes the peptide sequence at SEQ ID NO. 30442
aaactggagctccccgcggtggcggccgctctagaactagtggatcccccgggctgcaggaattcgcacgagaccattacctagaacatcctaatcgaaaactcttgatccgagccgccaccaaaccctaactatctaaaacccccgtctcgctgtccgatggccgccgcctcgccgccgccctccccaccccacgcaaagcgccccaagatgtcctcctcctccgacccggaagccgatgctgagcccacctcggcctccgccgccgttgagggcgccgatcctgcgcagcgtcgtcccaggtacaagcgccgcaaggccgccatccttctcgggtactgcggcgcggggtatcagggcatgcagaagaatccgggcgcgcgcaccatcgagggggacctcaaggaggccctctacaggggggcggccgtgcccgaaggccgaccggcccgcgcccgcgccgttaacaattgggcacgtgctggccgcaccaacaaggagggccgcgcccggggggcaggtggggtccggggggcttctaccgtcaaccccgcgggctttcatcgatcgcttggaacccgaaacttcccgccccaaaaaccggcggccaacgggtacgtggggggttaccacctctttaaagggaaaaaaagttctggcaacccgcggggagtacctg

SEQ ID NO: 30442 - protein, 173 aa, Zea mays
  misc_feature: Ceres CLONE 1405937-F
  misc_feature: SWISSPROT Homolog: EC 5.4.99.12 tRNA-pseudouridine synthase I
MAAASPPPSPPHAKRPKMSSSSDPEADAEPTSASAAVEGADPAQRRPRYKRRKAAILLGYCGAGYQGMQKNPGARTIEGDLKEALYRGAAVPEGRPARARAVNNWARAGRTNKEGRARGAGGVRGASTVNPAGFHRSLGTRNFPPQKPAANGYVGGYHLFKGKKSSGNPRGVP

SEQ ID NO: 30443 - DNA, 685 bp, Zea mays
  misc_feature: Ceres CLONE 1405941-F
  misc_feature: Encodes the peptide sequence at SEQ ID NO. 30444
aaagctggagctccccgcggtggcggccgctctagaactagtggatcccccgggctgcaggaattcgcacgagaccattacctagaacatcctaatcgaaaaatcaatcagttccacaatccacttgcctcggccgctatcgtgaccgggaacaacaactgcgagatggccacggtggagacctcgggcacggcgatagggtcctccgggagatgggcactacacggcaagacagccctcgtcaccggcggcacccgcggcatcgggcgtgcggtagtggaggagctggcggcgctgggggcggccgtgcacacatgctcccggaaggcggaggagctcggcgagcgcatcaagggagtggaggccaggggattcagcgttaccggggtccgtctgcgacctctccgagagggacaggcgggagcggttgctccgcgagggtgccgaccgcttcgggtgggccctctcacgctcacgcccccggacccttctccccgcggcgccggtcgccggagctccgggtctccgcccgggccacaccctaatcctcaatggctgccgcaaggggcataaccagctcctgaagagactctctacaccaggctgctggttcgccgcgcttttctcattcggggaaagcatgagaatcctctgctggactgaaacattggctcctcttggagtg

SEQ ID NO: 30444 - protein, 135 aa, Zea mays
  misc_feature: Ceres CLONE 1405941-F
  misc_feature: SWISSPROT Homolog: EC 1.1.1.236 Tropinone reductase
MATVETSGTAIGSSGRWALHGKTALVTGGTRGIGRAVVEELAALGAAVHTCSRKAEELGERIKGVEARGFSVTGVRLRPLREGQAGAVAPRGCRPLRVGPLTLTPPDPSPRGAGRRSSGSPPGPHPNPQWLPQGA

SEQ ID NO: 30445 - DNA, 673 bp, Zea mays
  misc_feature: Ceres CLONE 1405942-F
  misc_feature: Encodes the peptide sequence at SEQ ID NO. 30446
  misc_feature (350)..(350): n is a, c, t, g, unknown, or other
caaagctggagctccccgcggtggcggccgctctagaactagtggatcccccgggctgcaggaattcgcacgagaccattacctagaacatcctaatcgaaaattatccccagctttttctccaagcgtccgttcaggaagctgtccggcaacgagccgctcggcactgggcggtggccgtgcaagagcgatcgggaccgcatcgctcgtctgctcctccaggcctccgcctccctcatcatcactgcagcggcgagaagaacaagggacggtccggcggtggtctccactgacatcgcctaccatggctaccatgctgcgccggtgcatgcgggatctgcgcccgctgncgtctctcgcgagggtcccagaccgatcttcttcgagagtcaacatttcttaatgtagaaaagcactcacaaagcatctccaaagagtctacacagaatgctgccccagtccctcagacaccttctcagtcgggaagtaatgttcaaagcttgctcttgaaactcttgtggtcgtgcagcagctataggtgccatcaacttggttatatagatcttcaatttaaggaccagacattgccttttagcttaaagaaggagatgtcggaaaggtggtatatgaagatctgaggattccttctggacagaaggttgacagacacaaa

SEQ ID NO: 30446 - protein, 32 aa, Zea mays
  misc_feature: Ceres CLONE 1405942-F
  misc_feature (16)..(16): Xaa is any aa, unknown, or other
MATMLRRCMRDLRPLXSLARVPDRSSSRVNIS

SEQ ID NO: 30447 - DNA, 668 bp, Zea mays
  misc_feature: Ceres CLONE 1405944-F
  misc_feature: Encodes the peptide sequence at SEQ ID NO. 30448
  misc_feature (573)..(573): n is a, c, t, g, unknown, or other
tccccgcggtggcggccgctctagaactagtggatcccccgggctgcaggaattcgcacgagaccattacctagaacatcctaatcgaaaagatttcctcgtcatttctctcatccgctgcgctccctctcccactcggcgaagaagggggaaaaaagctcgaaagcgggagccggcgagcgagatgggcgcagggagcagccgcgcggacgcgccgtcgcggcgccgggcgcgcctcagcctcggcgggtgcttcggggccggatcctcctcgtccgcgcacgacggcgggagcttcgccgcggccgggccctcctcctcgcgcgccatcgaggtacaatcacgacagtcagggcgacaagtgagtgccctgaattttcaggcttctctagctgctaaggatctccaggtttccagtgagtcaaatccaaggctgcattcgtcttcaagcaccataagccatcatctcagattcaatcacctcaattaccatgaaaacaaggaagatggcctggggtctgaaaacgctgaaacaattggtcttcaaagctcatctaagaaacctgtcatggnaaaggggaagtctccttatggaacctggtgatggcgactcatcacaaggagggaatagttctggaggtaacaggcggggggaaggtcctgaccca

SEQ ID NO: 30448 - protein, 139 aa, Zea mays
  misc_feature: Ceres CLONE 1405944-F
  misc_feature (130)..(130): Xaa is any aa, unknown, or other
MGAGSSRADAPSRRRARLSLGGCFGAGSSSSAHDGGSFAAAGPSSSRAIEVQSRQSGRQVSALNFQASLAAKDLQVSSESNPRLHSSSSTISHHLRFNHLNYHENKEDGLGSENAETIGLQSSSKKPVMXKGKSPYGTW

SEQ ID NO: 30449 - DNA, 643 bp, Zea mays
  misc_feature: Ceres CLONE 1405946-F
  misc_feature: Translation starting site: 282
aagctggagctccccgcggtggcggccgctctagaactagtggatcccccgggctgcaggaattcgcacgagaccattacctagaacatcctaatcgaaaaaggatgacaaaatttcccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgccgccgccatgatctgcgcgatctccggtgaggtgccggacgagccggtggtatcgaagaagtcggggcttctcttcgagcggcggctcatcgagcgctacattgaggaccatggcaagtgccccatcaccaaggatgagcttactatggatgatatcctgccggtcaataccaaacaggtcggtgaacaccaggctttgcaggctgcaagcatcccaggactccttgggatttttagaacgagtgggatgctctcatgctttctaattttgctttggagcagcagctacacacagcaagacaagaaactagtcatgcactctaccagcatgacgctggctgccgggttataacccgggtgaaagaggaa

SEQ ID NO: 30450 - DNA, 689 bp, Zea mays
  misc_feature: Ceres CLONE 1405947-F
  misc_feature: Encodes the peptide sequence at SEQ ID NO. 30451
  misc_feature (325)..(325): n is a, c, t, g, unknown, or other
  misc_feature (427)..(427): n is a, c, t, g, unknown, or other
  misc_feature (439)..(439): n is a, c, t, g, unknown, or other
  misc_feature (515)..(515): n is a, c, t, g, unknown, or other
aagctggagctccccgcggtggcggccgctctagaactagtggatcccccgggctgcaggaattcgcacgagaccattacctagaacatcctaatcgaaaaacgccgctgctccaagaaaccaccgccgagcccaaccgcacaagcgcgcgaggcaggagagagagagagagaggcggggagcaaaacaatggaggggaaagaggaggacgtgcgcctgggcgccaacaagttctcggagcgccagcccatcgggacggcggcgcagggcgccgctgacgacaaggactacaaggagcccccgccggcgccgctgttcgagcccngggagctcaagtcctggtccttctaccgcgcgggcatcgccgagttcgtcgccaccttcctcttcctctacatcaccatcctcaccgtcatgggcgtctccnagtccacctccnagtgcgccaccgtcggcatccagggcatcgcctggtccttcggaggaatgatcttcgcgctcgtctactgcaccgncgggcatctccggaggaacatcaacccagctgtgactttcgggctgttcttagccagggaactgtccctgattagggccctcttctacttatcatgcaatgcctggtggcatctgtggagctgaagtggtgaaggtctcccgcagggattttactgggcaaggggggtgcgccc

SEQ ID NO: 30451 - protein, 149 aa, Zea mays
  misc_feature: Ceres CLONE 1405947-F
  misc_feature (47)..(146): Pfam Name: MIP Pfam Description: Major intrinsic protein
  misc_feature (46)..(46): Xaa is any aa, unknown, or other
  misc_feature (80)..(80): Xaa is any aa, unknown, or other
  misc_feature (84)..(84): Xaa is any aa, unknown, or other
  misc_feature (109)..(109): Xaa is any aa, unknown, or other
MEGKEEDVRLGANKFSERQPIGTAAQGAADDKDYKEPPPAPLFEPXELKSWSFYRAGIAEFVATFLFLYITILTVMGVSXSTSXCATVGIQGIAWSFGGMIFALVYCTXGHLRRNINPAVTFGLFLARELSLIRALFYLSCNAWWHLWS

SEQ ID NO: 30452 - DNA, 675 bp, Zea mays
  misc_feature: Ceres CLONE 1405949-F
  misc_feature (237)..(237): n is a, c, t, g, unknown, or other
  misc_feature (292)..(292): n is a, c, t, g, unknown, or other
  misc_feature (303)..(303): n is a, c, t, g, unknown, or other
  misc_feature (393)..(393): n is a, c, t, g, unknown, or other
  misc_feature (611)..(611): n is a, c, t, g, unknown, or other
  misc_feature (644)..(644): n is a, c, t, g, unknown, or other
  misc_feature (645)..(645): n is a, c, t, g, unknown, or other
  misc_feature (658)..(658): n is a, c, t, g, unknown, or other
ggagctccccgcggtggcggccgctctagaactagtggatcccccgggctgcaggaattcgcacgagaccattacctagaacatcctaatcgaaaaaatgtctacttgtctaccgtcgctgcgctagccctcctccctgcttcttgcttttgcctgagcctgcagcctgctgcaagcttttgctttggtttaggtgcttcttttcacccctttactgttcccccacttttgcttgcnttgtcacgcacacgaaaagctcctggcctttacttatctccgcaccgtagtgggnattttgggggnaagttgccctgctcgccccttccggtttcttttgctccaatggggggccacggcacggggccccgggttggctgcccgtggttcctgggncgggcgaaaatccgggttccttgtgcggggccccggtccccctcggggaattgggaaaatttcttttaaaaccctttgggaaattccccgaaaggccccccgaaaaaaaaattcggggccccccccaccaattttccccccggggtatacacccaccttttctttctccccccggaagcggaacaaatttttatggggccccaacaacatgtaaaccntggtttaaaaaaaaaagaagcccccccccccgnngggtgaaacttanacaacgacacccaggcg

SEQ ID NO: 30453 - DNA, 641 bp, Zea mays
  misc_feature: Ceres CLONE 1405950-F
  misc_feature: Encodes the peptide sequence at SEQ ID NO. 30454
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (576)..(576): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
aaagctggagctccccgcggtggcggccgctctagaactagtggatcccccgggctgcaggaattcgcacgagaccattacctagaacatcctaatcgaaaagtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttccgcgggggggaagggcatccccgggaaggcgggggggggggccacccccccgggggggcccccctcccaaagggggttttttttttttgggggggcccccccccggggggggggggggggtttgtttggggggcgcccccccccccctctccgcccccnnncccccccccccccggggggggggggggcgccccccacccccccacccggggggagttgtgtctctcctcccttctctcatcnaataacacgcaccgaccaccacccgcgggggttannnnccgctccgcgcgggcgccccaccctcg

SEQ ID NO: 30454 - protein, 156 aa, Zea mays
  misc_feature: Ceres CLONE 1405950-F
  misc_feature: SWISSPROT Homolog: EC 1.11.1.6 Catalase
  misc_feature (108)..(108): Xaa is any aa, unknown, or other
  misc_feature (147)..(147): Xaa is any aa, unknown, or other
  misc_feature (148)..(148): Xaa is any aa, unknown, or other
MDPTKFRPSSSHDTTVTTTNAGAPVWNDNEALTVGPRGPILLEDYHLIEKVAHFRGGEGHPREGGGGGHPPGGAPLPKGVFFFWGGPPPGGGGGFVWGAPPPPSPPPXPPPPGGGGGAPHPPTRGELCLSSLLSSNNTHRPPPAGVXXRSARAPHP

SEQ ID NO: 30455 - DNA, 648 bp, Zea mays
  misc_feature: Ceres CLONE 1405951-F
  misc_feature: Encodes the peptide sequence at SEQ ID NO. 30456
  misc_feature (232)..(232): n is a, c, t, g, unknown, or other
  misc_feature (310)..(310): n is a, c, t, g, unknown, or other
  misc_feature (354)..(354): n is a, c, t, g, unknown, or other
tccccgcggtggcggccgctctagaactagtggatcccccgggctgcaggaattcgcacgagaccattacctagaacatcctaatcgaaaagtgtcgtttcttccctttcccgtttcccccgttcagttcagcttcggttggctcgccgtactcgggtttgttcctcgcctcgcttcgcttccttcctccgcagtcctcgtctcgaattcgctcgcggtgggagaaatcggngcgcgaggatgaccgtgatcgacatcctcacccgggtggacgcgatctgccagaagtacgacaggtacgacgtcgacnagctcacgggcgcgaacgtcgccggcgacggaccgttcgcccgnctctacgcggtcgtcgacgcggacatcaaccaatgcgtcgattaagccggaaacggcgaagcaagagaagaacccggcccgcgggtggtggcgcttaacggccaagacccgggggcaaccaaggcaaggttcctcgagggagaccctccccagctgcaaggcctcgccgttaaaaaaggggaaagggctgaacaagaaaaaaaattgcgacccgtaatgggctggggtgcccctttacctggaaaaaaacaatcaatccccgaagggaagttctactggcacaaagaaaaaagg

SEQ ID NO: 30456 - protein, 52 aa, Zea mays
  misc_feature: Ceres CLONE 1405951-F
  misc_feature (24)..(24): Xaa is any aa, unknown, or other
MTVIDILTRVDAICQKYDRYDVDXLTGANVAGDGPFARLYAVVDADINQCVD

SEQ ID NO: 30457 - DNA, 634 bp, Zea mays
  misc_feature: Ceres CLONE 1405953-F
  misc_feature: Encodes the peptide sequence at SEQ ID NO. 30458
gctctagaactagtggatcccccgggctgcaggaattcgcacgagaccattacctagaacatcctaatcgaaaaagctagccgagctataccactagaaccagagcacaactcaaagcaatgccgccgcctcctcctcctccgccccactcccacgcttcccatcccgcgccgcatggacgcgagcagcactagcgcgggggcacacagcacggcgagcgggcgggggcgcgacgatggacctgggcgggtccggtggtgatggacgcgggcgcctcggagctgggcctgctcggcggcggatctagcaggctgctcaagcacgggcgggggcccaatgcggcggggggagacgacgacgtgtggggcggccgcaaggccaagcaccccaggacagggacagcgccccgtcgtcgccggggaagtggggtttgccagccaagggtttccccccgggggggggtggagggggtgtgccggcccgccacaaggggaagcacataatgacaggttcgcattctcggagggagagagacggggatgggggaccaccaccggcaataaaaaaaaaaggatgggtctgtagggcgaagaattgtagcagggggggggggcgagatatggggggggggtgg

SEQ ID NO: 30458 - protein, 80 aa, Zea mays
  misc_feature: Ceres CLONE 1405953-F
MDAGASELGLLGGGSSRLLKHGRGPNAAGGDDDVWGGRKAKHPRTGTAPRRRRGSGVCQPRVSPRGGVEGVCRPATRGST

SEQ ID NO: 30459 - DNA, 644 bp, Zea mays
  misc_feature: Ceres CLONE 1405957-F
  misc_feature: Translation starting site: 254
  misc_feature (284)..(284): n is a, c, t, g, unknown, or other
  misc_feature (298)..(298): n is a, c, t, g, unknown, or other
  misc_feature (342)..(342): n is a, c, t, g, unknown, or other
  misc_feature (404)..(404): n is a, c, t, g, unknown, or other
  misc_feature (406)..(406): n is a, c, t, g, unknown, or other
  misc_feature (410)..(410): n is a, c, t, g, unknown, or other
  misc_feature (411)..(411): n is a, c, t, g, unknown, or other
  misc_feature (420)..(420): n is a, c, t, g, unknown, or other
  misc_feature (423)..(423): n is a, c, t, g, unknown, or other
aaagctggagctccccgcggtggcggccgctctagaatagtggatcccccgggctgcaggaattcgcacgagaccattacctagaacatcctaatcgaaaaatccccaatatatccccactcttcgcctcctttctggagcagctagggttccgtcctcgatccgatcccgcgagtgcacaccacctttccccactccgatcgaatcgatggccgccgagggcgagaagagatgataaccctcaaaagctccgatggcgaggagttcgaggtggaaagaggcgntgccgatggagtcncacaccatccgccacatgatcgaggatgactgcgcccgacacgntatccctctttctaacgtcaactccaagatcctatccaggggtatcgagtactgcaacaagnangtannatgcgccgncgncggccgccgcgcctcgaaggccgttccgacgacggtggtgccgcctccgccaacagaccgcccgctccggggaggacctcaagaactgggatggcgactccgtcaaggccgaccagcccacgcttttcaacctcatcttggtggaaactatctgaacatcaggggtctgctcgacctgacctgtcagattgttgctgacatgatcaaggcaagaccccaaa

SEQ ID NO: 30460 - DNA, 682 bp, Zea mays
  misc_feature: Ceres CLONE 1405958-F
  misc_feature: Encodes the peptide sequence at SEQ ID NO. 30461
  misc_feature (288)..(288): n is a, c, t, g, unknown, or other
  misc_feature (436)..(436): n is a, c, t, g, unknown, or other
  misc_feature (440)..(440): n is a, c, t, g, unknown, or other
  misc_feature (682)..(682): n is a, c, t, g, unknown, or other
aaagctggagctccccgcggtggcggccgctctagaactagtggatcccccgggctgcaggaattcgcacgagaccattacctagaacatcctaatcgaaaaaagtcacgagaaaggtttcgcttcgaaactcaaccggagatggcgagctctggcggaatctccgaccagctcttcgtctccgtcaagttagagagcccgcacctcgcggagctcgacctcgccccccacctcttcggctcccaccctgtggctggctcgtgggacccctggcaggccctgcctttnggagcggcggccaccgccgtgtgggagttcagctgcgtcgtgccttcgcagcacgaatcgctggatttcagtttgttttgaagcgaaaggtgataatcctcatacattattgaggagggacctaccgacccattgggtgcagagaaantganttgagatggggatgcgttgttaaaactcacgaagggaaggagtacttgagtgcaggttcagggtgagacagaatgttatccccaattgacttggcggctagttggagagctcatcaggagtattttcagcccccaagggtgcgggggactcacgatgtcactatccaacctgggtttaaaaggagggcccagaatggcttcccttctgggttggaggctgatttaaacaagtatgtagttcn

SEQ ID NO: 30461 - protein, 75 aa, Zea mays
  misc_feature: Ceres CLONE 1405958-F
  misc_feature (49)..(49): Xaa is any aa, unknown, or other
MASSGGISDQLFVSVKLESPHLAELDLAPHLFGSHPVAGSWDPWQALPXGAAATAVWEFSCVVPSQHESLDFSLF

SEQ ID NO: 30462 - DNA, 690 bp, Zea mays
  misc_feature: Ceres CLONE 1405959-F
  misc_feature: Translation starting site: 230
  misc_feature: Pfam Name: CRAL_TRIO_N Pfam Description: CRAL/TRIO, N-terminus
  misc_feature (1)..(1): n is a, c, t, g, unknown, or other
  misc_feature (6)..(6): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (20)..(20): n is a, c, t, g, unknown, or other
  misc_feature (112)..(112): n is a, c, t, g, unknown, or other
nggggnggggnnnnaaccgntggggagaggggggagggggggggggggggaaagggtgtgcagggtggggctccccgcggtggcggccgctctagaactagtggatcccccngggctgcaggaattcgcacgagaccattacctagaacatcctaatcgaaaacagcatcgccgccccccctctccgcctcaaggctctcctctcggaggtctgataggcaacccaataatggcagaagtcctatcaggatctcatgaacaccgtctaagctctgccttagatggacactacgacgagaagaggaaatccaatgtggaatacacagaggacgagaagaaagccgtgatcgcggctctgaaaaagaaggctttgagcgcctcacagaagtttaggcattccatgaagaggggggaggaagagcagcaaaggtgatgtccatctcgattctggatgagcgtgaacctgaggaggtgcagggctggggatgccttccgccagcttcttgtacttggaagaggtgctaccatcgcagcatgatgactaccacatgagggttaagatttctcaaggcaagaaaagtttgatatcgagaaagaaaaggaaaagggggcctgaaatgctgaagggaaaaaaaagaaagttccggggaaaaaaccatttctcgagggaattcaaattccaaaaaacct

SEQ ID NO: 30463 - DNA, 583 bp, Zea mays
  misc_feature: Ceres CLONE 1405961-F
  misc_feature: SWISSPROT Homolog: EC 4.1.1.19 Arginine decarboxylase
cgggctgcaggaattcgcacgagaccattacctagaacatcctaatcgaaaacacggcactaaagtctattcatctctggatccccaaattcagctggagagcactttttcccatcatggataagaactacggtgaactctacaacatcctcggatgggggtgaggagtacttcgcgtggaacacggaggggcacctcagcgtgaagcctttcggccgctggacgtagcccgggcaggagatcgacgtgcactcggtcatcgtggaagctctagcgaccccaacccaaggacagcaccaggcaaatctcagtttcccatgatccttcgctttccccgacgtgctcaaaaaccgtaatcggagaggctccataacgatttcacaggcccatggagtccccggtaacacgccaggaaacaagggggggttccccaacaaggggaacaaaaaaaggcactcgggtaaagaaatgtgttaggtaccgacaaaatatgtaatcatggggcccctagagatgctatataactacaaattgtgtcccgattaaggctcttgccccccctgtatcgcaacccagttcccaa

SEQ ID NO: 30464 - DNA, 648 bp, Zea mays
  misc_feature: Ceres CLONE 1405962-F
  misc_feature (356)..(356): n is a, c, t, g, unknown, or other
  misc_feature (429)..(429): n is a, c, t, g, unknown, or other
  misc_feature (443)..(443): n is a, c, t, g, unknown, or other
  misc_feature (484)..(484): n is a, c, t, g, unknown, or other
  misc_feature (489)..(489): n is a, c, t, g, unknown, or other
tccccgcggtggcggccgctctagaactagtggatcccccgggctgcaggaattcgcacgagaccattacctagaacatcctaatcgaaaaatgctgggaccgcgggtgtgggatagggacggatgacaaagcaagagcagaaaaaagaactttcaccatcctccctatcaatacaagattcatctacacaaattataatatactccgtgcgaaggaaagatcaaattagagattcattcgatcaattctgattgtttccttccattcaaaccaccttcaattctgatttcctgcgggtgtggggatatcgtccccccttgccattccaaatcctcctctgcaattttctcatggnaagctgacgtttccatcccaactccgatccgcgtcaaccgcccgctaattcctccctaggtccagtcccctcntctcctgcgccgantcatctttttttctcgggtcactcccctgctgttgctgttnccggnaaaatcaaatcccgtcaaggtcaaaaggagcaaaagggtctgggaaaatggcaggcccaagaggaaggcaccttttcccccttggtttttttggaggattagcccacgggcaagtggggggttccaaagggggatcagggcgaaaaccaacttgggggg

SEQ ID NO: 30465 - DNA, 595 bp, Zea mays
  misc_feature: Ceres CLONE 1405963-F
  misc_feature (100)..(100): n is a, c, t, g, unknown, or other
  misc_feature (135)..(135): n is a, c, t, g, unknown, or other
tggagctccccgcggtggcggccgctctagaatagtggatcccccgggctgcaggaattcgcacgagaccattacctagaacatcctaatcgaaaaacancgagagagactgcggcagcggagtgcagagagcgnacgcaacgcaacaacgcccactctctatcactgacgatcgaagcgaggaaggcactgaaaccgccgcccaagaatcccctcccccggggagaaccctggccccggccccggaaatggaccctttgggggggggggcagggggttgaaaccccgcattttcaggaggggtcccccaaaaagttttcggtcccccccccggagaagggaaaatttttggggggggattgggaaaaaatcctttaatggggaaaggaaaaaccccccccccccagggggggaaatttccccccgggggggggggggggggaaaaaaaaaaaaaaaccccccgcggaggagtttttataagggcgcgggggggggtgttcccccccccttatttttccccaaagaaaaccccccgtggggagaaaaaaaaatcaaaaaaagggggttttttggttgcccccccccccccctatt

SEQ ID NO: 30466 - DNA, 872 bp, Zea mays
  misc_feature: Ceres CLONE 1405965-F
  misc_feature (11)..(11): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
ggccccccccncnncnccnnncccacccccgnnnaatattttnnnnnntcaaagctggagctccaccgcggtggcggccgctctagaactagtggatcccccgggctgcaggaattcgcacgagaccattacctagaacatcctaatcaaaaaaattcatcttcttcgtcttcatcgcagcatcggcgctccatcttctgctccctcccccacttcgtgctcgggttccatcttccgctccttcccccactcgcggtcggcacgcaggctcggccggcgtcaggggctccccatcccgcagtacaggaagaggccgcccgctggagctcgcgggaggtagcgtccccgccgccgcatggaggccccgaatggctgaatccctgacccgttgcctggaagaagcctcgcggctaaatcacattcatatttgagccttcctcgcctttgggatcccgtctttattaatttgcctccccacctgaaaaaattaagttttggcactttgggagggaaaaatggaggggggtggctcccccaaaagagggtttgcctcggaaggaaaagggtaacttcacctcccacccccccaaccaaaaaacgccccctttgggggatggaccagcccagcttttggatatttccgggggccccgggggaaaaatattttattccaggtccccgggtgggaaaagtgaattttcccagtgggttcctttctcgaaaccatggatgggataaaatttttcccaaaaatttttcaccgcgtggggggaagtctcccgtggaaggaataaaaaagtgcatttttggacccattcggggagggctggtgttggccccccccataacctttgtgctggtgtacaccccct

SEQ ID NO: 30467 - DNA, 663 bp, Zea mays
  misc_feature: Ceres CLONE 1405968-F
  misc_feature: Encodes the peptide sequence at SEQ ID NO. 30468
  misc_feature (207)..(207): n is a, c, t, g, unknown, or other
  misc_feature (208)..(208): n is a, c, t, g, unknown, or other
  misc_feature (226)..(226): n is a, c, t, g, unknown, or other
  misc_feature (251)..(251): n is a, c, t, g, unknown, or other
  misc_feature (252)..(252): n is a, c, t, g, unknown, or other
  misc_feature (258)..(258): n is a, c, t, g, unknown, or other
  misc_feature (279)..(279): n is a, c, t, g, unknown, or other
aagctggagctcaccgcggtggcggccgctctagaactagtggatcccccgggctgcaggaattcgcacgagaccattacctagaacatcctaatcgaaaaccctttccttccgccgcccaaatgccagtggccaccttcctcctcgtcgcgcttctctcgtgcggcgcacgagccatccggacgcacggcggctatgtctccgcgnntcgggacccggcatgcgncgcgaggcctccgcgtggcatgggnnagcgtnaaacttctgcaacgagtcggncaggaggcccccggcatgggaggcccccggggtggcgaattgttcgatcttctcgagacagctccgacaaggaaggggccggccggggtaatccgggggccaacctggggagcgaacaccacaaccgcctgggcgcgggggaacgcttccccgggtccccccccggggggggccccggttcagaaagccaaactttaatggccggggaaagaggtgttacctaaaggaacccctgcccggggggccacaaccccgcggccccgggggatttttgggggtgctatggcaaaaaaaaaggaaattttaaagacaccccccgccgcctctggtggaaaaaaaaacccccccccccaggccctttttcacaaaaaattccccttttct

SEQ ID NO: 30468 - protein, 126 aa, Zea mays
  misc_feature: Ceres CLONE 1405968-F
  misc_feature (29)..(29): Xaa is any aa, unknown, or other
  misc_feature (35)..(35): Xaa is any aa, unknown, or other
  misc_feature (44)..(44): Xaa is any aa, unknown, or other
  misc_feature (46)..(46): Xaa is any aa, unknown, or other
  misc_feature (53)..(53): Xaa is any aa, unknown, or other
MPVATFLLVALLSCGARAIRTHGGYVSAXRDPACXARPPRGMGXRXTSATSRXGGPRHGRPPGWRIVRSSRDSSDKEGAGRGNPGANLGSEHHNRLGAGERFPGSPPGGGPGSESQTLMAGERGVT

SEQ ID NO: 30469 - DNA, 641 bp, Zea mays
  misc_feature: Ceres CLONE 1405969-F
  misc_feature: Encodes the peptide sequence at SEQ ID NO. 30470
  misc_feature (326)..(326): n is a, c, t, g, unknown, or other
aaagctggagctccccgcggtggcggccgctctagaatagtggatcccccgggctgcaggaattcgcacgagaccattacctagaacatcctaatcgaaaaaaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagcaaatggtttctggtgcgggtcatggtgggtacggcggcggcgacgacgggcaggccgtcgacttccggggcaaccgggnggacagtcgaggaccgaaggctgcctgggcgcccggctgatcctgggcacgaacctggccgaaccccgtgtgcgtgattggcatcttcatgaaccctgtgggacgacctcgtcgggggaagtgcacttttccaaatccaaggccggcaaccggggtggaccaatttcatggggcacggttaaacctggttcccccctcgtgggggggttccctccccccaaacccaaagtttgggcgcgtaaccttaaccattggcatttttcccccaaaattcccccccccaggggggtggaaattttttttaaaccgggggaa

SEQ ID NO: 30470 - protein, 38 aa, Zea mays
  misc_feature: Ceres CLONE 1405969-F
  misc_feature (26)..(26): Xaa is any aa, unknown, or other
MVSGAGHGGYGGGDDGQAVDFRGNRXDSRGPKAAWAPG

SEQ ID NO: 30471 - DNA, 647 bp, Zea mays
  misc_feature: Ceres CLONE 1405971-F
  misc_feature (217)..(217): n is a, c, t, g, unknown, or other
  misc_feature (238)..(238): n is a, c, t, g, unknown, or other
  misc_feature (250)..(250): n is a, c, t, g, unknown, or other
gctctagaactagtggatcccccgggctgcaggaattcgcacgagaccattacctagaacatcctaatcgaaaaaaaaaaaccaacgctccccctgcccccctctttcctccccagacccgcgctcccctccgtggcgtgcaacgcgttcctcggctcctgcaggcggcgacctcggaaaggcgggggcgtctcgtcgcgaggcatttgaggccagnatttttttgtgctctcattgntagctgactggntgagggtctggatctagcaatgggcgaaaacaccccaccgtagtgggtcgccacgtggttggggacctggacaaatgttatttgcaagcgagcagccacatcaaatctggaggaagaagaaaggtggggaataaaaacccaacgggattgaaaaaaaatgggactaaggaaagaggcccatggcaatgcaaaaattaacaggatttggggaaagggaatgtgatttgggccactttggtttgaagagattggcccaaaaaaaaaatttcaaaagcctttttttttttcaaaaaaaaaagggggccaaccacataggtgggcgaaaaagggggggttcttttccccgggaaacccatggcccctaaaaaacccttttgtttcatcgggggcattaaaa

SEQ ID NO: 30472 - DNA, 674 bp, Zea mays
  misc_feature: Ceres CLONE 1405972-F
  misc_feature: Encodes the peptide sequence at SEQ ID NO. 30473
  misc_feature (314)..(314): n is a, c, t, g, unknown, or other
  misc_feature (362)..(362): n is a, c, t, g, unknown, or other
  misc_feature (409)..(409): n is a, c, t, g, unknown, or other
  misc_feature (410)..(410): n is a, c, t, g, unknown, or other
  misc_feature (470)..(470): n is a, c, t, g, unknown, or other
  misc_feature (535)..(535): n is a, c, t, g, unknown, or other
tggagctccccgcggtggcggccgctctagaatagtggatcccccgggctgcaggaattcgcacgagaccattacctagaacatcctaatcaaaaaaacaatccagttctcctttcgccggaatctgtccctcctccccctcctccccgcctctgcgggtactggaccaccgtggagcgggcattcatccaggctaggtccattccttcctttgctcgtaagtgaccctgatttttgctctacgagtttgtttcgtgctccattgaaatctaatcccactccgcatttgcggattcatgccctactactattancacccctttcatccatccattcctcgactaggttctcttctccatcgncgaagctccaccccgagttgacgcagaagagaatcggtgccctaggnntgtctcgcagaattattttccagaaagattgcagatcgagtcgaaccctatgccccacgntaagcctggcgccgggctgccccctttacacacggggcgctccctggccccgggcaagggtcagntcccacgggacatggatgatgcaccgggaaggcccgggatccataccggcccgttggggccaggatcccctaacccccggtgggggaaggggcccctcccttccccctacgaatgggtgccccgcttgcccccacgggg

SEQ ID NO: 30473 - protein, 71 aa, Zea mays
  misc_feature: Ceres CLONE 1405972-F
  misc_feature (4)..(4): Xaa is any aa, unknown, or other
  misc_feature (26)..(26): Xaa is any aa, unknown, or other
MPHXKPGAGLPPLHTGRSLAPGKGQXPRDMDDAPGRPGIHTGPLGPGSPNPRWGKGPLPSPYEWVPRLPPR

SEQ ID NO: 30474 - DNA, 677 bp, Zea mays
  misc_feature: Ceres CLONE 1405974-F
  misc_feature: Encodes the peptide sequence at SEQ ID NO. 30475
tggagctccccgcggtggcggccgctctagaactagtggatcccccgggctgcaggaattcgcacgagaccattacctagaaacatcctaatcgaaaaaaccaacccctcaaacggttaaacccatgccgctaatcgacgccgccgcctcggcggtcgcgccgcccccaccccggcgagtggctcaactccgcttcttcagcactcgcagacccggaatcctatccctaactgccaccagctgctccccctcccctccgcccccggtcgctgcggaggtgcctgcgccgccacaggaagcgaagtcgaagccaggccacggcggtacccgaagcagtaccccggcgagtcggtgggcgttgctgaggagatgcgctttgtcgccatgcgcctgcgtaaccccaagcgcaccaccataaaagacaagtcggggacggaggacgcggacgccggggcgggggttgtcggagggcgaagctgaggaagacgacggcggcggcgtgaagggagaacaccagggagaagatgagggccagctccaggaaggggatggatgcccagcattggagggttcgggcgatacctgggggacagaaggctcgtcttcggacccaccaaggggtccgtggccaatccaccgatggccccaatgttacttcaggaaaaaggggtttgaag

SEQ ID NO: 30475 - protein, 36 aa, Zea mays
  misc_feature: Ceres CLONE 1405974-F
MRFVAMRLRNPKRTTIKDKSGTEDADAGAGVVGGRS

SEQ ID NO: 30476 - DNA, 856 bp, Zea mays
  misc_feature: Ceres CLONE 1405984-F
  misc_feature (1)..(1): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (832)..(832): n is a, c, t, g, unknown, or other
nccccccccccccnnnnccccacccccccccccntnnnnagaaaaaaaacaaactggagctccaccgcggtggcggccgctctagaactagtggatcccccgggctgcaggaattcgcacgagaccattacctagaacatcctaatcaaaaaaccaggcaagcaagcgggagccgccaactcgtgcctctcggcagcggcgtctgaactctgaaccgaccgaccgaccgaccgttccgttccgttcaccccaccatggaggcgccgccgggaccggggcccatggagctggacgccccacctcccgccgccgccgccgcggggattcctcccgccggcaggcgacaagcacaaggacggggaaagggggagacgctgtgacgggccatatcatctccacccacattcggcggggaaaaacggcgagccccaagcgggaccattcagtttacatgggcaaaaaccgggtccgtggggccacagggttccattttgggaagcggcccttcccaggccttaagggggccctgagaaaccagggaaaagaccctttccccccaattcaaaaaaagggtggccttgccaaagaaatcgggcgggttaaccaagaaaacccggagaagcttgcaaaacttttatgggcggtgcccatgggaggccaccccccaagcggtcattctctgccttgaaaagcacttggctttctttcctctgaaaaacgaagcgagggtaccaaaattggtttttttaaacccttggtgcatggggaattcccgcccctggaaaactcctattcacccgaggccctggaagcacttaccggcaaggggcgnaaccggaaggagggccccctttat

SEQ ID NO: 30477 - DNA, 708 bp, Zea mays
  misc_feature: Ceres CLONE 1405988-F
  misc_feature: Encodes the peptide sequence at SEQ ID NO. 30478
cagagctggagctccccgcggtggcggccgctctagaactagtggatcccccgggctgcaggaattcgcacgagaccattacctagaacatcctaatcaaaaaagaatatcgcagcgccgctccgtcctccgccgatactcccgggcccgccccgtctgggatcgaggaatcagacacatctcactaatctctcctaggaccgagcggacttacatccacggcgtaacgcacatcgtcgtccgagtcctcgcggtctctcggctcccctgctgcgagaggacgccggcagtagcgccgcggcatgtgcggcggcttggcgggggaagaccggaggcggtggcagagctcgcgcccaaaggagcacggcaggactgctctcggcgtcggctgccggaaggcgatgtacccctcgtcgaaggacgagagaataatcatgaggtcgaactgccctttcgcggcagccaccactggtgggggtgtatgccctgtgaaatctgataagagcaacactggggtgtgccctgcaaaatctgacaagagcatcagtggtgtatgccctgtcactggcaaggatcatggtagcaagctcaaggaaagtggtgatcatggtgaagaaaagggcaccgatcctcgtgtcgtaccagcaaaatgcccattcggctatgactccaacactttcaagctgggtccgcttagctgcattgtct

SEQ ID NO: 30478 - protein, 91 aa, Zea mays
  misc_feature: Ceres CLONE 1405988-F
MRSNCPFAAATTGGGVCPVKSDKSNTGVCPAKSDKSISGVCPVTGKDHGSKLKESGDHGEEKGTDPRVVPAKCPFGYDSNTFKLGPLSCIV

SEQ ID NO: 30479 - DNA, 498 bp, Zea mays
  misc_feature: Ceres CLONE 1405989-F
  misc_feature (256)..(256): n is a, c, t, g, unknown, or other
tggagctccccgcggtggcggccgctctagaactagtggatcccccgggctgcaggaattcgcacgagaccattacctagaacatcctaatcgaaaaaagctactaagtaataaaaccacgcgggcaccagcaggcagcagctagctagccatccagtccagagatggccacgagcggccccgtccttctggtctcgcaggcgcagcagcgcaagtcacggacctacaccccgagcccatggggtgacttcttccntccacacggtccatgcactccgtcacagctcttggccatggagggaaagggcaaagggccaggggggcaaacaaggggggggaaagggttacccccaaaaagggtggccctccccccaaaacggtgttttaaaaaaaaagagaattcttggggaaacaccaaaaaaggcccccggggggggccccccccccccccccggggggaaccccccccgtgttttttttttttttaaaaaaaaacaa

SEQ ID NO: 30480 - DNA, 680 bp, Zea mays
  misc_feature: Ceres CLONE 1405992-F
  misc_feature: Encodes the peptide sequence at SEQ ID NO. 30481
caaagctggagctccccgcggtggcggccgctctagaactagtggatcccccgggctgcaggaattcgcacgagaccattacctagaacatcctaatcgaaaagtgtatcgcggaattttttgggttctcgggctccgccgcgatcccatccccatccccgccttgccgttgccgttgccggcccccccggttctcccggagctttctttctggccggcgcagtagagaagcaagacagaattgcggcggcgcctgcccgcgcaaaggaaataatcagcactgtttgccaaagcagctcctgacgcatggctagtacttaaggatactttatgtgcagaccatgaagatagatgacgaaaagccttaccaaactcatatttttcatgatcttgcatctaacggcagtcctaaattagactgtgaggctgaaagacaaagtaatcacaaggttgaggcagataaaatggttgagcaaaccaatcaatctgaagttagctttgtgaaaggtgagcatctgaatggagtaaaattcggaaacacgcattgaggattactctatgacaagatgttggagagacaaactgccagaccagatctttctctggatacggtgtccattttgcaaggatgctgcattgatgaggagtcttccagatcaaagatttcatcaaaaagcagg

SEQ ID NO: 30481 - protein, 68 aa, Zea mays
  misc_feature: Ceres CLONE 1405992-F
MKIDDEKPYQTHIFHDLASNGSPKLDCEAERQSNHKVEADKMVEQTNQSEVSFVKGEHLNGVKFGNTH

SEQ ID NO: 30482 - DNA, 704 bp, Zea mays
  misc_feature: Ceres CLONE 1405993-F
  misc_feature (489)..(489): n is a, c, t, g, unknown, or other
  misc_feature (509)..(509): n is a, c, t, g, unknown, or other
  misc_feature (610)..(610): n is a, c, t, g, unknown, or other
  misc_feature (667)..(667): n is a, c, t, g, unknown, or other
  misc_feature (668)..(668): n is a, c, t, g, unknown, or other
cagagctggagctccccgcggtggcggccgctctagaactagtggatcccccgggctgcaggaattcgcacgagaccattacctagaacatcctaatcaaaaagagggcgcgcattactctgcagcgcggacacgcccggcacggcaagccagccactcttctcgcgtgaagctgccaggacgagagagagagaggaggaggattagcttagccattcttgcggctgggcaaggaaactgctgaagccactagccggctgcctgctctacttcctccgaaccgaacgaggtgcatcgtgaggaagcagcagcagggggggcagtggccgggcgggatgacggtgagggaggacgtgtgggcgccgcaggcggagctggatcaggactcgacgggggaggcggagaccgcgctgctgagcccgctcagcgagacattgcgccgattcagggcggccgccgcggtgggcggagtccccgtcactgaacggntggcccccctggggggtcgngtcctccccttgaccaatgcgtaccccttccgcttccccgaaggccgggtatggtcgggcttcaagagggcaccccgaatccgcgggcccatgcccggggnaccaggggggcccccccgggttctgaaaacgaaaaccagtggttgagccaacaaggnnaagggggaatcaacacgaaaaaacgcgtccaaggta

SEQ ID NO: 30483 - DNA, 694 bp, Zea mays
  misc_feature: Ceres CLONE 1405994-F
  misc_feature (494)..(494): n is a, c, t, g, unknown, or other
aaagctggagctccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaatcaatttcttcgtccgccttcgcccctgcttacgtccccgctactaaccctaggatcattctgtcttttctcgtttcttatccgactcttcttcgttttatgcctatcaggtatgaggttgaacgccttcagaagcttctctactagattagtgtaaatagtagacttgttcgagnttagcttggctggaagaattagtctctggcccgtgttatatctgctagcaatatggctgcaatgaacggagagtattgggtgaatgtggaaggacataaatagtctcaagagaaggcggagagccccgctgctatgctgctggcgtattctgcacctctgaattgcatcacatactgccaatgatcctgctggtaggttt

SEQ ID NO: 30484 - DNA, 808 bp, Zea mays
  misc_feature: Ceres CLONE 1405996-F
  misc_feature (1)..(1): n is a, c, t, g, unknown, or other
  misc_feature (2)..(2): n is a, c, t, g, unknown, or other
  misc_feature (11)..(11): n is a, c, t, g, unknown, or other
  misc_feature (12)..(12): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
nncccccaaannccccannnnccggcggacctgnnncgctttgtgcgatagctggagctccccgcggtggcggccgctctagaactagtggatcccccgggctgcaggaattcgcacgagaccattacctagaacatcctaatcgaaaaacacactccactccacgtccccctccttcaaatcctttcaacacccaagcacaaggagagagaagccgccgccgccgccatggacaatattgaggtgaggaggaggaagaagaaagggagaagcagcggacgccgcccgggggggacgggtacaggcggtcctgcgcgccggcctcgtcgccatggccttcgccctcctctgcctctgctcctccacgccctccgccattgccctcaccccagacggcggagccgttgctggagctcaagttggccttcaacgccaccgtgcagcggctcaaccagctgggggtcccagcgaacccccaacccctggggctggggagggcatctccctggctccggccctggaactccagggcccatccataaaaccctccccattcatggaaggttcggggggcatcattttccccccaagaaccggggagggctccggacaaagcctgcaaaagacttagctcctgccaccagaaaaaagcttggccaggccccaaatcccctggcaaagagaccaaaaaacggccacccgaagtctccgggggcaattttaaccctgagaaagccaacttaccctggggagggagagacttcccccttacaaaaaatttggggggaacttccgtgacccccttcac

SEQ ID NO: 30485 - DNA, 616 bp, Zea mays
  misc_feature: Ceres CLONE 1405997-F
  misc_feature (90)..(90): n is a, c, t, g, unknown, or other
  misc_feature (406)..(406): n is a, c, t, g, unknown, or other
tccccgcggtggcggccgctctagaactagtggatcccccgggctgcaggaattcgcacgagaccattacctagaacatcctaatcgaanagctggtgcttctacggggcctggcgatttgaattcgagtggtgcgtgtatagagcgtgagagagagaaagagagtgcctcttgcgctctgcagtcccagtcttggatccagagctgcgattcgtgctcgcctgacgccgatgggccgaaccctgagcccccttgtacggagggagttggacaacctggacaaggacctttaaaccccccccgcccccttgaagggctcaagtcttaacccaaaaccttggatcccaaggcattccccgatttctccgcggggggttccaaacccccccggggggggcgcggggcnaaaaaggatttccccccccggggaatttccccctcccccccccccccccgggtggggggggcggggcccaaaattttttgccgaaaaaaggaaaatttttggccccccccctgtgggccgcccctccccccgcggggggttcctttttccccctccccccagcctttgtctccagggggggcccccctcccccctcccgcggggcttccg

SEQ ID NO: 30486 - DNA, 688 bp, Zea mays
  misc_feature: Ceres CLONE 1405998-F
  misc_feature: Encodes the peptide sequence at SEQ ID NO. 30487
  misc_feature (439)..(439): n is a, c, t, g, unknown, or other
  misc_feature (512)..(512): n is a, c, t, g, unknown, or other
  misc_feature (523)..(523): n is a, c, t, g, unknown, or other
cagagctggagctccccgcggtggcggccgctctagaactagtggatcccccgggctgcaggaattcgcacgagaccattacctagaaacttccttagctaacttcccagccccgacaccttggccgccgctccgtgcgcacccagttgctgaggttgcaacgctgcagccggcgaggatcggatgaaccaccaacccctcctataaatcctaaccgagtcctctgcttctgctctcatccatctgtagagtgcaacatgcagtgccccatggacactgctgctagtggaacctcgccagtgatgcaattccatagcaatgctgatgagtctatcgcccattcatctccattggcaacattaatacaacgttcacagcgccattgctatggggatggatccccaggcgaatttccccttgctgtgagcccctccattgntctccatgtgctctcatcttgtgatctaggtccgaaagatctcgccaatctgggagctacatgcgtatttttncgcaaacctgncagttttgcaccaaactttgcattgtcacttccggagctttgcggcattgatatgtgccagaaaaggaccatgttttagcagatgaagcaagaagatcaggagtgtctgaaacaaccgtggtggaagctcttggaagcatggtcttgggaaacttccgggtaggg

SEQ ID NO: 30487 - protein, 114 aa, Zea mays
  misc_feature: Ceres CLONE 1405998-F
  misc_feature (61)..(61): Xaa is any aa, unknown, or other
  misc_feature (85)..(85): Xaa is any aa, unknown, or other
  misc_feature (89)..(89): Xaa is any aa, unknown, or other
MQCPMDTAASGTSPVMQFHSNADESIAHSSPLATLIQRSQRHCYGDGSPGEFPLAVSPSIXLHVLSSCDLGPKDLANLGATCVFXRKPXSFAPNFALSLPELCGIDMCQKRTMF

SEQ ID NO: 30488 - DNA, 647 bp, Zea mays
  misc_feature: Ceres CLONE 1405999-F
  misc_feature: Encodes the peptide sequence at SEQ ID NO. 30489
  misc_feature (285)..(285): n is a, c, t, g, unknown, or other
  misc_feature (295)..(295): n is a, c, t, g, unknown, or other
aagctggagctccccgcggtggcggccgctctagaatagtggatcccccgggctgcaggaattcgcacgagaccattacctagaacatcctaatcgaaaaatccaaaattccccaaaccccctcccaagtcccaaccctagccggctagcctccttccccttcagccttcacacctccgatttctcgcgccttcgtctcccgcccaatttccagaagcttctagaaccaggggttctaccctaccgcagaatgatgctttcctgcgcctagtagcctgggggcgnagcatggacngcggccggggaggggggctccagccggcggaaggttccctattctgcaggcgaaccggggaccccaagtccaattgggaaggtggaccgtgccaaaaaccctcaaggattcctggttcagaactgccccgggaaggctcccggggaggacgggccccctttggtaatttggccgaggggggtttttaaccccggggtcgggttaaggggacaggaggaagggggggaactttgaccccggggggggttcccccgtaaaagacccccccccaaaaaaaaaagggacaacgggaaagggggcctcttttttttaaaaaaaacccccctggtttttccccggggggaaaaaaaga

SEQ ID NO: 30489 - protein, 64 aa, Zea mays
  misc_feature: Ceres CLONE 1405999-F
  misc_feature (3)..(3): Xaa is any aa, unknown, or other
MDXGRGGGLQPAEGSLFCRRTGDPKSNWEGGPCQKPSRIPGSELPREGSRGGRAPFGNLAEGGF

SEQ ID NO: 30490 - DNA, 719 bp, Zea mays
  misc_feature: Ceres CLONE 1406002-F
  misc_feature: Encodes the peptide sequence at SEQ ID NO. 30491
  misc_feature (379)..(379): n is a, c, t, g, unknown, or other
  misc_feature (445)..(445): n is a, c, t, g, unknown, or other
  misc_feature (449)..(449): n is a, c, t, g, unknown, or other
  misc_feature (490)..(490): n is a, c, t, g, unknown, or other
  misc_feature (504)..(504): n is a, c, t, g, unknown, or other
  misc_feature (579)..(579): n is a, c, t, g, unknown, or other
  misc_feature (586)..(586): n is a, c, t, g, unknown, or other
caaagctggagctccccgcggtggcggccgctctagaactagtggatcccccgggctgcaggaattcgcacgagaccattacctagaacatcctaatcgaaaaatcgcgggctcacatagcaccgcacagctgaggtgcagtttctactagcagcaatatcatggattctgaggtagtgcatgtggtagagtcgtcgtttgtagtgccgagcgagccgacaccgtcggaggggctctcgctctctccgctggacctcgttctgcccagcagaggccacaccccaacagtctacctgtacagccccagcgatgttgccgccgccgatggtttcttcgacgtggccaggctcaaggaggctatggccaagaccttggtggncttctaccccctcgctggccgcctcggcgtcaacaacgattggcagggtagagatcacctgcaccnggcnagggcgcacttctttgtggtcgctcatgctgacctcagtgnttgtgacatcgagnacgactttcagccgtcgccggaactgaaggaggcttggttgttccatgcattgagccagcatccatcaaattggnccatacngatgactttctccaatttccgaggttgggggttagggaacgtttttcaccattgccgccgggattgcctcaagggggtccactttttttcaaaaggggcaccctgtggcaaattggccaccccccaaccctga

SEQ ID NO: 30491 - protein, 185 aa, Zea mays
  misc_feature: Ceres CLONE 1406002-F
  misc_feature (73)..(73): Xaa is any aa, unknown, or other
  misc_feature (95)..(95): Xaa is any aa, unknown, or other
  misc_feature (110)..(110): Xaa is any aa, unknown, or other
  misc_feature (115)..(115): Xaa is any aa, unknown, or other
  misc_feature (140)..(140): Xaa is any aa, unknown, or other
  misc_feature (142)..(142): Xaa is any aa, unknown, or other
MDSEVVHVVESSFVVPSEPTPSEGLSLSPLDLVLPSRGHTPTVYLYSPSDVAAADGFFDVARLKEAMAKTLVXFYPLAGRLGVNNDWQGRDHLHXARAHFFVVAHADLSXCDIEXDFQPSPELKEAWLFHALSQHPSNWXIXMTFSNFRGWGLGNVFHHCRRDCLKGVHFFSKGAPCGKLATPQP

SEQ ID NO: 30492 - DNA, 569 bp, Zea mays
  misc_feature: Ceres CLONE 1406005-F
  misc_feature (155)..(155): n is a, c, t, g, unknown, or other
  misc_feature (180)..(180): n is a, c, t, g, unknown, or other
  misc_feature (194)..(194): n is a, c, t, g, unknown, or other
  misc_feature (211)..(211): n is a, c, t, g, unknown, or other
  misc_feature (228)..(228): n is a, c, t, g, unknown, or other
  misc_feature (230)..(230): n is a, c, t, g, unknown, or other
  misc_feature (274)..(274): n is a, c, t, g, unknown, or other
gctctagaactagtggatcccccgggctgcaggaattcgcacgagaccattacctagaacatcctaatcgaaaaattttttcatttcttccccccttctcgtcacgtccaagggggggaaaacttctttctctctcttttttttccctcccccgnccgaatctgatgcttaaaccctcgncgggaggaagattncaatccgagagaacagnccggggccggcactaangncgggccggatttccccatggccggccgggcgaacaagccagggncccgaaaaaggggggttccctgaatttgaaacccgatggaaataaccctccaaaggggaaagccagggacaattttttttggaaggaaatgggttaagggatgggcgggggggggtttttgaaaaccaaaaaggccccaaaaagattttttttttggaaaaaagggaaaaacttttttccaacaaaaagggggggtgccccccccccccccctttttcgggggggaaataaacctttggaaaggggggggaatcccctttgggggggggggggggcgggctcccctccccccccg

SEQ ID NO: 30493 - DNA, 901 bp, Zea mays
  misc_feature: Ceres CLONE 1406006-F
  misc_feature (1)..(1): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (28)..(28): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (901)..(901): n is a, c, t, g, unknown, or other
nccccccccccannncccccccacaaangaannnnnnnttaaannnaacagaactggagctccccgcggtggcggccgctctagaactagtggatcccccgggctgcaggaattcgcacgagaccattacctagaacatcctaatcgaaaaagacaaccaaacgaaccctcccggagcagcaaagcataggcgctcgagcgctccctcccgagctcctccgcctcacggtcacgcctcgtgtccccccaccccctcctcctcctcctcggacggccgcctcacgccgtcacctccgctcggggagtctcggctccgaccgctgccgccacgtgcgacctcccctactcctgagagatctgcgaggcctcggcatggggtgaccagaatcggcccgctggtcggtggttttccaacttgaatccctgccccgcacctccgggtccggaaggaagcgaaacaatgggcgggaaggcccggccggggcgcaccgcgggctccaggggaagccgcttgggccggatggcttttgggtcccaggggaaaactcccggggccattggctttgggggcgtgggggcccccgctttcgggcccacccaatggggcccccccgccccaaaggggcgaaaggctggggttttaaattaaaccttccccccccccggggtgggccattaaggggaaaaagcgcctttggaagacggggtcttacaggagacacaacaaaactttgggaaccaggcacctctgggcccttgttgggtcaaagagccaacccggaacaagaaatcccttctgggcagagggggggcgccaattggtaagaaaccttaaaaggctggaaaacctggttcctgggagaaaaattctaagtgctccaaaattttcgcccggccaacn

SEQ ID NO: 30494 - DNA, 691 bp, Zea mays
  misc_feature: Ceres CLONE 1406008-F
  misc_feature (208)..(208): n is a, c, t, g, unknown, or other
  misc_feature (211)..(211): n is a, c, t, g, unknown, or other
  misc_feature (212)..(212): n is a, c, t, g, unknown, or other
  misc_feature (227)..(227): n is a, c, t, g, unknown, or other
  misc_feature (228)..(228): n is a, c, t, g, unknown, or other
  misc_feature (259)..(259): n is a, c, t, g, unknown, or other
  misc_feature (283)..(283): n is a, c, t, g, unknown, or other
  misc_feature (287)..(287): n is a, c, t, g, unknown, or other
  misc_feature (303)..(303): n is a, c, t, g, unknown, or other
  misc_feature (321)..(321): n is a, c, t, g, unknown, or other
cagagctggagctccccgcggtggcggccgctctagaactagtggatcccccgggctgcaggaattcgcacgagaccattacctagaacatcctaatcaaaaatcgagctgagctgagcatcatggggtagtgtgtgtgtgaggcgatagagaagctagtgctcataaccaaccaccactcagtcctcctccctctaccttttccttncgnncgcgttctacttggnntctagaggagagagatctcgaacttccaggncgcatgcttcggttgctagctacnatgncgtgtgcgtagctgcngcagcctttgatcgatcnatcgatcctttgtgcggatgggcccgatcagtggagtcagctatcttaaacttccccgggccccctcccccccttgacgtacgccccaaaaaggggggtttaaaagaaaaccctaaagctggtttccaaaattggggttggctcctctggccacctggtttgactcctggaacgggaaaatacacatatatcccccacaacaaaaaagggccccctcctccttcttgtgaaaaacccggcggcggcggcgcccaaaaaaaagaggaacccaccccgtgaaccaaaccctttagcggagggggttttcccttttttccccaaaagattatggggaccaaaaaggtttttgtggggaaaggtggaacaaggg

SEQ ID NO: 30495 - DNA, 635 bp, Zea mays
  misc_feature: Ceres CLONE 1406010-F
  misc_feature: Encodes the peptide sequence at SEQ ID NO. 30496
  misc_feature (317)..(317): n is a, c, t, g, unknown, or other
  misc_feature (318)..(318): n is a, c, t, g, unknown, or other
  misc_feature (341)..(341): n is a, c, t, g, unknown, or other
  misc_feature (352)..(352): n is a, c, t, g, unknown, or other
  misc_feature (393)..(393): n is a, c, t, g, unknown, or other
  misc_feature (437)..(437): n is a, c, t, g, unknown, or other
  misc_feature (443)..(443): n is a, c, t, g, unknown, or other
  misc_feature (444)..(444): n is a, c, t, g, unknown, or other
aaagctggagctccccgcggtggcggccgctctagaactagtggatcccccgggctgcaggaattcgcacgagaccattacctagaacatcctaatcgaaaaaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccnnacgacaggggaaccgcaccacgncgtcctatgtncgcttcacccgacacgagcggctcatcggcgacgctgccangaaccccagtcgcatgaacccccaccaacacgtctttcgatgcnagcggnntgatcgggcagaggtctctgatccgtcagggcaaagtgacatgaagctatgggcgttcaaggtcatccagggccctggtgaccagcccatgattggaatgaacttacaaggccagggaaaacaattttgctgtttgagaaaaccccctccagggccctcatcaagaggaaaggaaattggtgaagccttac

SEQ ID NO: 30496 - protein, 138 aa, Zea mays
  misc_feature: Ceres CLONE 1406010-F
  misc_feature (33)..(33): Xaa is any aa, unknown, or other
  misc_feature (41)..(41): Xaa is any aa, unknown, or other
  misc_feature (58)..(58): Xaa is any aa, unknown, or other
  misc_feature (73)..(73): Xaa is any aa, unknown, or other
  misc_feature (75)..(75): Xaa is any aa, unknown, or other
MAKSEGPAIGIDLGTTYSCVGVWQHDRVEIIAXRQGNRTTXSYVRFTRHERLIGDAAXNPSRMNPHQHVFRCXRXDRAEVSDPSGQSDMKLWAFKVIQGPGDQPMIGMNLQGQGKQFCCLRKPPPGPSSRGKEIGEAL

SEQ ID NO: 30497 - DNA, 674 bp, Zea mays
  misc_feature: Ceres CLONE 1406013-F
  misc_feature: Encodes the peptide sequence at SEQ ID NO. 30498
  misc_feature (480)..(480): n is a, c, t, g, unknown, or other
  misc_feature (583)..(583): n is a, c, t, g, unknown, or other
  misc_feature (667)..(667): n is a, c, t, g, unknown, or other
tggagctccccgcggtggcggccgctctagaactagtggatcccccgggctgcaggaattcgcacgagaccattacctagaacatcctaatcgaaaaaactcgccgtctcgccagtcgccaccatctaaagccgcggctccaatcccaccgcaggacaggcaggcagagcgcgccccgcgccatttcagccatgtcgacgacgtcgtcgtcgtcgtcgtcgtcgtcgtcgtcgtcgttccagtggcgcccatgggtggcactctcctccatccccgtcgtcgtcggcgccacaacgagcgggcacggaggctcgcgcccggtgcctccgacctctttctcgacatccagctcccacagcacggcgcctcctacctggtcctgcccgagcgcatcataccggagccccagaattcgtattcaggccgccaccccttcaccatcctgtcccgctgctcccgacgcttcctcttcattgcggntgggggtacccgagccgagggcgtctcgaaccccgcctgcttcctcggcaacgcccaggccagcaccgccgtccgcctccccgacgtcccgccccacctcggngtcaacatcatactgcgaaacagcattgggctcatcgccgacccgggacacgtgggcattacatggtagcccagctccacccanctgcaag

SEQ ID NO: 30498 - protein, 133 aa, Zea mays
  misc_feature: Ceres CLONE 1406013-F
  misc_feature (77)..(77): Xaa is any aa, unknown, or other
MGGTLLHPRRRRRHNERARRLAPGASDLFLDIQLPQHGASYLVLPERIIPEPQNSYSGRHPFTILSRCSRRFLFIAXGGTRAEGVSNPACFLGNAQASTAVRLPDVPPHLGVNIILRNSIGLIADPGHVGITW

SEQ ID NO: 30499 - DNA, 698 bp, Zea mays
  misc_feature: Ceres CLONE 1406014-F
  misc_feature: Encodes the peptide sequence at SEQ ID NO. 30500
  misc_feature (368)..(368): n is a, c, t, g, unknown, or other
aaagctggagctccccgcggtggcggccgctctagaactagtggatcccccgggctgcaggaattcgcacgagaccattacctagaacatcctaaaaaaaaactatcggatcttgcgaaggcatcgtcctcttcgtctccttcgtcgtcctatcttataatcgcatttcgaaatccccaaacggaagcatcgccactcttccgaacctgaacaatcaccaccgttattaagaagatgatgcgctgcgctgcaacgggcggcgggtgcgtcgcttcgtggagcggcgatcggagattgccggcggtcaacccctgcagcgtgcggatgccgacgggcaacgatgggtggtgcgccggcctgaggtcgcnggcggcggatctcgccggcctcgagatggccaacctgcgcggcggcgtcggggggctcttccgcgcgagcccgcgctacgggcgcttgcaagccacgggggcagtggaccctgaagatattccatgggagaggttcaagttaaatcctcaggacatgttctgccatatgttggcggtgcttggtttgggggctattctgtttggttaccatcctgggggtgcccaaggcgccctttgataatccccccaaggtccttgggattggcgaaaatggtggttttgagggggggggtgggtaagcacctccttgggttggggcaacccaagggt

SEQ ID NO: 30500 - protein, 123 aa, Zea mays
  misc_feature: Ceres CLONE 1406014-F
  misc_feature (45)..(45): Xaa is any aa, unknown, or other
MMRCAATGGGCVASWSGDRRLPAVNPCSVRMPTGNDGWCAGLRSXAADLAGLEMANLRGGVGGLFRASPRYGRLQATGAVDPEDIPWERFKLNPQDMFCHMLAVLGLGAILFGYHPGGAQGAL

SEQ ID NO: 30501 - DNA, 651 bp, Zea mays
  misc_feature: Ceres CLONE 1406015-F
  misc_feature: Encodes the peptide sequence at SEQ ID NO. 30502
  misc_feature (446)..(446): n is a, c, t, g, unknown, or other
  misc_feature (447)..(447): n is a, c, t, g, unknown, or other
  misc_feature (481)..(481): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (513)..(513): n is a, c, t, g, unknown, or other
  misc_feature (520)..(520): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
gctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggaccatcgccaggtccgnnaaacgaaaggagttcatggaagcccttgctgccnggcgctgagtggcttgaaatggccagnnnccncgggggngggttttctactctgcctacctcgcgnnngaaaaaaaaaaaagttggccggggaccccccaagcaccacgaatgacgagccaaggtctcggggggggggaaggcccccaacggggggggggggggttccct

SEQ ID NO: 30502 - protein, 150 aa, Zea mays
  misc_feature: Ceres CLONE 1406015-F
  misc_feature (102)..(102): Xaa is any aa, unknown, or other
  misc_feature (122)..(122): Xaa is any aa, unknown, or other
  misc_feature (123)..(123): Xaa is any aa, unknown, or other
  misc_feature (124)..(124): Xaa is any aa, unknown, or other
  misc_feature (136)..(136): Xaa is any aa, unknown, or other
MASETETFAFQAEINQLLSLIINTFYSNKEIFLRELISNSSDALDKIRFESLTDKSKLDAQPELFIHLVPDKATNTLSIIDSGIGMTKSDLVNNLGPSPGPXNERSSWKPLLPGAEWLEMAXXXGGGFSTLPTSRXKKKKVGRGPPKHHE

SEQ ID NO: 30503 - DNA, 637 bp, Zea mays
  misc_feature: Ceres CLONE 1406018-F
  misc_feature: Translation starting site: 253
  misc_feature (294)..(294): n is a, c, t, g, unknown, or other
  misc_feature (295)..(295): n is a, c, t, g, unknown, or other
  misc_feature (372)..(372): n is a, c, t, g, unknown, or other
aaagctggagctccccgcggtgggcggccgctctagaactagtggatcccccgggctgcaggaattcgcacgagaccattacctagaacatcctaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatggcggcggcgccagcgctcgcgcgagagctgctgaacgcnngcgcggagccggagttcgcggagtggcagcgcggcgtgcggcgccggatccaccagcacccggagctggccttcagnagcaccgcaccagcgcgctcgtgcgcgccgagctcgacgcgatcggcgtcccgtacgcctggcccgtcccgcagaggggcgtcgtggccaccatcaccgggcccgccgggggccccgtgttcgggctccgggccaacatgaacgcccttcccatccaggaaatggaaaaatgggagtccaaaaccaaagaaaaacggaaaaatggttgggttggggccatggacgcccagggggggatgtttcttggaaaagtaaggttgcttcc

SEQ ID NO: 30504 - DNA, 662 bp, Zea mays
  misc_feature: Ceres CLONE 1406019-F
  misc_feature: Encodes the peptide sequence at SEQ ID NO. 30505
  misc_feature (364)..(364): n is a, c, t, g, unknown, or other
  misc_feature (459)..(459): n is a, c, t, g, unknown, or other
  misc_feature (460)..(460): n is a, c, t, g, unknown, or other
  misc_feature (534)..(534): n is a, c, t, g, unknown, or other
  misc_feature (590)..(590): n is a, c, t, g, unknown, or other
  misc_feature (591)..(591): n is a, c, t, g, unknown, or other
aaagctggagctccccgcggtggcggccgctctagaactagtggatcccccgggctgcaggaattcgcacgagaccattacctagaacatcctaatcgaaaaaactcacaattcacatcgaggtctcagcttcaggaaagggaaggaagcatgttcgggcaccaccaccaccacggccacggcgggcaccaccaggccccgccgccgcacgagcagacgctgttcaggatcttctgccgcgccgacgaggcgtactgcctcaccgtgcgcccacgacgcgtcgtcctcgcgcccaccaacccccgcgacgagtaccagcactggtacaaggacatgaggcacagcacgaaggtgaaggacgcgnagggccagccggcgttcgcgctcatcaacaggggcaccggcctcgccatcaagcactcgctcgggcagtcccatcccgtgaagctgtgccctacnnacgcgagtacctggacgagtcggtgctgtggacggaaagccacgacgtggggcaagggcttccgctggatcggnatggtcaaacacatccacctcaacttcgacgccttccacggggaacaggaccacgnnggggtgcacgacgggaccacccgtggtggtctggggagggtggcagggcccccaacagaggctggaggggc

SEQ ID NO: 30505 - protein, 170 aa, Zea mays
  misc_feature: Ceres CLONE 1406019-F
  misc_feature (72)..(72): Xaa is any aa, unknown, or other
  misc_feature (104)..(104): Xaa is any aa, unknown, or other
  misc_feature (147)..(147): Xaa is any aa, unknown, or other
MFGHHHHHGHGGHHQAPPPHEQTLFRIFCRADEAYCLTVRPRRVVLAPTNPRDEYQHWYKDMRHSTKVKDAXGQPAFALINRGTGLAIKHSLGQSHPVKLCPTXASTWTSRCCGRKATTWGKGFRWIGMVKHIHLNFDAFHGEQDHXGVHDGTTRGGLGRVAGPPTEAGG

SEQ ID NO: 30506 - DNA, 701 bp, Zea mays
  misc_feature: Ceres CLONE 1406020-F
  misc_feature: Translation starting site: 182
caaagctggagctccccgcggtggcggccgctctagaactagtggatcccccgggctgcaggaattcgcacgagaccattacctagaacatcctaatcaaaaaactacggtaactcgtctgctcgcatttcctcccaatccatcccgtctccaaacccgaactccaagtcgccccgcatcgatggcgcccaaggccgagaagaatcccgcggtgaagaaaccgtcggaggaggagcccgcggtcgagaaggcgccggccgggaagaagcccaaggcggtaaagcgtgtcccagcgggcaagtccgccggcaaggagggcggtgagggaaagaagtgccgcataaatggcaagaagagcgtggagacttacaagatctacattttcaaggtgctgaagcaagtgcacccggacatcggcatttcctccaaggccatgtccatcatgaacttccttcatcaacgacttcttcaagaagctcgctgccgaggccgccaagctcgcgcggtacaacaagaagcccaccatcacctcccgcgagatccagactttcgtgcgcctcgtcctctccggggagttcgccaagcacgccgtctccgaaggcatcaaggccgtcaccagattcacttcgtcctaagctgcgcagcctccggttgcaggtttctctcgtatgttcgcgcgtcttgctgtagttaggatgctt

SEQ ID NO: 30507 - DNA, 642 bp, Zea mays
  misc_feature: Ceres CLONE 1406022-F
  misc_feature: Encodes the peptide sequence at SEQ ID NO. 30508
  misc_feature (280)..(280): n is a, c, t, g, unknown, or other
  misc_feature (283)..(283): n is a, c, t, g, unknown, or other
  misc_feature (317)..(317): n is a, c, t, g, unknown, or other
tcagaacaagtggatcccccgggctgcaggaattcgcacgagaccattacctagaacatcctaatcgaaaaaaccgaagcaatccgacctgagaccaagacccgcaccacgcggctcgccgccgatggcgaacgccgacgccgacgaagcgccgctgctctctgtggaacacctccgtccaggatcctgcagccgcgagctcgagctgcgggagttccgcgaccgctacgtgatccgttcgctcgacggcgccgccgctttcgccgtccttcgctccggnggntccatccgccctctctccccagaggaagccgaanctgagagcgacttgcaagggttttcagaaatatcgggggtggaaggcaccataagatttgcccgctggaaagtatggacctccgtaaccccttcccaaaaaaaaggtgggtccttaaccggggcctcccctgggggaccaaggggaaaaccaagggaaattttttaaggggggaaggagggtttaaaggcatttggccccccaggaaaaaaagggggggggggtttttttttggtggtccccccgggaaaatgcgaaaaaaaaaattgggggggggggggtatatttccccaccagggggggtgtggggccacaaaacgcgggag

SEQ ID NO: 30508 - protein, 119 aa, Zea mays
  misc_feature: Ceres CLONE 1406022-F
  misc_feature (65)..(65): Xaa is any aa, unknown, or other
MANADADEAPLLSVEHLRPGSCSRELELREFRDRYVIRSLDGAAAFAVLRSGGSIRPLSPEEAEXESDLQGFSEISGVEGTIRFARWKVWTSVTPSQKKGGSLTGASPGGPRGKPREIF

SEQ ID NO: 30509 - DNA, 609 bp, Zea mays
  misc_feature: Ceres CLONE 1406024-F
  misc_feature: Encodes the peptide sequence at SEQ ID NO. 30510
  misc_feature (320)..(320): n is a, c, t, g, unknown, or other
  misc_feature (332)..(332): n is a, c, t, g, unknown, or other
  misc_feature (333)..(333): n is a, c, t, g, unknown, or other
  misc_feature (498)..(498): n is a, c, t, g, unknown, or other
  misc_feature (609)..(609): n is a, c, t, g, unknown, or other
aagctggagctccccgcggtggcggccgctctagaactagtggatcccccgggctgcaggaattcgcacgagaccattacctagaacatcctaatcgaaaaactccttcgcctcccatcccaccccgaagggcgtcgccgagctagccattgccgcctcccggctcgcgactcgcgagtcacaggcgcagccgagcgttccttggggacgaggctacatcgcgatgtggtggagggcggtgaggcgccggtgggtcgcgacggcgcggcccgcgtcctccgcggcggcgggggcggagaagagctgccgcgccgtggtgntgccgcgtttcnngtggccggaggtgctcgaggtcaggcagggcatgcctgtgcccgatctgaaagcgcaggaggtgctcgtgcgcgcacgcgctgtctctatcaaccccctggacctccgaatgcgatgtggctatgggcgctccatattcgacccactctacctctgatcattggncgggacattacggtgaagtgcggccacgggactttggcatcgtctttttctatgggccagaaaggtttgggtcgttgcatccactgctctcaaaggaatatgctgattagn

SEQ ID NO: 30510 - protein, 88 aa, Zea mays
  misc_feature: Ceres CLONE 1406024-F
  misc_feature: SWISSPROT Homolog: EC 1.6.5.5 NADPH:quinone reductase
  misc_feature (33)..(33): Xaa is any aa, unknown, or other
  misc_feature (37)..(37): Xaa is any aa, unknown, or other
MWWRAVRRRWVATARPASSAAAGAEKSCRAVVXPRFXWPEVLEVRQGMPVPDLKAQEVLVRARAVSINPLDLRMRCGYGRSIFDPLYL

SEQ ID NO: 30511 - DNA, 671 bp, Zea mays
  misc_feature: Ceres CLONE 1406025-F
  misc_feature: Encodes the peptide sequence at SEQ ID NO. 30512
  misc_feature (378)..(378): n is a, c, t, g, unknown, or other
  misc_feature (396)..(396): n is a, c, t, g, unknown, or other
  misc_feature (452)..(452): n is a, c, t, g, unknown, or other
  misc_feature (458)..(458): n is a, c, t, g, unknown, or other
  misc_feature (491)..(491): n is a, c, t, g, unknown, or other
  misc_feature (500)..(500): n is a, c, t, g, unknown, or other
  misc_feature (514)..(514): n is a, c, t, g, unknown, or other
  misc_feature (515)..(515): n is a, c, t, g, unknown, or other
  misc_feature (521)..(521): n is a, c, t, g, unknown, or other
  misc_feature (530)..(530): n is a, c, t, g, unknown, or other
  misc_feature (561)..(561): n is a, c, t, g, unknown, or other
  misc_feature (646)..(646): n is a, c, t, g, unknown, or other
  misc_feature (671)..(671): n is a, c, t, g, unknown, or other
aagctggagctccccgcggtggcggccgctctagaactagtggatcccccgggctgcaggaattcgcacgagaccattacctagaacatcctaatcgaaaaatcatcagtcatcacataccgccaagaccacatcggcacatcgacgtgagctcgtgcgtgagtgccctggtcgacgaccgctcgcgcgccatggactcaacgacgacggcgccgctgctgcagccgtccgccgcctcgagcaaggaggggccggggccggcgccggctcagcacggtgagggcagccgggagctggaggcgatccctggcgacgcgtccaagccgtgggcttggcgggcctgggaaggcgccccgctggagctgccgctgctgctgncggtggcgctgccggcgntggccgtctacatgatcaacttcgtcatggtcatgtccacgcagatcttctgcggncagctncgcaacctcgagctcgccgcctcctcgctcggnaacaccggnatccagcccttggnnctacgnctcatgctnggcatgggcagcgcggtggagacgctgtgcnaggcagcgtacggcgcgcacaagcaccgcatgctgggggtgtacctgcagcgctcgacgtgctgctcatgggcaccgcgtggcgntgaccgtcttctacgccttctcgan

SEQ ID NO: 30512 - protein, 159 aa, Zea mays
  misc_feature: Ceres CLONE 1406025-F
  misc_feature (63)..(63): Xaa is any aa, unknown, or other
  misc_feature (69)..(69): Xaa is any aa, unknown, or other
  misc_feature (108)..(108): Xaa is any aa, unknown, or other
  misc_feature (124)..(124): Xaa is any aa, unknown, or other
  misc_feature (152)..(152): Xaa is any aa, unknown, or other
MDSTTTAPLLQPSAASSKEGPGPAPAQHGEGSRELEAIPGDASKPWAWRAWEGAPLELPLLLXVALPAXAVYMINFVMVMSTQIFCGQLRNLELAASSLGNTGIQPLXLRLMLGMGSAVETLCXAAYGAHKHRMLGVYLQRSTCCSWAPRGXDRLLRLL

SEQ ID NO: 30513 - DNA, 733 bp, Zea mays
  misc_feature: Ceres CLONE 1406029-F
  misc_feature: Encodes the peptide sequence at SEQ ID NO. 30514
  misc_feature (418)..(418): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (448)..(448): n is a, c, t, g, unknown, or other
  misc_feature (453)..(453): n is a, c, t, g, unknown, or other
  misc_feature (474)..(474): n is a, c, t, g, unknown, or other
  misc_feature (491)..(491): n is a, c, t, g, unknown, or other
aagagctggagctccccgcggtggcggccgctctagaactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgctggcgtccacggagaagcaggcgccccgccgcgcgntgcagggggtcctgtgcctgnnnagagtgnacggnaaagcggtgaagctacctggntgaacggtggggccccnaaagggaaggacaggggccggggccctcccccctggggccgcccttaaggcccggcccttgcattccccgttttccccttgcggaggaaaaatggctttcctaaaaaccttatggggggcccggaggtttttcccaaaaggtgttctcctttcaataggaccttaaaggcccggggggggctttaaaattttttttggggggggggggggagggttttacaaaaaaacttttttgttttttt

SEQ ID NO: 30514 - protein, 72 aa, Zea mays
  misc_feature: Ceres CLONE 1406029-F
  misc_feature (54)..(54): Xaa is any aa, unknown, or other
  misc_feature (61)..(61): Xaa is any aa, unknown, or other
  misc_feature (64)..(64): Xaa is any aa, unknown, or other
MAPAVGLKRSATQTITLPPPDTRLAVRDVMRSTIPSQPAVALASTEKQAPRRAXQGVLCLXRVXGKAVKLPG

SEQ ID NO: 30515 - DNA, 878 bp, Zea mays
  misc_feature: Ceres CLONE 1406030-F
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (26)..(26): n is a, c, t, g, unknown, or other
  misc_feature (32)..(32): n is a, c, t, g, unknown, or other
tccccccccccnnnnnnnnnnnnacnacaagnacagtccgggcccctcggccaaagctggagctccaccgcggtggcggccgctctagaatagtggatcccccgggctgcaggaattcgcacgagaccattacctagaacatcctaatcaaaaattcctcttgctcttcctcttccattcattagctgcactcgcctccctcgcgccaccgccttctcagccaccaccgccgcgggtgccttcaaaaagtgcaggtgtggcccaagccggtgtccatctcgtggccgttgccggtatacgcgccgatctccccgtcgttcaaacatccgcgcctcgccgtcgcacccgtcgctccgtcacgccatcgcgtactacacccggcctcattccggaccgagggggaacacgccggattattccccgccgtaaactacaaccggtgctcgtggggccgcccattccgcctgggtcggggctctccagttctcccgatcccggaacatcaccgtttcggacccccgggcgaccgaccgagtccctcacaagaatcttcccgggggccacagcaagttgccaggcttccgcgtttgaacatttcgctttgcacgccccactcccccttggacgggaatccttctcgggggtgcttccgaaaaaccctttcccccccacgccgtcgccccgggaaacccgccggccgcccgccccgaaagcgggagaagggctcaagccggaattccgtccccccggagggggagagaaagaaatatatcccccgaacctacacctccctaggattgatccccccgccgccaggggaaacacctcgccgtgagaaaaaccgcgcggccggggaacacagccttaagccacggtct

SEQ ID NO: 30516 - DNA, 628 bp, Zea mays
  misc_feature: Ceres CLONE 1406031-F
  misc_feature: Encodes the peptide sequence at SEQ ID NO. 30517
tcagaactagtggatcccccgggctgcaggaattcgcacgagaccattacctagaacatcctaatcgaaaaataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggctgcacggccgggtggccgctggccgccacgctgtcggagcggttccgcgtgctgctgctggagcgcggcgcctcgccctacgacgacgaccgcatcggggacatggcccgcttcgcggacacgctgtcggacacctccccgggcctcgcccgcgaagcgcttcctgtcggaggaacgggtcatcaactcgcgccccgagggtgttggggggcggaaacttgcatcaacggccggctttctaacacgcgggccaacgaacaactaactgccggggcggtccaggtgggaacctgggccccccccccggggcccccaatacccgggggggcgaaagcaccctgggg

SEQ ID NO: 30517 - protein, 170 aa, Zea mays
  misc_feature: Ceres CLONE 1406031-F
  misc_feature: SWISSPROT Homolog: EC 4.1.2.10 Mandelonitrile lyase
MSGRSRHFTMSTLLATSFFFVLLCSSLQVRGVNYTFVKDAALAPSVSYYDYIIVGGCTAGWPLAATLSERFRVLLLERGASPYDDDRIGDMARFADTLSDTSPGLAREALPVGGTGHQLAPRGCWGAETCINGRLSNTRANEQLTAGAVQVGTWAPPPGPPIPGGAKAPW

SEQ ID NO: 30518 - DNA, 694 bp, Zea mays
  misc_feature: Ceres CLONE 1406032-F
  misc_feature: Encodes the peptide sequence at SEQ ID NO. 30519
  misc_feature (649)..(649): n is a, c, t, g, unknown, or other
agagctggagctccccgcggtggcggccgctctagaactagtggatcccccgggctgcaggaattcgcacgagaccattacctagaacatccctaatcaaaaaagcaaccacttctgctctgcatcccgtctgggcctctgcatttgcttggctgctgctcccttctcccaccgaccaactcgatcccgcgccatggatcgcgccgaccccgcgcggggccgccttgccgtgctctcctcccacctccgtggtgcaggggccgaggaggcggcggggctggagaggtcgccggtatccgcgccggcgcccgggccccgcgccggcgcgcttgccgtggtggacgggaggaccgggaagcggcacgaggtcaaggtctccgaagacggcaccgtgcgcgccaccgacttcaagaagattaccactggaaaggacgacaagggtcttaagatttatgatcctggttaccttaacactgcccctgttcgctcgtccatctgctacatcgatggagatgaggaaatctttcgctatagggttatccaatcgaaaatttggctaaaccccctcctttggtgagggggcctccctttaaggttggggaatcttccacctccagaaaattgggcgggggggaaattgaatttctcnacattttgggtgtcccccaggggggggaaaaaaaacaaacaagcc

SEQ ID NO: 30519 - protein, 127 aa, Zea mays
  misc_feature: Ceres CLONE 1406032-F
  misc_feature: SWISSPROT Homolog: EC 2.3.3.1 Citrate (Si)-synthase
MDRADPARGRLAVLSSHLRGAGAEEAAGLERSPVSAPAPGPRAGALAVVDGRTGKRHEVKVSEDGTVRATDFKKITTGKDDKGLKIYDPGYLNTAPVRSSICYIDGDEEIFRYRVIQSKIWLNPLLW

SEQ ID NO: 30520 - DNA, 819 bp, Zea mays
  misc_feature: Ceres CLONE 1406033-F
  misc_feature (1)..(1): n is a, c, t, g, unknown, or other
  misc_feature (2)..(2): n is a, c, t, g, unknown, or other
  misc_feature (7)..(7): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (22)..(22): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (819)..(819): n is a, c, t, g, unknown, or other
nnccccncccaaaatnnnnaanaatgtaaaccnnnnnncccccnnacaaactggagctccaccgcggtggcggccgctctagaactagtggatcccccgggctgcaggattcgcacgagaccattacctagaacatcctaatcgaaaaaccgttctcttctccctaatcctggtaatcagtagtagcccactagcgctgctgccgttctcttcccctacccgacacaagctccccacctctatctacaacacgccaccactgtaagagctcctccacgatcatcccgccctagagccataataattcgttgaggagggaggggttcttaaaaaccagaggccggttacccggtgaaggaaacccgtgcctgctggttggttgctgttcctcaagctaaaacccgggtgggggtttgggaaatttcgaaagcgcaactttcacgccctcaaatttgttttcaaggggggagcccctccctgtcttgtacccaaccaaaaatttggggaaagggggcctctggttcccccgagggaaaaaaggggaaaattccttggttcccactataacccacaccccgggctttggggtttcctagaaaaaactgccctccacaacttttgggggggtttctaaagggggtgggcaaaaaaccctcaggggctggaggggggaataaaaatacccctgggggcccccccccttaaataagaggggcgcttttccttggtgggggggggaaaaaccccccccggcgcaaaaattctttggggtctacactgggagaacaaagggtggcctctcaatattttaaacaaggn

SEQ ID NO: 30521 - DNA, 663 bp, Zea mays
  misc_feature: Ceres CLONE 1406035-F
  misc_feature (311)..(311): n is a, c, t, g, unknown, or other
  misc_feature (376)..(376): n is a, c, t, g, unknown, or other
  misc_feature (392)..(392): n is a, c, t, g, unknown, or other
  misc_feature (409)..(409): n is a, c, t, g, unknown, or other
  misc_feature (538)..(538): n is a, c, t, g, unknown, or other
tccccgcggtggcggccgctctagaactagtggatcccccgggctgcaggaattcgcacgagaccattacctagaacatcctaatcgaaaaaccgcatcgcctcgccgctgttccccgcaacctatcgacccaatctcgtccgacccggcgcgtcgtcccctccagatctccgtcgccctctccaggtagcagaaactgttctgctgcattctgacaaagtggagggcttaggagcttctgcttcttttatgtctgaacaatctttgctttatttgggattgttgggagagtactctcgtgcaactagganaaggcacaaggttccgtcccactgcatgcgtcaagagactgtctgggtttcttgttctgatttgncatttgctggtgctcnaagccggcttggttccntcgaaggatcagcatctactcttgattgtggactttgtcgcatctgatatcaacttcataaatcttttatccaagatggcgctgcaaaacattggtgcttcaaacagggatgatgccttctacaggtancagatggccagaatgatacccagatagaaggccggtggtaatgtatcaggaacaatgttggggacatgttgacatagcaaaagacttgccaggccagcttctacacacaaggtaactttggatgt

SEQ ID NO: 30522 - DNA, 718 bp, Zea mays
  misc_feature: Ceres CLONE 1406037-F
  misc_feature: Translation starting site: 230
  misc_feature: Pfam Name: malic Pfam Description: Malic enzyme, N-terminal domain
  misc_feature: SWISSPROT Homolog: EC 1.1.1.40 Malate dehydrogenase (oxaloacetate-decarboxylating) (NADP(+))
  misc_feature (618)..(618): n is a, c, t, g, unknown, or other
  misc_feature (661)..(661): n is a, c, t, g, unknown, or other
aaagctggagctccccgcggtggcggccgctctagaactagtggatcccccgggctgcaggaattcgcacgagaccattacctagaacatcctaatcgaaaaacatccgtcttcctcctgtaaccagatctgaacccgcggcgacagaaacaaacgctcgctcgctcgttcgttgtccgttcattgtcttcgccggcgccgagggaccctgagagggcaggcggacgagatggcgggcggcggcgttgaggacgtgtacggcgaggaccgcgctaccgaggagcagctgatcacgccgtgggtcttctccgtcgcaagcggctacaccctgctgcgcgacccgcggcacaacaagggcctggccttctcggaggcggagcgcgacgcgcactacctccggggcctgctgccgccggcgctggcgtcacatgagctgcaggagaagaactcatgcagaacctgcgccggtacgagcagccgctgcaccgctacatcgtcatgatggacctgcaggagtgcaacgagaggctcatctacaagctcctcatcgactacgtctaggagctgctccctgtcgtctacacgcccacctgtcgggacgcatgccagaagtacggnagcatctaccggcgcccgcaggggctgtacatcagcctcaggnacgaggggaagatcctcgaggtggtcaagaactgccccaagatggacatccaggtct

SEQ ID NO: 30523 - DNA, 677 bp, Zea mays
  misc_feature: Ceres CLONE 1406043-F
  misc_feature: Encodes the peptide sequence at SEQ ID NO. 30524
ggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtggccttcttctggctgctgaaccacgaagtgcccgaagagctgatgggcgccatgctcccgggggtgcgccagttcaaccagggccccggtgaaagggaaagcaagggctcctaccccaagggaacctccctcggaaacctggcggtttcccctccaaccttcgaaccttcttcaagggttgctggcgggccgaactggccccgacaccccttctttctgggaaaggggggttccgaaacccccgccgg

SEQ ID NO: 30524 - protein, 178 aa, Zea mays
  misc_feature: Ceres CLONE 1406043-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVAFFWLLNHEVPEELMGAMLPGVRQFNQGPGERESKGSYPKGTSLGNLAVSPPTFEPSSRVAGGPNWPRHPFFLGKGGSETPA

SEQ ID NO: 30525 - DNA, 821 bp, Zea mays
  misc_feature: Ceres CLONE 1406045-F
  misc_feature: Encodes the peptide sequence at SEQ ID NO. 30526
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
nnnngggggtgtggtgggggtgttgtttaatgaannannnnctcccccccatctaaagctggagctcaccgcggtggcggccgctctagaatagtggatcccccgggctgcaggaattcgcacgagaccattacctagaacatcctaatcgaaaatcttcctgctcaacatcagtagcagctttagctgtagcagcgccaccggccaccgccacgccatggccaccacgttgcacaagccccttggggcgatccaccgttgacgacctcgccgcggcggcgcctgggtcggacgccaccgcgctccacgaagtgctccggggcgcgctcgactcgcacggacccaccgaagtggggggcggagctctgccgggcccggggtctggcccgtctggtccccttccgccggcccccgggatggccctactaacggttgctttcgccggggttccccgtcccccccacgccggcgggcctgggttctccccccacccccaggggagttctggtcttggaccaaaggggcggcccggggtcccctccggggggggtggggccaaggaaaacttgggtcccgcgcgaacgccgaaaacaagggatccccccttccccccaggctttccccaaaacccccccccgaggtgctccccaaaggaagaaacccccagaagggggtaactgggaaaagaaagggtatttttgagggggaaatggggtatacccccactttaagggggtaaaaggcccctccctcgggatttctgggagaaaagaaaaacaccggcgtatatatcccccggggggcgggagggggtggctacc

SEQ ID NO: 30526 - protein, 86 aa, Zea mays
  misc_feature: Ceres CLONE 1406045-F
MALLTVAFAGVPRPPHAGGPGFSPHPQGSSGLGPKGRPGVPSGGGGAKENLGPARTPKTRDPPFPPGFPQNPPPRCSPKEETPRRG

SEQ ID NO: 30527 - DNA, 659 bp, Zea mays
  misc_feature: Ceres CLONE 1406046-F
  misc_feature: Encodes the peptide sequence at SEQ ID NO. 30528
  misc_feature (404)..(404): n is a, c, t, g, unknown, or other
  misc_feature (519)..(519): n is a, c, t, g, unknown, or other
tcaccgcggtggcggccgctctagaactagtggatcccccgggctgcaggaattcgcacgagaccattacctagaacatcctaatcgaaaaatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcgtctcaggtcccaccgtcacctccacgagcccgaccaacaatcaggtcatcgcagaggtcgtggaggcgtccgtgcacgactacgaggagggcatgcgcgcctgcttcgatgccgcccagacatggatggcgattcctgctcccaagcgaggagagatcgttnaggcaatcggtgatgcactgagagcaaagctccatcaccttggcaggcttgtgccacttgagatggggaaaatcttcctgaagggatcggtgagggtcaggaaatcatcgacatnggggattatgctgggggcctaatccccaactaaagggatccattataccatctgaacggacaaccatatgatggagggaggtggggatccccttgggaggtgggggtggtataacggatttaatttccccttgggcgggg

SEQ ID NO: 30528 - protein, 130 aa, Zea mays
  misc_feature: Ceres CLONE 1406046-F
  misc_feature: SWISSPROT Homolog: EC 1.2.1.3 Aldehyde dehydrogenase (NAD(+))
  misc_feature (86)..(86): Xaa is any aa, unknown, or other
  misc_feature (124)..(124): Xaa is any aa, unknown, or other
MGAFAKEEHQFLAELGLAQRNPGAFACGAWGVSGPTVTSTSPTNNQVIAEVVEASVHDYEEGMRACFDAAQTWMAIPAPKRGEIVXAIGDALRAKLHHLGRLVPLEMGKIFLKGSVRVRKSSTXGIMLGA

SEQ ID NO: 30529 - DNA, 629 bp, Zea mays
  misc_feature: Ceres CLONE 1406050-F
  misc_feature (199)..(199): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
gagctcaccgcggtggcggccgctctagaactagtggatcccccgggctgcaggaattcgcacgagaccattacctaaacatcctaatcgaaaaccaacccttgtagtctcagtcaatctgtagattgagactacgatgagcctggtcacgttcgactttctctcccgccggccgcgggttgcggttgcttcttaacgnagtgcccctcgccccgggttcccgcttccaccccacgacaaggaggtcgtttctaataactccgcgccgggttcttgggcggcgctttcgggttaaaagcctttgcaagaatgaacttttaaccgcttagagcctgggaactccccttccttttcccgattccgaaaggggaaagccaagggggattttttttcccctttttaaaaaaaaaggccccccggtttgtgtcccgggggcccccnnnnttccccccaaaaaaaaaaaaacaccccgctttccgcgggggggggtgttggaaaaaaacccgcaaaaagaccgccgggggggcccccccccggggaagaccctctgttaaaaaaaaaaaaaaactcttttttctcccccggggggggggggtaaaaaggaaaagaaaaaaaattgtttttttttt

SEQ ID NO: 30530 - DNA, 729 bp, Zea mays
  misc_feature: Ceres CLONE 1406051-F
  misc_feature: Encodes the peptide sequence at SEQ ID NO. 30531
  misc_feature (409)..(409): n is a, c, t, g, unknown, or other
  misc_feature (450)..(450): n is a, c, t, g, unknown, or other
  misc_feature (504)..(504): n is a, c, t, g, unknown, or other
acaagctggagctccccgcggtggcggccgctctagaactagtggatcccccgggctgcaggaattcgcacgagaccattacctagaacatcctaatcgaaaaacaccccggtcggctagtcccaaggctgctgccgccgcctgctgctaggggatcgcttgctttcctcggaccactctgccgaccacatctacaccgcatcaacggtccttccaagtgagctccaatcccctgtctgtagatggagagggtgctcaaggatgacgccgtcgaggagaagggcgagcgcgccaggatggcatcgtttgttggggccatggcaatctcggatttggtgaagaccacattgggcccaaaaggaatggacaagatcctgcaatcaactggcagaggacgtaatgttactgntacaaatgatggggctaccattttgaagtcacttcacattngacatcctgctgcaaaggtcccttgtgacatcttcaaagttcaagatgatgaantttgtgatgggaacactttctgttgttgttccaacctgaaaacttttaaagaggctgaaaagttaatttacctggaaaatccttcccatgactattattggcgggtaaccaaaggggtttccaggggggcccaaaaattctttgttaaaaagaccctggggcccccaaaaaaaacgggaaatttcgaatcgggcccccggaaaattggttagcccccccctaaat

SEQ ID NO: 30531 - protein, 157 aa, Zea mays
  misc_feature: Ceres CLONE 1406051-F
  misc_feature (56)..(56): Xaa is any aa, unknown, or other
  misc_feature (70)..(70): Xaa is any aa, unknown, or other
  misc_feature (88)..(88): Xaa is any aa, unknown, or other
MERVLKDDAVEEKGERARMASFVGAMAISDLVKTTLGPKGMDKILQSTGRGRNVTXTNDGATILKSLHIXHPAAKVPCDIFKVQDDEXCDGNTFCCCSNLKTFKEAEKLIYLENPSHDYYWRVTKGVSRGAQKFFVKKTLGPPKKTGNFESGPRKIG

SEQ ID NO: 30532 - DNA, 660 bp, Zea mays
  misc_feature: Ceres CLONE 1406053-F
  misc_feature: Encodes the peptide sequence at SEQ ID NO. 30533
  misc_feature (308)..(308): n is a, c, t, g, unknown, or other
  misc_feature (309)..(309): n is a, c, t, g, unknown, or other
  misc_feature (321)..(321): n is a, c, t, g, unknown, or other
  misc_feature (380)..(380): n is a, c, t, g, unknown, or other
cgctctagaactagtggatcccccgggctgcaggaattcgcacgagaccattacctagaacatcctaatcgaaaaactggattcttctctcttctctttctctgagtcgcagcttcggcagctggcggtctggtctacggtctaccactaccactctaccagagaggggatcgatcacacaaacacacccatggcgggctgcgcggcggcgcgcatgttcgcgtacaacgccagcctctgcgcctgcgatccggggtactactactacctcagcagcaacggcaccgcgagctgcatcccgatgccgnnggcggcggtggngcgactggcaggtggggctccgtgggcgcgccgaggaaccagagcctctacttcctggnagccggtgctctcggtctacgccatccgccgcctcacccaggtccaggccgtggctcctcgaggcgaccctcgcgtcgctccttctgctggatcgccttctggccgcaaccagggttcggcggcgggaccccccggggggaaaaaagaggctggccccgggcccgggaattgggtcagcccgcctcgactgccttctcgaacacagcccctgggggggggggatccagcaagtactaagggaaagggaaacccgaattgggggggaacattctccagcgg

SEQ ID NO: 30533 - protein, 156 aa, Zea mays
  misc_feature: Ceres CLONE 1406053-F
  misc_feature (40)..(40): Xaa is any aa, unknown, or other
  misc_feature (44)..(44): Xaa is any aa, unknown, or other
  misc_feature (64)..(64): Xaa is any aa, unknown, or other
MAGCAAARMFAYNASLCACDPGYYYYLSSNGTASCIPMPXAAVXRLAGGAPWARRGTRASTSWXPVLSVYAIRRLTQVQAVAPRGDPRVAPSAGSPSGRNQGSAAGPPGGKKEAGPGPGNWVSPPRLPSRTQPLGGGDPASTKGKGNPNWGGTFSS

SEQ ID NO: 30534 - DNA, 756 bp, Zea mays
  misc_feature: Ceres CLONE 1406054-F
  misc_feature: Encodes the peptide sequence at SEQ ID NO. 30535
  misc_feature (244)..(244): n is a, c, t, g, unknown, or other
  misc_feature (258)..(258): n is a, c, t, g, unknown, or other
  misc_feature (263)..(263): n is a, c, t, g, unknown, or other
  misc_feature (265)..(265): n is a, c, t, g, unknown, or other
  misc_feature (332)..(332): n is a, c, t, g, unknown, or other
aaagctggagctccccgcggtggcggccgctctagaactagtggatcccccgggctgcaggaattcgcacgagaccattacctagaacatcctaatcgaaaaactcgcaccacgccaccgctgctgcctgctcctcacagtcctccccgcgctcgcattgcgatttgcgacctagcgcgagggtaccgggggggtggtgcgcgcgcgtgctcggtgatccgggaagcgccgcgagatgggcggnggtggagggcgcgntgccncncccgagcacgacgacttcacgccgcacccccgtcaggaacagctccctggggtctcctactgcatcnacagccctcccccgtggcctgaaagccgttctcttgggggtccacattatctgggcatgcttgggaaccactgggatcataccaactggaccttgttccccaaatgggggggaaacatgggggcacaagcgggggtttcccaaacattggtggtcgtttcgaggtaccaacccccccggcaaaatttctttgaacaccttttccctggagagaatcgggggaaaaaaaccctttggtggccccacacttttaaaccccctgtgggggggtttttttttagacccccctcccccctttttaaatttccccccaatcgggggggaaaaaaagggggggggatggggggccccccccccccaaaaataaaaagtttctccccggcctttttggggaaagggggcccgaaattaagcccccctttcct

SEQ ID NO: 30535 - protein, 173 aa, Zea mays
  misc_feature: Ceres CLONE 1406054-F
  misc_feature (8)..(8): Xaa is any aa, unknown, or other
  misc_feature (10)..(10): Xaa is any aa, unknown, or other
  misc_feature (33)..(33): Xaa is any aa, unknown, or other
MGGGGGRXAXPEHDDFTPHPRQEQLPGVSYCIXSPPPWPESRSLGGPHYLGMLGNHWDHTNWTLFPKWGGNMGAQAGVSQTLVVVSRYQPPRQNFFEHLFPGENRGKKTLWWPHTFKPPVGGFFFRPPSPLFKFPPNRGGKKGGGMGGPPPPKIKSFSPAFLGKGGPKLSPPF

SEQ ID NO: 30536 - DNA, 650 bp, Zea mays
  misc_feature: Ceres CLONE 1406056-F
  misc_feature (480)..(480): n is a, c, t, g, unknown, or other
  misc_feature (617)..(617): n is a, c, t, g, unknown, or other
  misc_feature (618)..(618): n is a, c, t, g, unknown, or other
gctctagaactagttgatcccccgggctgcaggaattcgcacgagaccattacctagaacatcctaatcgaaaaaccggggtttcggacaagcgtctctctccctctctagtctctactgcttcaccgacgacggcggctctccgagtccggtattcccgtctcctcatcggtgtcttcggaattaggttcattacagcgtcccgttctcctatgtacgtcgtcacgctcaaaggcaggaagcgccggtcgtcgagcaacaaggctgtttggcccagacacgcagccaacggaggggccactaccacacggagtgcattccgccacccgagaagtcacatttacttcccccagccgccagacaatcaaagctaccatttccagccagagacagccattcacttcgtcatggtgagcatcgacgcagctcattgtagatctgcatgaagtaggacgacttacgagaaggcaagaatctccnagggctttttcaaggaaatccccccccccccaaaaggaggggttttccaccccgcggttttttataaaaaaaaaaaaaaaaagggcgcccaccctcctttttttggtggcccgccccccccggtctcccccgggggnnaaaaaaaaaaaaaaaaaaacattctttttttt

SEQ ID NO: 30537 - DNA, 746 bp, Zea mays
  misc_feature: Ceres CLONE 1406059-F
  misc_feature (462)..(462): n is a, c, t, g, unknown, or other
  misc_feature (474)..(474): n is a, c, t, g, unknown, or other
  misc_feature (488)..(488): n is a, c, t, g, unknown, or other
acaagctggagctccccgcggtggcggccgctctagaactagtggatcccccgggctgcaggaattcgcacgagaccattacctagaacatcctaatcaaaagctaagatgttatacttcatgcttaaatatgcaatggagattatcaacaaaaaatgcaatagtgattttgctttcagagtcaaatgttacgagcagttactatttcagctggaatacaacaacaatggcaacatttctagcaatccttggattcacggttcttcctgttggaacataaattagcaaaatgtttgatgcgaacacaaggttgacttgtcccttgtggttcgagttgatgatgagtgattgtcaatgggtagcactctagggtagtcagtggactgactagagtgagattatgtttgtgcaacccatgtcgtcgacttgtggtgtgcaggtgtggagcacaggaaaacgtgntcgatggctgangtgaatgtcatgcnggcttcgtgctgatggactgggagcgattaagggaacatgctgaattctgactgatggatcaaaacagccaggtgaaccaaccccgggggtttaaccctaggaaccccccttttcccaagacctggggggaaaaaccctggttcccgcattgtccaaggttttgggggaacctttcttttattttgggaaaacgcccaaaagggccgtgctcccaccaggtttttggggtttgggcccaaaaaccccccgggtttggt

SEQ ID NO: 30538 - DNA, 635 bp, Zea mays
  misc_feature: Ceres CLONE 1406060-F
  misc_feature: Encodes the peptide sequence at SEQ ID NO. 30539
  misc_feature (184)..(184): n is a, c, t, g, unknown, or other
aagctggagctcaccgcggtggcggccgctctagaactagtggatcccccgggctgcaggaattcgcacgagaccattacctagaacatcctaatcgaaaacttgtgaacatcgcagtgctgtagcctccttcgtcttgagcgagcatggagatgtcagccatggaggaagccctccccaaggncgatggagaggaggaaggtaggcctcaaaaccattccgttcatcatcttaaacgagatattcgagaaggtggccacgttcggactgtcggccaacatgatcctggacctcaccgagcggtatctcatgaccaacgcctttgccaccgacgtcctctacttctggcatgccttctccaacttcctgcccatcttaggcgccgtgctcgccgacgcccgcctcggccggttccggatcatcaccctcgggtcctgcgttaacctcttcgggatgagcatgctgtgaatgacggtgatccttccggtgtacaacaaacccccggagtgcgcgccggtgcggccggtaagggtgcccgatgctgccaaggaagctgccggcccctcttcacggggtttcgcgtgaatgcccctcgggaacgggccggattccggccttgaaacgctgggggtccg

SEQ ID NO: 30539 - protein, 93 aa, Zea mays
  misc_feature: Ceres CLONE 1406060-F
MERRKVGLKTIPFIILNEIFEKVATFGLSANMILDLTERYLMTNAFATDVLYFWHAFSNFLPILGAVLADARLGRFRIITLGSCVNLFGMSML

SEQ ID NO: 30540 - DNA, 718 bp, Zea mays
  misc_feature: Ceres CLONE 1406061-F
  misc_feature: Encodes the peptide sequence at SEQ ID NO. 30541
  misc_feature (680)..(680): n is a, c, t, g, unknown, or other
aaagctggagctccccgcggtggcggccgctctagaactagtggatcccccgggctgcaggaattcgcacgagaccattacctagaacatcctaatcgaaaagtcgagttaacaaagtcacctcatccaatcttgcatccccatctctgtctttgctcctccatggccatggccatggcccgaccttgtgctttccttctcttcttcctagttcttttctcctacgacggatccggtcctgggagcagcagcaggaggagtggcgtcgctcaggccacgcagagagtcttcctgtatccacaggctcccaaggtctcctccatcgtgagcagcaagtacaggaccgcgtaccacttccagcctcccaagaactggatcaacgatccaaatggaccaatgtactacaatggtatctaccaccagttctaccagtacaacccaaacggctcgctctggggcaacatagtctgggcgcactcggtctccacagatctcgtgaactggatccggctcgcgccggcgatagagcggacgactccgagcgacatcaatggctgctggacaggttcagccaccatcctcaagagcggcctggcctgccatcatatacaccggcgccgacaccgagaagcgtcaggtccagaacttggcgttccccaagaacctgtccgatccgaccntgcgggaagtgggtgagcaccaaaaaactcgttgatcc

SEQ ID NO: 30541 - protein, 177 aa, Zea mays
  misc_feature: Ceres CLONE 1406061-F
  misc_feature (64)..(172): Pfam Name: Glyco_hydro_32N Pfam Description: Glycosyl hydrolases family 32 N terminal
  misc_feature: SWISSPROT Homolog: EC 3.2.1.26 Beta-fructofuranosidase
  misc_feature (173)..(173): Xaa is any aa, unknown, or other
MAMAMARPCAFLLFFLVLFSYDGSGPGSSSRRSGVAQATQRVFLYPQAPKVSSIVSSKYRTAYHFQPPKNWINDPNGPMYYNGIYHQFYQYNPNGSLWGNIVWAHSVSTDLVNWIRLAPAIERTTPSDINGCWTGSATILKSGLACHHIHRRRHREASGPELGVPQEPVRSDXAGSG

SEQ ID NO: 30542 - DNA, 764 bp, Zea mays
  misc_feature: Ceres CLONE 1406066-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (38)..(38): n is a, c, t, g, unknown, or other
  misc_feature (51)..(51): n is a, c, t, g, unknown, or other
  misc_feature (53)..(53): n is a, c, t, g, unknown, or other
nnnnnnnnnnttttnnnnnttttatttttggttgattngtttatagaaaantntcaaactggcgctcaccgcggtggcggccgctctagaactagtggatcccccgggctgcaggaattcgcacgagaccattacctagaacatcctaatcgaaaaggtgatagttctgattcccaggcaaggaaccctcttatcccttctcgtctcctgtcccggtaccggggaggccgccatcgagaaggggaacgagcgcgtcccgtgatcgccactcctcgccgatggcgtcctccactctgtcagcctcccccttccgaatgtctcttcccgcactacgagcccccgcaccctgctaagggtaagcacgtatccgttcgaacccccgctcgtcgtcttcccgttgcagcctccgcggacaacatcaggcgccgcggtgtggggcggcgagggagcgccaggcgtttcccttggagcgctcccccctttaacccaaacgaccttcccagcacaatgccatacgattaattccgagggcactacaccccaattattcctgcacctcattccgaaatgccttgaccgctgccgccattgcgaggagaattactgaacgggcgatgcccatctccatttcctttcttttccccggacggaaacaaaacggccccgcgcggaaggtcggaagattagtcagagaaagaaggggaaccaaacctgcagatagagggactaactgacctccacccctaaagggggcaggctgcccc

SEQ ID NO: 30543 - DNA, 649 bp, Zea mays
  misc_feature: Ceres CLONE 1406082-F
  misc_feature: Translation starting site: 214
  misc_feature (393)..(393): n is a, c, t, g, unknown, or other
  misc_feature (413)..(413): n is a, c, t, g, unknown, or other
  misc_feature (434)..(434): n is a, c, t, g, unknown, or other
  misc_feature (449)..(449): n is a, c, t, g, unknown, or other
  misc_feature (452)..(452): n is a, c, t, g, unknown, or other
  misc_feature (487)..(487): n is a, c, t, g, unknown, or other
gctctagaactagtggatcccccgggctgcaggaattcgcacgagaccattacctagaacatcctaatcgaaaaagggaccaaatcaactcaagtcatcgagtccacagctcgcgcgcgctgccgccagccaatcgctctgcctccggcctccgcagcccaaaaccacctcggccccacttcttctctccgtcgccccctgtttgcccaacccatggcgacccacgccagcgacaatggcagcgggcacgcggagtggcggttcgctcgtgcggcgaaggagggtgcgctggccgtggccggggacaagatgagcatccgggcggcgcggttcaagatcagcgcgagcgtggacgggcgcgacccgcggcccgtgctgccgcttgcgcacggngaaccctcggtgttcccggncttccgcaccgccgccgaggncgaggacgccgtggncgncgcgctccggacgggcaagtcaactgctaccccgncggcgtcggcctccccgaggccgccgtgctctggcggagcacctgtcaagtgatcttcccatacagctgtcaactgatgacatcttcctcaccgctggagggactcagccaatgaagttgtcgtctcagtcctggccaaccgaggggcacatattgctccca

SEQ ID NO: 30544 - DNA, 774 bp, Zea mays
  misc_feature: Ceres CLONE 1406083-F
  misc_feature: Encodes the peptide sequence at SEQ ID NO. 30545
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
nnnnnnnnnnnnnnnnnnnnaaaaaaccnnnaacggggcggggacccattccccaaaactggagctccccgcggtggcggccgctctagaactagtggatcccccgggctgcaggaattcgcacgagaccattacctagaacatcctaatcgaaaaaaccacgatgctctgctcgaccaccgccgatatctatggtcggattaggttcgctgccctcttcgcctcagctgtttcccgaggtctccctgcggcgacggtcaccgtagtggactccggcctcccccacggcgaccgacaaaagggtgagagagtgcaagaacctacggtacaccggcctcacgaacagctccatcaacaatctctttgatctcatcacggaccaaggtacggggagacctacgcttcaccgcctttgccctctcctccagctagaaaattgttcctgattccctcaaataaccaaggtatgaacagttaaaaagctattgcaatatactactgcaaacttccattggttttggggccacttttgcttatggcaagaattttcgacgggggctcgggttaattaagttgaaccaagttgaatatggattgggctttggcccgccataaaggggggtcccaaagaacataccgattttcctttggggcgaaattttaaaccctaatgggcccaattttttaattttgcgcccaaatggggcgggctttgggggggatggggttaaaccccccccaaataacgggggtggccccaccggcaaaaaaatt

SEQ ID NO: 30545 - protein, 67 aa, Zea mays; identical to SEQ ID NO: 27643
  misc_feature: Ceres CLONE 1406083-F

SEQ ID NO: 30546 - DNA, 706 bp, Zea mays
  misc_feature: Ceres CLONE 1406084-F
  misc_feature (1)..(1): n is a, c, t, g, unknown, or other
naaagctggagctccccgcggtggcggccgctctagaactagtggatcccccgggctgcaggaattcgcacgagaccattacctagaacatcctaatcgaaaaccccaaccccgttcttctccctccgtccgaccgtccctcgacagtgccgaggcgcaacctagcagccgcccacgcggcgcgacatccactggcgcaagcgcaatccgcaagggccccccggcgcgccgccagcctcctggctcggccgcccccgcggctaacccaggggcggaaaggccggccagccgcccacaccccatccggccagccaggcggaaacgaccgtaagagggaagccgcagccggccgctgactccgatcccacctctagtcaaccccaggcagaccgatcctcttcgtctgaccacgacgtccatctcgcacgcctacttccactcaaccacataagtcttttctgccaggcctaacctttcccctgcgccgcctctactggttttgcacagtgccgtgacgtgggaagacgtggagatccaacgaaaattagatttatttcttccttcttcggtccaacaggttcctcagcttgcgtaagatccgtctgggttgtccgccctccattggactacccaaggtgcggcgcatccaccaggtggaagatatctgcgtaagtcaaacatagaaaaagagtggactgctattagt

SEQ ID NO: 30547 - DNA, 699 bp, Zea mays
  misc_feature: Ceres CLONE 1406085-F
  misc_feature: Translation starting site: 188
  misc_feature (280)..(280): n is a, c, t, g, unknown, or other
  misc_feature (281)..(281): n is a, c, t, g, unknown, or other
  misc_feature (284)..(284): n is a, c, t, g, unknown, or other
  misc_feature (305)..(305): n is a, c, t, g, unknown, or other
  misc_feature (328)..(328): n is a, c, t, g, unknown, or other
  misc_feature (329)..(329): n is a, c, t, g, unknown, or other
  misc_feature (344)..(344): n is a, c, t, g, unknown, or other
  misc_feature (434)..(434): n is a, c, t, g, unknown, or other
caaagctggagctccccgcggtggcggccgctctagaactagtggatcccccgggctgcaggaattcgcacgagaccattacctagaacatcctaatcgaaaaaacccaacccaaccgcgctttttgtcacctctcacctggaaagggaagacaagtcgagattcgagaaggcaaatcgaattcgccatgggcatggctgctccgcgcgcgccgctgcctctcccccaactgctgctcctcctcgttgctgcgcttctcgccgccgctcccctcctaggnnggncggggcggacgaagttcgaangtcgccgcccactctttcacgtnnaccagtatgatgtgncccaggagtccagtagtgtcatctccatgccgtcaatcccagacggggggcccgggtcattcacctccatcctaatgccaagaactgggnactcgtgctcctaccaagaagcgaatcaggagattggataaaatgggcatttccaactggaagccctttttaaagaaggaaatcagggccttggaaggggattttttggaaaaaattcctccgggattaagggggggaaacccccttaaagggaggcctaaagggggggtctttttttgggagggaaagagggtttgccattttctttccaaaaggggggggggttcccaaaatttttgtgagaaacaaccccccctggtgtatt

SEQ ID NO: 30548 - DNA, 707 bp, Zea mays
  misc_feature: Ceres CLONE 1406087-F
  misc_feature: Encodes the peptide sequence at SEQ ID NO. 30549
  misc_feature (1)..(1): n is a, c, t, g, unknown, or other
  misc_feature (420)..(420): n is a, c, t, g, unknown, or other
  misc_feature (425)..(425): n is a, c, t, g, unknown, or other
nagagctggagctccccgtggtggcggccgctctaaccacacaagatcccccgggctgcaggaattttgcacgagaccattacctagaacatcctaatcaaaaaacgctcccgtccgaggtttcgcgtgcggccatgctcgtccgcatcaacaccctcctccagggctactccggcatccgcttcgagatcctcgaggccatcaccaagctcatcaacaccggcgtcagcccgtgcctgccgctgcggggcaccatcaccgcgtcgggcgacctcgtcccgctgtcctacatcgccggcctcatcacggggcgtcccaacgcgcaggccgtcacggttgacggcaggaaggtggacgccgccgaggcgttcaagggcggcggcatcggaggcggcttcttcagctcacccccagggaggnctggncatcgtcaacgcacgtccgtggggtcggcgctcgcgccatggtgtgtttcacgccaacggcctcgccgtcctgtccgagggcctggcggccggctttttgcgaggggatgaccggaaagcccgaaaagggaccactttcccccaaggtaaggcaccccccgggggcccatcggggcctttgcccttttgggaacaattccgggaagggaggcccctttttaaaaacccccccaggggggagaaccccgtggacccccttttaaaccccaaaaggggaaggga

SEQ ID NO: 30549 - protein, 177 aa, Zea mays
  misc_feature: Ceres CLONE 1406087-F
  misc_feature (3)..(175): Pfam Name: PAL Pfam Description: Phenylalanine and histidine ammonia-lyase
  misc_feature: SWISSPROT Homolog: EC 4.3.1.5 Phenylalanine ammonia-lyase
  misc_feature (140)..(140): Xaa is any aa, unknown, or other
ELELPVVAAALTTQDPPGCRNFARDHYLEHPNQKTLPSEVSRAAMLVRINTLLQGYSGIRFEILEAITKLINTGVSPCLPLRGTITASGDLVPLSYIAGLITGRPNAQAVTVDGRKVDAAEAFKGGGIGGGFFSSPPGRXGHRQRTSVGSALAPWCVSRQRPRRPVRGPGGRLFARG

SEQ ID NO: 30550 - DNA, 707 bp, Zea mays
  misc_feature: Ceres CLONE 1406088-F
  misc_feature: Encodes the peptide sequence at SEQ ID NO. 30551
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (445)..(445): n is a, c, t, g, unknown, or other
  misc_feature (447)..(447): n is a, c, t, g, unknown, or other
  misc_feature (472)..(472): n is a, c, t, g, unknown, or other
  misc_feature (613)..(613): n is a, c, t, g, unknown, or other
caaagctggagctccccgcggtggcggccgctctagaactagtggatcccccgggctgcaggaattcgcacgagaccattacctagaacatcctaatcaaaaaaccggagagatctggtctgccattccctcgctccttcccgtgaaccacaaacctaacgcggagcggcgcgggccggccgccgggcgaggtgcgcgtagctgccgtcgattgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgcgaacacacgccgaaggcaagattttccccaaaagagannnnnttttcnanttgttttcccccatcttaatcaatncaaaagccctaaccttaacagcccatggttggttttgcacaccaatgatacaccccaaaggagtaactactgggaataaccttcgctaatttatataaagttctgatgagttgggaacgaaaccggggtttattcccatanaaaacgaaccgccccccttagcaattggagaagtccccccccggccgatcttgagattaaagactctttctgtttcttgccattgtccgccctt

SEQ ID NO: 30551 - protein, 77 aa, Zea mays
  misc_feature: Ceres CLONE 1406088-F
  misc_feature (4)..(75): Pfam Name: DUF1909 Pfam Description: Domain of unknown function (DUF1909)
  misc_feature (68)..(68): Xaa is any aa, unknown, or other
  misc_feature (69)..(69): Xaa is any aa, unknown, or other
  misc_feature (72)..(72): Xaa is any aa, unknown, or other
MGGGNGQKSKMARERNLEKNKGAKGSQLETNKKAMSIQCKVCMQTFMCTTTEVKCEHTPKARFSPKEXXFSXCFPPS

SEQ ID NO: 30552 - DNA, 679 bp, Zea mays
  misc_feature: Ceres CLONE 1406091-F
  misc_feature: Encodes the peptide sequence at SEQ ID NO. 30553
  misc_feature (575)..(575): n is a, c, t, g, unknown, or other
  misc_feature (679)..(679): n is a, c, t, g, unknown, or other
acccgcggtggcggccgctctagaactagtggatcccccgggctgcaggaattcgcacgagaccattacctagaacatcctaatcgaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgcccccttcgcgcccccgatcgcccgattccttcagggccaaagatattccagtgtttaccaacagagtttctcgtacgtaccgggtaaaatcagtgacagttccagatcacggagttgatgtgtgtcctttggaatacaatgagtatgtcccctgccatgatggagcctatataagcagcttgaagagcctgcatacatctagggcatgaggatcttgaaagtatctgtcctcctggggagaaagcggttgttttttgtttgggtgccccctccaaaatgactacnagataccaaataggatgggccaacaagccgagactacggtatggggcgtagttaatgtccaaccattcacattccttgcttgaaggtcaaaaggagggaacagn

SEQ ID NO: 30553 - protein, 116 aa, Zea mays
  misc_feature: Ceres CLONE 1406091-F
MRRWWSPALAAVEPRSVQLLLLGVALVAASFYAGTLFGSSASPALVLPPSRPRSPDSFRAKDIPVFTNRVSRTYRVKSVTVPDHGVDVCPLEYNEYVPCHDGAYISSLKSLHTSRA

SEQ ID NO: 30554 - DNA, 644 bp, Zea mays
  misc_feature: Ceres CLONE 1406093-F
  misc_feature: Encodes the peptide sequence at SEQ ID NO. 30555
  misc_feature (440)..(440): n is a, c, t, g, unknown, or other
  misc_feature (451)..(451): n is a, c, t, g, unknown, or other
  misc_feature (508)..(508): n is a, c, t, g, unknown, or other
aagagctggagctccccgcggtggcggccgctctagaactagtggatcccccgggctgcaggaattcgcacgagaccattacctagaacatcctaatctaaaaaaaacccatcttcgtcgatcggtgtccctagcctccccctgcccggctgtcctcctcgatttcgcaagctcctggttacggcggcatctatcgttccgccgcaagggccgcatcgtctctctcgcgacgctgccccagaccgccgagataatggctggccaccgaaacagtcatggaaagcgccagtctgattttactgaaaatggaggcagtaagagaagaaatcctggcgatgatacatatgcacctggatctgatgacactgtgtatcgctacctctgtgcctctacaaaaatagggagtatcattggcaggggtggagaaatcgcaaagcagntgaggactganacccaagctaggatcaggattgggcgacagtgcccctgcatgtgatgagccgattgntacccgtatttagcaccagaggaaaactactaccatcgatggtgttaacgaagagggttgccctgatcaggaagcccccctaagagtcctgaaaagggttgcccgggttaagggcttgggaaacaaaaacccaaaa

SEQ ID NO: 30555 - protein, 80 aa, Zea mays
  misc_feature: Ceres CLONE 1406093-F
  misc_feature (63)..(63): Xaa is any aa, unknown, or other
  misc_feature (66)..(66): Xaa is any aa, unknown, or other
MAGHRNSHGKRQSDFTENGGSKRRNPGDDTYAPGSDDTVYRYLCASTKIGSIIGRGGEIAKQXRTXTQARIRIGRQCPCM

SEQ ID NO: 30556 - DNA, 820 bp, Zea mays
  misc_feature: Ceres CLONE 1406098-F
  misc_feature: Encodes the peptide sequence at SEQ ID NO. 30557
  misc_feature (64)..(64): n is a, c, t, g, unknown, or other
  misc_feature (66)..(66): n is a, c, t, g, unknown, or other
  misc_feature (803)..(803): n is a, c, t, g, unknown, or other
ggggtgttgtggggggtgggggggggtttggtttgggggggtgggtttcctctcccccccaaangnaaatccacgcggtggcggccgctctagaactagtggatcccccgggctgcaggaattcgcacgagaccattacctagaacatcctaatcgaaaaatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagccccgtggtacggccccgaccgcgtgctggacctggggcccactgtccggggaggccaccgaggttacctggacggggggagttccccggggcgacttacgggtgggaacacccggggggggttggcgggcgggacccccgaagaacgtttcggccaagaaacccgggaaggcttgggaggggggaccccacttccccggctgggggccagtggctggggccggcgcctccgggttgggggtccttccccccgggggtgtgtttcggcgcggaagaaggggggcagggggttcggggcgaagggaccggaggggggttccgaggggcgggggcttcccaagaatcctttccaagcgagggggacgtagctttggagagcaaaccgcaggggaagagccggagaggttgaatggcaaggggggaaagagggagacgncttgtgtaaatctggcg

SEQ ID NO: 30557 - protein, 183 aa, Zea mays
  misc_feature: Ceres CLONE 1406098-F
MASSTMALSSTAFAGKAVNVPSSSAFGEARVTMRKTAAKAKPAAASGSPVVRPRPRAGPGAHCPGRPPRLPGRGEFPGATYGWEHPGGVGGRDPRRTFRPRNPGRLGRGDPTSPAGGQWLGPAPPGWGSFPPGVCFGAEEGGQGVRGEGTGGGFRGAGASQESFPSEGDVALESKPQGKSRRG

SEQ ID NO: 30558 - DNA, 782 bp, Zea mays
  misc_feature: Ceres CLONE 1406107-R
  misc_feature: Pfam Name: ADK Pfam Description: Adenylate kinase
  misc_feature: SWISSPROT Homolog: EC 2.7.4.3 Adenylate kinase
cgacgaagttttatttttacccctttctctttccccccaccccacacccatcaccaaacgaattgggtaccgggccccccctcgaggtcgacgttctcgataagcttttttttttttttttttgcacaagaaaaaatcatgctgtctgaccccccatagatttagaatattcaaagaccgttccgatccaaagtcaatattattctcaaacattacgccgaaaaggcatagcacaaaagactagaacagaactgtccttccgcatatgaataaatatatatcactgtgtctctcttgttggaaggaaaaataatgccttgagcaaggctttcctcctcctgccaatgctttctgaacctgtgatgtaacttcgtggggagccttctcggctttgatgtctgtaagaacagccttctttgcgtagtaggcaatcacgggttcaatcacagtgtggaaagcagccagtcttgaccccccccccccagcgttattctcttcgcgttggatcccaggtactccggtaacatcctcaactataagggcttggggaggcgcgaacttggagtggtaactccctgcaaactcgatgggaggatcaccccttccagaatctgcttctccctccagactgaactcctccaaactcaatttcgaggactttggccgattcccgggttcactacttccctaaaactccccgagataaaatttcactctagactgtagcaaaccccccctctgttataaactccctccgggtgtttgagccccctctcttcacc

SEQ ID NO: 30559 - DNA, 631 bp, Zea mays
  misc_feature: Ceres CLONE 1406107-F
aaagctggagctcaccgcggtggcggccgctctagaactagtggatcccccgggctgcaggaattcgcacgagaccattacctagaacatcctaatcgaaaaaagtctggccaggcctctcccatatcggcctctcccttcctcttcctgtttccgagcgcaagatacgcgccccgagtgagctctagatcccgatggcctcatgccgacgcaccctgatcacggtgatcatcctcagcgacagcgcagttgccaagacgtcttcgatgaatcatatgtgaacaacaagttcaaggaccataacaaggtggcattgggggccggattccccccggaaggaggggccacttccagataagggtccttcccccctggaaaaagggggacccggccggccccgaaaaggataaaaaatccttgggggttccatttcaaccgggggagggaaagggtaggccccaaacccatgggggaaaattcatagaaaaaggtaataaactcttccacaagggggcagaagaattttcacaatagggggggggccccccggggcccgggaaaaatttccccttttgtgggggggggcgaaaaaaaagtgttgtttttttggggggaaaacccccgggggggg

SEQ ID NO: 30560 - DNA, 626 bp, Zea mays
  misc_feature: Ceres CLONE 1406109-F
  misc_feature: Encodes the peptide sequence at SEQ ID NO. 30561
  misc_feature (399)..(399): n is a, c, t, g, unknown, or other
  misc_feature (445)..(445): n is a, c, t, g, unknown, or other
  misc_feature (518)..(518): n is a, c, t, g, unknown, or other
cgcggtggcggccgctctagaactagtggatcccccgggctgcaggaattcgcacgagaccattacctagaacatcctaatcgaaaaagcctgcgctccccttctttcccgttcggctcacagcgaagaaggaagccggttagggtttccacctcctttcccctcctctccttcagcgacgaccgcgggccacaccctcgatatccttcccctcggacccggaggcgagcagcagcctccagcgcctgccacgcctgcccgtctcgttattgggaggattcgccatgtctgacatggagtccgtcgcagctcttatgaactcgacaagctccaagatacagcagcttcaggaggcatttgctgagcttgagagccagagcacggttccatggacctcangtggagcagcttgagaccactttcgtggtcttgaacagtccctcangaaaaggttgacgagctaaagagcagggagaaggagtcccaggagacggccgcaaatcagagcaaatctggancaagggaaggcaactggtggggcaaagaactgactcctttggaaaaatttgcaggaaaaagggaacggcattacttatgatcttaagaaggccgggttcccttaccgg

SEQ ID NO: 30561 - protein, 42 aa, Zea mays
  misc_feature: Ceres CLONE 1406109-F
  misc_feature (39)..(39): Xaa is any aa, unknown, or other
MSDMESVAALMNSTSSKIQQLQEAFAELESQSTVPWTSXGAA

SEQ ID NO: 30562 - DNA, 670 bp, Zea mays
  misc_feature: Ceres CLONE 1406112-F
  misc_feature (627)..(627): n is a, c, t, g, unknown, or other
tccccgcggtggcggccgctctagaactagtggatcccccgggctgcaggaattcgcacgagaccattacctagaacatcctaatcgaaaagtcgtaagtctgcgctttcatcccttattgttccaggaacaaacaaaatctacaggtttccaagacaccaggacggagacatcgaggaggcggcggagacgccgccgcgtccttccgcttctgagccgtataacaacaaacccctcggccccgtcccctctgtccatcgatcaccttgaccacgtgcctgtgccgcaggccgcagccaggcatctccggcgaatctggtttgaggcgcggagagaggatatttgcatgcgggactgatcaatcaaagcaatggcagtagcgcccatggactgcggtgctggttcgattagtctaggccacaaggttttatggccgtttcggagtacccaacagcagtagattggcgatggggtgggatatgacaggaaacaagggacagatcagttgattgctagagcccgtatccgtggatcggacacaactagacttctcgaatccggactgggaagacgcagttttcaagaggatttcgataagcgcttcagcttgccacactgacgaaatgnaaatttgatggggggacccgaggccaactacttttttctctca

SEQ ID NO: 30563 - DNA, 692 bp, Zea mays
  misc_feature: Ceres CLONE 1406117-F
  misc_feature (652)..(652): n is a, c, t, g, unknown, or other
aagctggagctccccgcggtggcggccgctctagaactagtggatcccccgggctgcaggaattcgcacgagaccattacctagaacatcctaatcgaaaaagtcggtctctctcactctctcttgtctccaagtttgtaaccctagccgccaagcttgaagctccagccgtgctcgtgtagggccgcaggccatccgggctccggcttccagcatctaccaggcgtccttagaatacggtgcagcgagcagcaagtcgccgagcagccgagccaccgccgaacacagggcgccgccgagcagccgagccgccgccgagcgccgagtcttctctcagtgacttcggtacagacgacaaactttctccacacataccgcgccactccgccactcactgtgctgacgggatggggtggtgctccccgtccacttcccggcagcttctctccacgacctcactcttcaccttcggcgcgggtctccttaccttcggcatccacctctcctacgtccacatcgagccccagcgcgctcgcacgctcgctcgggaccaattcgtccgtgactacctccgcaagaagcacgacaagtagcccgcccttctgcggtccccaggtgattggcttggtagtcggagacgatggcctggttnccatcgaggtccgacagcgaggctgggatccccggaagtg

SEQ ID NO: 30564 - DNA, 709 bp, Zea mays
  misc_feature: Ceres CLONE 1406119-F
  misc_feature: Translation starting site: 184
  misc_feature (393)..(393): n is a, c, t, g, unknown, or other
  misc_feature (645)..(645): n is a, c, t, g, unknown, or other
aaagctggagctccccgcggtggcggccgctctagaactagtggatcccccgggctgcaggaattcgcacgagaccattacctagaacatcctaatcgaaaactaaacctcacctcgccggcggccaaaaatcgaagcaccgaaccagcggctgcggcggcggcggtgcggcaagtcttgaccatggcggagctaaagcggttgtcggagagccgtgacctgacgcggattgagcgcatcggcgcgcactcccacatccgggggctagggttggactcgtccatggaggcgcgcgatacctcggagggcatggtcgggcagctccacgcgcgccgcgcctcggggctcatactccagctcatccgccagggcaagatcgcccggccgcgctgntgctccttgcgggccagcccggcactggcaagaccgcgctcgccatgggtatcgccaagtcgcttgggtgcggagacgcccttcgcctccgtcgctgcctcggagctcttctcgctcgacctctccaagacggagcggctgacgcaggccttccgcgcgccataggcgtcgcatcaaggaggaggcgagatcattgagggcgaggtcgtggagatctcaatcgaccgccctttgtcggcctctgggcgtggnggcagctcagttgctccttctgtgccactgccgctggaagcccgggcggctacgcttgaaacca

SEQ ID NO: 30565 - DNA, 592 bp, Zea mays
  misc_feature: Ceres CLONE 1406120-F
  misc_feature (278)..(278): n is a, c, t, g, unknown, or other
  misc_feature (299)..(299): n is a, c, t, g, unknown, or other
  misc_feature (538)..(538): n is a, c, t, g, unknown, or other
  misc_feature (540)..(540): n is a, c, t, g, unknown, or other
aaagctggagctcaccgcggtggcggccgctctagaactagtggatcccccgggctgcaggaattcgcacgagaccattacctagaacatcctaatcgaaaaagcaggcctccttcctcctcgctcgcggcgcctccgcctatacctgttgcggcaggcaacaaggcaggcaggcagcagcggagtgccttggtgatctacgaaagaggatggattccaggatctcgctcctctgggccctcgtctcgctcctccctctgactgggcagatccgacgnaatgaccgcagttctcaaggnaataaaagttacgggcctccttaaagcccgggggttggcaaaaaaaaaaaacgcgggtggcctggccaaaaatttccaaaaaaatttcaaggggaaggaggcccccaaaaaaagggggccaaaaccgttttttggacaccaaaaaaaaattccccggaaaaccccccgggtttgggggccgtgtcccctccagagcctttaaaacaaaaaaacccccattttttccccgggggggtgtncnggttttcccccccggggtttttccccaaaaaaaaaaggggggaaaaaaccgc

SEQ ID NO: 30566 - DNA, 698 bp, Zea mays
  misc_feature: Ceres CLONE 1406122-F
  misc_feature: Encodes the peptide sequence at SEQ ID NO. 30567
  misc_feature (322)..(322): n is a, c, t, g, unknown, or other
  misc_feature (394)..(394): n is a, c, t, g, unknown, or other
  misc_feature (415)..(415): n is a, c, t, g, unknown, or other
  misc_feature (418)..(418): n is a, c, t, g, unknown, or other
  misc_feature (504)..(504): n is a, c, t, g, unknown, or other
aaagctggagctccccgcggtggcggccgctctagaactagtggatcccccgggctgcaggaattcgcacgagaccattacctagaacatcctaatcgaaaaaaacacctccgatccgtccccgatcatcgcaccacctgtagcccacctcgctctcgagtctcgacccagcgacgagatggccgcggtggatctgaccccaaggacgcccaagaaggcctacggcggcgacggcggcgcctactacgagtggagccccgccgacctgcccatgctctccgtcgcctccatcggcgccgccaagctctcgctcgccgccggnggcctctccctccccagctactccgactccgccaaggtcgcctacgtcctacaaggcgcgggcacctgcggnctcgtcctgcccgaggcgacnaangaaaaggtggtggcggtgaaggagggcgacgcgctggcgctgcccttcggcgcgtgacgtgtggcacaacggccccgcgcgcaggncgacctcacggtgctctttctcggcgacccctcaaggggcacaagggggggcaggtccccaatttcagctcacgggtccggcgggcatcttcagggcctgtccaccgagttcggggcgcgcggggggggaatctgcggaaacccaaacccccggaggttgggggccaagcccaccgcccttggggaattgaaaa

SEQ ID NO: 30567 - protein, 98 aa, Zea mays
  misc_feature: Ceres CLONE 1406122-F
  misc_feature (6)..(99): Pfam Name: Cupin_1 Pfam Description: Cupin
  misc_feature (80)..(80): Xaa is any aa, unknown, or other
MAAVDLTPRTPKKAYGGDGGAYYEWSPADLPMLSVASIGAAKLSLAAGGLSLPSYSDSAKVAYVLQGAGTCGLVLPEATXEKVVAVKEGDALALPFGA

SEQ ID NO: 30568 - DNA, 690 bp, Zea mays
  misc_feature: Ceres CLONE 1406123-F
  misc_feature: Translation starting site: 211
  misc_feature: SWISSPROT Homolog: EC 2.3.1.119 Icosanoyl-CoA synthase
  misc_feature (274)..(274): n is a, c, t, g, unknown, or other
  misc_feature (472)..(472): n is a, c, t, g, unknown, or other
  misc_feature (473)..(473): n is a, c, t, g, unknown, or other
  misc_feature (486)..(486): n is a, c, t, g, unknown, or other
  misc_feature (503)..(503): n is a, c, t, g, unknown, or other
  misc_feature (577)..(577): n is a, c, t, g, unknown, or other
  misc_feature (610)..(610): n is a, c, t, g, unknown, or other
aaagctggagctccccgcggtggcggccgctctagaactagtggatcccccgggctgcaggaattcgcacgagaccattacctagaacatcctaatcaaaaactcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgnggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtggctggtgtgcggcgccgagctgggcagcctcagccgcgacgagctggnncgcaggtgggggnggggagggcacctacgnactcgccaccgtgctcgcctttctcgccgtcctcgccttcaccatctccgtctacatcatgtccaggcccaggnccgtgtacctcatcgacttcgcatgctacaagncgggcgacgagctcaagtgtccccaggcggagttcatcgacctggcgcgcaagtccggcaagttcgacgaggacagcctg

SEQ ID NO: 30569 - DNA, 744 bp, Zea mays
  misc_feature: Ceres CLONE 1406124-F
  misc_feature (1)..(1): n is a, c, t, g, unknown, or other
  misc_feature (407)..(407): n is a, c, t, g, unknown, or other
  misc_feature (437)..(437): n is a, c, t, g, unknown, or other
  misc_feature (443)..(443): n is a, c, t, g, unknown, or other
  misc_feature (446)..(446): n is a, c, t, g, unknown, or other
  misc_feature (447)..(447): n is a, c, t, g, unknown, or other
  misc_feature (476)..(476): n is a, c, t, g, unknown, or other
  misc_feature (486)..(486): n is a, c, t, g, unknown, or other
  misc_feature (494)..(494): n is a, c, t, g, unknown, or other
naaagctggagctccccgcggtggcggccgctctagaactagtggatcccccgggctgcaggaattcgcacgagaccattcctagaacatcctaatcgaaaaccacctccaaagtccaaaagcgaagcctacgcccgccccaacggtgaaaacgtcggaaccctagatccctctcacggtcgcgcctgtgctccaaaaccttagatccgacatgcatcagcccagagcccgctacccacccgggtatggctccagcgggggaggcggtggcgggggaggcggtagtggagtaggaagaggaggcagcggcggcggaggaaacacaactactacggccggaacacacatccacagcatcaacaccactaccagcagcagcagcagcactcgcataggaactcctcgcnacagcagcagtggctggcgcgagacagggnccccgncgnntgcggggccagtgtctggaaacgctgtgncttagacggncgctcagnttggacgctggtggactcgagtttcccaggatgggaagggtccactaaattttccagttccagaaaaacggttaagggaagagggtgggcccttgcaaaaaagggaaagagatttggggggatattttcttgaaaacggggggttgttttgggaaaaatggggaagagggttttggaaggggcgttccccctttcgaaaaaaaggctttctcttgggggtggggggggaagggagaattttgtgggggga

SEQ ID NO: 30570 - DNA, 718 bp, Zea mays
  misc_feature: Ceres CLONE 1406127-F
  misc_feature: Translation starting site: 215
  misc_feature (1)..(1): n is a, c, t, g, unknown, or other
  misc_feature (462)..(462): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (598)..(598): n is a, c, t, g, unknown, or other
  misc_feature (599)..(599): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
naaagctggagctccccgcggtggcggccgctctagaactagtggatcccccgggctgcaggaattcgcacgagaccattacctagaacatcctaatcgaaaaagtaatcactcctcagtgctcactagcccaagtcgccctaaacctagcccgggcacccgccagaccagccagcccaacaacgcaaaacgcgacgcggccaccgccttgtccatgggctcctcggcgcagctcaggcggctgaagcctctgtaccagctggtggtgaacaacatcctgaccatcgtggccgtgccgctcgccgccgcggtcctgctcaaggcggcggagctggggcccgaggagatcctggcccgggcccgcgcgctccggccggcgcacatgctcctggcggggttcctgccgggccgtggcgacggttctgtacctgacgctccggccgcgcgcggtgtacctggggnactacgcgtgcttccgcaccaaccccaactgccgcgtcccgttcgcgacgttcctgggagcactccggcgtgtgggcggggcttcgacgagcgcagcggtcggttcatgacgcgcttgctgaggggnnnncggggnnttggnnnnaaggaaacttgccctgcccgaacgcgcagcactacatccccgccgtcgcggcgacctgaagtcctcccggcgccgaggccggagctcgtcatcttctcgggccatcgacga

SEQ ID NO: 30571 - DNA, 749 bp, Zea mays
  misc_feature: Ceres CLONE 1406128-F
  misc_feature (229)..(229): n is a, c, t, g, unknown, or other
  misc_feature (331)..(331): n is a, c, t, g, unknown, or other
  misc_feature (334)..(334): n is a, c, t, g, unknown, or other
  misc_feature (386)..(386): n is a, c, t, g, unknown, or other
  misc_feature (387)..(387): n is a, c, t, g, unknown, or other
  misc_feature (399)..(399): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (463)..(463): n is a, c, t, g, unknown, or other
  misc_feature (471)..(471): n is a, c, t, g, unknown, or other
  misc_feature (558)..(558): n is a, c, t, g, unknown, or other
caaagctggagctccccgcggtggcggccgctctagaactagtggatcccccgggctgcaggaattcgcacgagaccattacctagaacatcctaatcaaaaaagaatatcgcatcgccgtcgcgtcgtcgtcgatctccccgccccgccccgcccgcgccgcggaatctgacacatctccctaatctctcctaggaccgggtgcccttacatccacgccgcaacgcanatcgccgtccgagccctcgcggtctctcgtctccccgtgcgagaggacgccggcagcagcggcgtgccagtgcggtggcttggtgggggagacccggagcgncgncagagctcgcgcccagaggtgcacggcaggcctgtttctcgcgtcggctggnngaaagcgagtanccccgggaaggacgagtgaataatcatgagctcgatctgccctttcgccgnnnagcacactggntgtggtgnatgccctgtgaaatctgataagagcaccctggggtgggccctgcaaaatctgacagaagcatcagggggggatgccccgtccctggnaagggatcatggaacaaagtccaggagagggggggatcttggtaaaaaaaagggcaccgattctccgggtgaaaccagaaaagggcccattcggtattgaccccaactttttagggtgggcccgcttaaagtggtttggtgcgccggccctccctccctaaaaagacaaaggggggccggtggccctaaat

SEQ ID NO: 30572 - DNA, 725 bp, Zea mays
  misc_feature: Ceres CLONE 1406129-F
  misc_feature: Translation starting site: 176
  misc_feature (334)..(334): n is a, c, t, g, unknown, or other
  misc_feature (410)..(410): n is a, c, t, g, unknown, or other
  misc_feature (414)..(414): n is a, c, t, g, unknown, or other
  misc_feature (516)..(516): n is a, c, t, g, unknown, or other
  misc_feature (625)..(625): n is a, c, t, g, unknown, or other
  misc_feature (627)..(627): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (701)..(701): n is a, c, t, g, unknown, or other
  misc_feature (702)..(702): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
caaagctggagctccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtgggaggnagacgggcttcgtgtggctccggcagcgccgcaaggtggaccactacttcgccaaggccggccgccacgtgcctanggcngccgagggtgggtcggcggtggccggacaagggccggctcaagaagatcacgggcgtcaaggccaaggagatggctgctgtgggtcaccctccacgagatcntgcgtcgacgacccgcccacgggtaagctccactgcaaggccatcggcggcctgtcccgcagcttccccgtcgaggccttcgaggccgaggagccggcgccgcggaaancnggcgggcgtcccccgggggcgggggggggnnnnnngnnnnnnnnnnnnnnnnnnnnnnnnnnnnnnnnnnnggnngnnnggggnnnnnnnnnnnnngc

SEQ ID NO: 30573 - DNA, 654 bp, Zea mays
  misc_feature: Ceres CLONE 1406130-F
  misc_feature: Encodes the peptide sequence at SEQ ID NO. 30574
  misc_feature (185)..(185): n is a, c, t, g, unknown, or other
  misc_feature (191)..(191): n is a, c, t, g, unknown, or other
  misc_feature (296)..(296): n is a, c, t, g, unknown, or other
  misc_feature (336)..(336): n is a, c, t, g, unknown, or other
  misc_feature (375)..(375): n is a, c, t, g, unknown, or other
  misc_feature (392)..(392): n is a, c, t, g, unknown, or other
  misc_feature (435)..(435): n is a, c, t, g, unknown, or other
  misc_feature (451)..(451): n is a, c, t, g, unknown, or other
  misc_feature (456)..(456): n is a, c, t, g, unknown, or other
  misc_feature (457)..(457): n is a, c, t, g, unknown, or other
  misc_feature (563)..(563): n is a, c, t, g, unknown, or other
aaagctggagctccccgcggtggcggccgctctagaactagtggatcccccgggctgcaggaattcgcacgagaccattacctagaacatcctaatcgaaaaacggatcaaaatcgaatccaacgctactgcctagggtttcctctgcatttcccctaccacaccccgcgccgcccacccatggnccgccngcagacgcgtccgccgagaccgccgccatcgcgcggcgcctggcctcctgcaacaccggcacccgggagcgcgcgctccgctacctcctctccgaatttctgccnggctccgcgccgcgcctctccgccaccgacctccctcagntctggaagggcatcttcttctgcttctggcacgccgacnagccgctctaccagagntcccgtcgctcgcctcccgcgtctccgtcccgccgtcccccgncgatggtgccgccttnctcgnncgctaaactcacagggtcggcgcgagtgggcccaatcgacgtccacgcctcaacagttctacctcctcaaccgccggtcctccaccagcttcctgttctcatgatnctcctccgccccgagtacttcaaggtgggtcctccggcaaaaaagcttggtccggaggcgaaagtgccctgcccctcgggggctcggacac

SEQ ID NO: 30574 - protein, 32 aa, Zea mays
  misc_feature: Ceres CLONE 1406130-F
  misc_feature (2)..(2): Xaa is any aa, unknown, or other
MXLLRPEYFKVGPPAKKLGPEAKVPCPSGART

SEQ ID NO: 30575 - DNA, 714 bp, Zea mays
  misc_feature: Ceres CLONE 1406131-F
  misc_feature: Encodes the peptide sequence at SEQ ID NO. 30576
  misc_feature (271)..(271): n is a, c, t, g, unknown, or other
  misc_feature (402)..(402): n is a, c, t, g, unknown, or other
  misc_feature (417)..(417): n is a, c, t, g, unknown, or other
  misc_feature (433)..(433): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (502)..(502): n is a, c, t, g, unknown, or other
aaaagctggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgcgnggcccggacgccggctcgccggccttctcggtgcgcgtgcgccgccgcctgccggacttcctgcagtcggtgaacctcaagtacgtgcgcctcgggtaccactacctcatcagccacggcgtgtacctggncaccatccccgtcantcgtgctggtgtgcgncgccgagctgggcagcctcagccgcgacgagtgggnnnncagggggtggggggggaaggcacctacggnactcgcaccgtgctcgcctttccctcggcgtctccgcttcaccatcttccggctacttcatgtccaggcccagggccgtgtacctcatcgaatttcaatggtaaaagccgggccgagagttcaggggggcaagggggagttctcgaccttggcgcaatcccggaaattccaaaagaaaacctggggttccaaaccggtgggtggccaaatcc

SEQ ID NO: 30576 - protein, 168 aa, Zea mays
  misc_feature: Ceres CLONE 1406131-F
  misc_feature: SWISSPROT Homolog: EC 2.3.1.119 Icosanoyl-CoA synthase
  misc_feature (65)..(65): Xaa is any aa, unknown, or other
  misc_feature (70)..(70): Xaa is any aa, unknown, or other
  misc_feature (88)..(88): Xaa is any aa, unknown, or other
MAREEQALLSTEIVNRGVEPRGPDAGSPAFSVRVRRRLPDFLQSVNLKYVRLGYHYLISHGVYLXTIPVXRAGVRRRAGQPQPRRVGXQGVGGEGTYGTRTVLAFPSASPLHHLPATSCPGPGPCTSSNFNGKSRAESSGGQGGVLDLGAIPEIPKENLGFQTGGWPN

SEQ ID NO: 30577 - DNA, 714 bp, Zea mays
  misc_feature: Ceres CLONE 1406132-F
  misc_feature: Encodes the peptide sequence at SEQ ID NO. 30578
  misc_feature (215)..(215): n is a, c, t, g, unknown, or other
  misc_feature (288)..(288): n is a, c, t, g, unknown, or other
  misc_feature (301)..(301): n is a, c, t, g, unknown, or other
  misc_feature (660)..(660): n is a, c, t, g, unknown, or other
acaagctggagctcaccgcggtggcggccgctctagaactagtggatcccccgggctgcaggaattcgcacgagaccattacctagaacatcctaatcgaaaacaggatgacaaaatttcccactccactcgaattaaaaccctagcggcaaaaccttcgctctgcgccgccgtcgcctgctcccgtcccgccaccacatccgcccaggagctcngccgtcggggaggctgctcgaggagccgcgctgtctctcccgcgccgcgaccttcgccctcgccgccgcctgnatctgcgcgatcntccggtgaggtgccggacgagccggtggtggtcgaagaagtcggggcttctcttcgagcggcggctcatcgagcgctacattgaggaccatggcaagtgccccatcaccaaggatgagcttactatggatgatatcgtgccggtcaataccaacaaggtcgtgaagcccaggcctttgcaggctgcaagcattccaggaactccttgggatttttcagaacgagtgggatgctctcatgctttctaattttgctttggagcagcagctacacacagcaagacaagaacttagtcatgcactctaccagcatgacgctgcctgccgtattatagccaggttgaagaaaggaagagatgangctagagcacttttgggctcagctgagagaagattccagcatcagttgcaggac

SEQ ID NO: 30578 - protein, 59 aa, Zea mays
  misc_feature: Ceres CLONE 1406132-F
  misc_feature (1)..(50): Pfam Name: Prp19 Pfam Description: Prp19/Pso4-like
  misc_feature (41)..(41): Xaa is any aa, unknown, or other
MLSNFALEQQLHTARQELSHALYQHDAACRIIARLKKGRDXARALLGSAERRFQHQLQD

SEQ ID NO: 30579 - DNA, 713 bp, Zea mays
  misc_feature: Ceres CLONE 1406137-F
  misc_feature: Translation starting site: 357
  misc_feature: SWISSPROT Homolog: EC 3.2.1.21 Beta-glucosidase
  misc_feature (564)..(564): n is a, c, t, g, unknown, or other
  misc_feature (570)..(570): n is a, c, t, g, unknown, or other
  misc_feature (627)..(627): n is a, c, t, g, unknown, or other
  misc_feature (634)..(634): n is a, c, t, g, unknown, or other
aaaagctggagctcaccgcggtggcggccgctctagaactagtggatcccccgggctgcaggaattcgcacgagaccattacctagaacatcctaatcgaaaaacacacttcacaagcagctcaaagctctagttctagctagctagcaaagggggggaaaatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctttactacacgatctgcaagagtaggcagccaaaatggagtccaaatgttgagcccctcggaaatcccacaaagggactggttcccctctgacttcaccttcggtgccgccacttcagcgtaccaaattgaaggtgttggaaatgaagatggaaagggggaaagcaactgggatcacttctgccacaatcatccggaaaggatactggacgggagcaattcagacattggagcgaattcgtaccatatgtacnaaacgnacgttagattgctcaaggaaatgggcatggaccgcatataggttctctatctcttgncccaaantactgccgaagggaacaaaagaaggaggatttaacccggatggcatcaagtactacagaaactcatcaacttggtgctg

SEQ ID NO: 30580 - DNA, 669 bp, Zea mays
  misc_feature: Ceres CLONE 1406138-F
  misc_feature (250)..(250): n is a, c, t, g, unknown, or other
  misc_feature (262)..(262): n is a, c, t, g, unknown, or other
  misc_feature (271)..(271): n is a, c, t, g, unknown, or other
  misc_feature (318)..(318): n is a, c, t, g, unknown, or other
  misc_feature (343)..(343): n is a, c, t, g, unknown, or other
  misc_feature (402)..(402): n is a, c, t, g, unknown, or other
cagagctggagctccccgcggtggcggccgctctagaactagtggatcccccgggctgcaggaattcgcacgagaccattacctagaacatcctaatcaaaaaaaatctggaatcctttcacgccgccactctcccctttttccttctctcttcgtcgttgtggctcctgccttcctggcctcggcgcatcgactcgcggagagggacagcacagcgcctcctccccatcctttctccattcccagatcngaagtccataanaaacatccnttttgcatctgattgagcactgtctttgtgcaagagaaacatttagntgtacttacaaacaaaagaagtggnaggatttttcagagtttattagaagaaactgtttccaggaccccagtcagagaaaaggnaaaagttttaccacggcaaaggggttggtcaatgacccccaagggaaccgccccggggaaatgggtgccacccgggggcccctaaaaaaatttttggcctggggggaaaacgcccgtctccccccaaacccggggttcaagggtgggccaaggcccccttttaatcctttgaaaaaaattgttttttggggttttcccccccggggttttttttcccccccggggggggggggcaacaaaaaaaaaccgttttggggggtggggttt

SEQ ID NO: 30581 - DNA, 714 bp, Zea mays
  misc_feature: Ceres CLONE 1406140-F
  misc_feature: Translation starting site: 215
  misc_feature (530)..(530): n is a, c, t, g, unknown, or other
  misc_feature (560)..(560): n is a, c, t, g, unknown, or other
  misc_feature (591)..(591): n is a, c, t, g, unknown, or other
  misc_feature (592)..(592): n is a, c, t, g, unknown, or other
  misc_feature (599)..(599): n is a, c, t, g, unknown, or other
  misc_feature (608)..(608): n is a, c, t, g, unknown, or other
aagagctggagctccccgcggtggcggccgctctagaactagtggatcccccgggctgcaggaattcgcacgagaccattacctagaacatcctaatcgaaaaagtaatcactcctcagtgctcactagcccaagtcgccctaaacctagcccgggcacccgccagaccagccagcccaacaacgcaaaacgcgacgcggccaccgccttgtccatgggctcctcggcgcagctcaggcggctgaagcctctgtaccagctggtggtgaacaacatcctgaccatcgtggccgtgccgctcgccgccgcggtcctgctcaaggcggcggagctggggcccgaggagatcctggcccgggcccgcgcgctccggccggcgcacatgctcctggcggggttcctgccggccgtggcgacggttctgtacctgacgctccggccgcgcgcggtgtacctggtgggactacgcgtgcttccgcaccaaccccaactgccgcgtcccgttcgcgacgttcctggagcacttccgncgtggtggcggggcttcgacgagcgcagcngtccgggtcatgacgcgcttggctgagcggnnccggggnctggggggnaagaaaacgtgccctgccgtacgcgcagcactacatcccgccgtcgcgcgacctggagtccctcccgcggcgaggccgagttcgtcatcctctcgggcatcgacga

SEQ ID NO: 30582 - DNA, 741 bp, Zea mays
  misc_feature: Ceres CLONE 1406143-F
  misc_feature (349)..(349): n is a, c, t, g, unknown, or other
  misc_feature (424)..(424): n is a, c, t, g, unknown, or other
  misc_feature (427)..(427): n is a, c, t, g, unknown, or other
  misc_feature (435)..(435): n is a, c, t, g, unknown, or other
  misc_feature (468)..(468): n is a, c, t, g, unknown, or other
caaagctggagctcaccgcggtggcggccgctctagaactagtggatcccccgggctgcaggaattcgcacgagaccattacctagaacatcctaatcgaaaaagtgtttcgcactttgctattcagcttcgttcttcaccggttcaccctagccgccaccccaacccccagcgacagggaccttcgccgccaggccgcccccaatccctagcgactgcgagcaccgtcgccaggcgccgtgcagcgagcgtcgccgcctggcgaagtcgcgcgactcgtgccctgcagcgagcgccgctgtcccgcacccaccgtcgaacggctgccgatgcccaacgccctgcagcngagttgcgccgtcgtccgcttcctctcgctggtaacctcgtggtttcgatttggacagattgctcgtgacttggntgntgcgccgnccgaccgagcctcctttcccctaggtccctaanccgaaagtctaaatcttgggggaggtctgtcatgggcaatttgagcttacgatctatgaaacgggccttaaggaatggggactgggaattaagggggtgggaaaatggaaagcctttttagggtttgggggaaaggggaaatgtggctttatggaatcggaaagccttttggggaagttttaacattttttgggggattgggggagggtttagaactttcccaaaacttttaatccaaaatggggaaaaaaaataatggcgggggaaaaaaaa

SEQ ID NO: 30583 - DNA, 697 bp, Zea mays
  misc_feature: Ceres CLONE 1406147-F
  misc_feature: Encodes the peptide sequence at SEQ ID NO. 30584
  misc_feature (328)..(328): n is a, c, t, g, unknown, or other
  misc_feature (355)..(355): n is a, c, t, g, unknown, or other
  misc_feature (356)..(356): n is a, c, t, g, unknown, or other
  misc_feature (589)..(589): n is a, c, t, g, unknown, or other
  misc_feature (595)..(595): n is a, c, t, g, unknown, or other
  misc_feature (596)..(596): n is a, c, t, g, unknown, or other
  misc_feature (616)..(616): n is a, c, t, g, unknown, or other
caaagctggagctccccgcggtggcggccgctctagaactagtggatcccccgggctgcaggaattcgcacgagaccattacctagaacatcctaatcgaaaaaaggcttcgttctgctctccggctctcccgcatccaccccgtctcatccccaatccgaccacctcatccctcgcctccatggccctacccctcgcgtcaccggcgggggcatgagccggtgactgctcacgcggcctcgtctgtctgcgcacgcgcgcggggtcggcgagtgagcattgcggcggtccgcgatcgcccgtgggggagcatggcgtcgcgggcggnggtcgggccgggcgggcccggcgcggnngtctgggcgggctgaagacctacttcaagaccccccgaggggcggcacaaagctgcagtatgagaagacgcactccccccgccgtcgtgcactacagccacagcggcaagaccgtctcccagatgacagtggcatatttgaaggagaagccagcagggcagggttccacgcctttcaacacaagtgctggtagtgggaatgcgtctgcaactgcaagacttctcggcactggnaatggnnagcgggcacttagcttcggnagcatggtaccaggcaggctgtctcaggaacaccgcatgggtgagggaatggggtgtccacataagcaagggaatcaaagc

SEQ ID NO: 30584 - protein, 73 aa, Zea mays
  misc_feature: Ceres CLONE 1406147-F
  misc_feature (40)..(40): Xaa is any aa, unknown, or other
MTVAYLKEKPAGQGSTPFNTSAGSGNASATARLLGTGNGXRALSFGSMVPGRLSQEHRMGEGMGCPHKQGNQS

SEQ ID NO: 30585 - DNA, 635 bp, Zea mays
  misc_feature: Ceres CLONE 1406149-F
  misc_feature (335)..(335): n is a, c, t, g, unknown, or other
  misc_feature (410)..(410): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (454)..(454): n is a, c, t, g, unknown, or other
  misc_feature (455)..(455): n is a, c, t, g, unknown, or other
  misc_feature (459)..(459): n is a, c, t, g, unknown, or other
  misc_feature (460)..(460): n is a, c, t, g, unknown, or other
  misc_feature (470)..(470): n is a, c, t, g, unknown, or other
  misc_feature (557)..(557): n is a, c, t, g, unknown, or other
  misc_feature (558)..(558): n is a, c, t, g, unknown, or other
  misc_feature (573)..(573): n is a, c, t, g, unknown, or other
aaagctggagctccccgcggtggcggccgctctagaactagtggatcccccgggctgcaggaattcgcacgagaccattacctagaacatcctaatcaaaaaaatccccatcaaacccccggacatttctggtcgcaccctcctccggccctcccagccgctaagccctctggaaccttcgagagctcgatcggatcggagcccctgccatggccgacgaggcgaaggcgaaggtaatgcggcgttctcagccggccgcttcgaggaggcggcgcggcacttcacggacgccatcgcgctcgcccgggcaacacgtctctactccaccggtcggngggctcgctcactccacgctactcgacgctctcgcgacgcgagaagacgtcgagctcagcctgactggggcaggnctactccccgctcgggcgcgcaccnnnnnccttcggggacgccnncagnngccgtcgccnacaagaagaggggccttgcgctcgaccccagcaacgaggtctccagggcgggggctcgaggaccccaagaaggccgccgcccccggnncgggggttggggggnctttcgggccccgaagccattgggcagaatgtttccaggccccccaaaaggggggacaaaaa

SEQ ID NO: 30586 - DNA, 706 bp, Zea mays
  misc_feature: Ceres CLONE 1406150-F
  misc_feature: Encodes the peptide sequence at SEQ ID NO. 30587
  misc_feature (532)..(532): n is a, c, t, g, unknown, or other
  misc_feature (660)..(660): n is a, c, t, g, unknown, or other
  misc_feature (696)..(696): n is a, c, t, g, unknown, or other
aagctggagctccccgcggtggcggccgctctagaactagtggatcccccgggctgcaggaattcgcacgagaccattacctagaacatcctaatcgaaaaacatgttacagcgactcggcctgccgcgatttttataatgcgccgcggtggccgtcgctagtggtacatatcagcaccgcccctgcctcgaggttgcgtgttttgttctctgtgagcgccgtgggtgttgatggcgtcaacggcgtactcgcggccatccaagccgccagggccggcggccggagacaggagcggaccgcggctgggcaaggagctcggcaggatcgagcccaagaagctgggcatcgggctggttgccggctgctgcttcgcgctgctcacctacctctcctttgcccggctgttttgcatctactcgccggttttcgacagctcgtcgtccatggtgttgaaagacatgcccgcagcaacgacgacggtgccgggtacagctacaggggcgctgcccgtggagcaaaaggccaagtggnagagcagaaagaggttcgtgaccctgaggcggacccgcacatgcccaacttaccggaggtcacagaaaaggatcagcaggagggagccacggcgacgaaaccagccggtggtgcattattacaggagncaagatcacctgcgacgagaacggcgtcgacgaggncttccgtacg

SEQ ID NO: 30587 - protein, 158 aa, Zea mays
  misc_feature: Ceres CLONE 1406150-F
  misc_feature (101)..(101): Xaa is any aa, unknown, or other
  misc_feature (143)..(143): Xaa is any aa, unknown, or other
MASTAYSRPSKPPGPAAGDRSGPRLGKELGRIEPKKLGIGLVAGCCFALLTYLSFARLFCIYSPVFDSSSSMVLKDMPAATTTVPGTATGALPVEQKAKWXSRKRFVTLRRTRTCPTYRRSQKRISRREPRRRNQPVVHYYRXQDHLRRERRRRGLPY

SEQ ID NO: 30588 - DNA, 716 bp, Zea mays
  misc_feature: Ceres CLONE 1406153-F
  misc_feature: Translation starting site: 233
  misc_feature (362)..(362): n is a, c, t, g, unknown, or other
  misc_feature (369)..(369): n is a, c, t, g, unknown, or other
  misc_feature (446)..(446): n is a, c, t, g, unknown, or other
  misc_feature (467)..(467): n is a, c, t, g, unknown, or other
  misc_feature (497)..(497): n is a, c, t, g, unknown, or other
  misc_feature (498)..(498): n is a, c, t, g, unknown, or other
  misc_feature (549)..(549): n is a, c, t, g, unknown, or other
  misc_feature (564)..(564): n is a, c, t, g, unknown, or other
  misc_feature (596)..(596): n is a, c, t, g, unknown, or other
  misc_feature (640)..(640): n is a, c, t, g, unknown, or other
aaagctggagctccccgcggtggcggccgctctagaactagtggatcccccgggctgcaggaattcgcacgagaccattacctaaaacatcctaatcgaaaaagaggctaaacccccgtctaaccctgctgccgtgccgcttgccactactccgcttcgttctccgccgcctccccggacgtccggaaacttctagattgaagggggatagccattggcgtcaacgtgtgtgatggaggtcaggggactggggcagctcctggcggcgctggccgcggcgttcttcgtccgcgccatcgcgggacccggccccgccctccttccgccggcggaggacacggaggccgacgaggccgacgcgnaggctgncgagggaggtggtggtgttgtgccgcccgtgaccatccggtgggctcgcatcacctgcgcactgaagaacaagcgcngggaagtggcaaggtttctgnttgtcaatgtgtcaggggaggcgaaaccgnngaggctgcttgcactaatgggggcatcgggctctggcaaacaactttgctncatgtgctagcaggncagctcgccgcatcgtcttcctttgcactttncggggttctgtatatcaatggcggcctatctcgagggcggatantagattgcttttgtcagcaggaagacctgtcttctacagctcactgtgcggagacgctctcactgctgctgagctc

SEQ ID NO: 30589 - DNA, 720 bp, Zea mays
  misc_feature: Ceres CLONE 1406159-F
  misc_feature: Encodes the peptide sequence at SEQ ID NO. 30590
  misc_feature (581)..(581): n is a, c, t, g, unknown, or other
  misc_feature (683)..(683): n is a, c, t, g, unknown, or other
ctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgaccctccgggagaagtacgggcccatcttcacccatggcggatggggcagcgcacccctcatcgtgggtcacctcggcggagctcatccacgagggcgctgggtgaagcagggccccatgtttcgcgagcccggcccgaggacagcccccaccgccctctcttcagcggtcggnaagtgcaccgtcaactcggcgcctacggccccccctggggcgtgctctgcgccgcacttcgtcccgccgagatcgtgtcccgcaccgcgtcagggctctctnggaattcgggaaggggggccggggacgcgcacttgcc

SEQ ID NO: 30590 - protein, 164 aa, Zea mays
  misc_feature: Ceres CLONE 1406159-F
  misc_feature (119)..(119): Xaa is any aa, unknown, or other
  misc_feature (153)..(153): Xaa is any aa, unknown, or other
MDVNDVLLVVLAAALAAMWWRRCSKTGGVDGLPPGPPGWPVVGNLFQVILQRRPFMYVVRDPPGEVRAHLHPWRMGQRTPHRGSPRRSSSTRALGEAGPHVSRARPEDSPHRPLFSGRXVHRQLGAYGPPWGVLCAALRPAEIVSRTASGLSXNSGRGAGDAHL

SEQ ID NO: 30591 - DNA, 719 bp, Zea mays
  misc_feature: Ceres CLONE 1406161-F
  misc_feature: Translation starting site: 180
  misc_feature (585)..(585): n is a, c, t, g, unknown, or other
  misc_feature (586)..(586): n is a, c, t, g, unknown, or other
  misc_feature (611)..(611): n is a, c, t, g, unknown, or other
  misc_feature (629)..(629): n is a, c, t, g, unknown, or other
  misc_feature (672)..(672): n is a, c, t, g, unknown, or other
  misc_feature (680)..(680): n is a, c, t, g, unknown, or other
aagctggagctccccgcggtggcggccgctctagaactagtggatcccccgggctgcaggaattcgcacgagaccattacctagaacatcctaatcgaaaaaaaaccccacagaagcgtttccttcgctcgcttcacttcgctccgccgcgtcctcgaaagtcgaaacccccacccgtcatggagccacccgcgtggtcgccgccgcgtgaggaggaggaggagaccgagatcgacttcgacgaggaggaggacccggaggaggtggagccgtggttcacgtcctccggctcggagccggagctagaaccagagccagagccgaagcacccggcgccgaccccatcccccgcccccgcttgggctgagccggagcagcagccggctccggtcacggcggtggaggcgacgaaaaaagggcgagggggaggatgcgaggccgcggtggcccgggtggcccggcgcgagcgtgttccgcctggtggtgcccgcggacaaggtcggcggaatcatcgggcgccgcggcgacaccatcaagcgcctctgcgacgagacccgcgcccgcgtccgcgtcctcgacgcccgnnacgggggacggggccttcagccggnattgttttagtgtctgcnaggagaaaaagttgaagcagagttgtcacctgcaatgaatgcntgcattangatcttttcagcatataacgaggatagaagagatccatt

SEQ ID NO: 30592 - DNA, 704 bp, Zea mays
  misc_feature: Ceres CLONE 1406163-F
  misc_feature: Encodes the peptide sequence at SEQ ID NO. 30593
  misc_feature (522)..(522): n is a, c, t, g, unknown, or other
  misc_feature (542)..(542): n is a, c, t, g, unknown, or other
aaagctggagctccccgcggtggcggccgctctagaactagtggatcccccgggctgcaggaattcgcacgagaccattacctagaacatcctaatcgaaaaatcatcagtcatcacataccgccaagaccacatcggcacatcgacgtgagctcgtgcgtgagtgccctggtcgacgaccgctcgcgcgccatgcactcaacgacgacggcgccgctgctgcagccgtccgccgcctcgagcaaggaggggccggggccggcgccgtctcatcacgctgagggcagccgctatctggaggctatcctggccgacgcgtccaagccgtgaatttgtcgtgcctagcaaggcacccgcctgtagctgacgctgctgctgcgcatgcagctactggcgtcgcccatctacttgatcaactacgacaggtccatgtgcacgcacatcttctggcggcaggtcggcaacatcgagctcgacgactcctcgctgcggtacacggacatccagtgcatggactactgnctcatgctgagtatgaccancttcatgcagacactgtgcaagcagctttacgaggcataaaagcagcgcatgctgcagcagtacctgcaaatatcgaggccgatgttcatggacactgcctgacatctgaccgatgctacgacttctacgatcgagtctgctcctcctcgcgagtcagatgg

SEQ ID NO: 30593 - protein, 66 aa, Zea mays
  misc_feature: Ceres CLONE 1406163-F
  misc_feature (47)..(47): Xaa is any aa, unknown, or other
  misc_feature (54)..(54): Xaa is any aa, unknown, or other
MQLLASPIYLINYDRSMCTHIFWRQVGNIELDDSSLRYTDIQCMDYXLMLSMTXFMQTLCKQLYEA

SEQ ID NO: 30594 - DNA, 694 bp, Zea mays
  misc_feature: Ceres CLONE 1406166-F
aaagctggagctccccgcggtggcggccgctctagaactagtggatcccccgggctgcaggaattcgcacgagaccattacctagaacatcctaatcgaaaaattgtccagccttcctcaggcagcttcgagttccacgacgagagcaccggcagccgcacatgcgtttgtctcctcgccggaccttcccggcaccggcgtcgggtctccctcggggtccactacactccatagcaccgccgacgcacaaggacatggcctcctccgctacctatctcatgctcgccagcgcccacgctcccctcgctcctctcataaggccaccgccgatggaccttgacgcgagaaccgccgcaacctccatcactacgcgcgaaagagccagtgtccctctgttagtcaactccgctgcgtgccggccgaaactgccgcgccgtggctgcacccatatctgcagagactcgtccctccagggcccttcgggcgctgattctcctggtcaagcgcatcaggatctgaagaagagcgaggcggagtcagaggctgccgctcggactgccgaaggcactgatggcacgttaagcgactggagaacggcggtgttcatcttcgggatctggacgggaatcatggactaacgtcttcctgctcgggcctaaccagacacgttctcgagaaaccttcgtttttggca

SEQ ID NO: 30595 - DNA, 719 bp, Zea mays
  misc_feature: Ceres CLONE 1406167-F
  misc_feature: Translation starting site: 194
  misc_feature (516)..(516): n is a, c, t, g, unknown, or other
  misc_feature (517)..(517): n is a, c, t, g, unknown, or other
  misc_feature (677)..(677): n is a, c, t, g, unknown, or other
ggagctccccgcggtggcggccgctctagaactagtggatcccccgggctgcaggaattcgcacgagaccattacctagaacatcctaatcgaaaaatctcgccctcgctcacctacatctccgtccgcaagcgtcagccaggctgccccgggaggccgggaggaagcagatcggagaaggtgatctgttgtaatggctcgattgtacatcggcaacctggatccccgggtgaccgctcgggagctggaggacgagttccgcacgttcggggttcttcgcagtgtctgggttgctcggaaaccacctggctttgcgtttattgattttgatgataagagggacgcagaggatgcaatccgtgacctagatggcaagaatggatggagagttgagttatctcgtaatgccagcggtgggtcgtggaggtcgtgaccggcatggtgggtctgagtccaagtgttacgagtgtggtgagactggccactttgctcgtgagtgcgttttggaggatgggnntctggaggtctaggcagcggaaggcgccaaagccgtagccgtagccggcagtcgcagtcccaataattcgccggagtccaagttacgggtagaaagggagtacagtcctgcagcacgctctcccaaggcgtcgtagcgtctcaccagctcgtggagccancctatagcaggtcacaccagcacaaaggtggcacgtgaagaa

SEQ ID NO: 30596 - DNA, 704 bp, Zea mays
  misc_feature: Ceres CLONE 1406168-F
  misc_feature: Encodes the peptide sequence at SEQ ID NO. 30597
  misc_feature (401)..(401): n is a, c, t, g, unknown, or other
aaagctggagctccccgcggtggcggccgctctagaactagtggatcccccgggctgcaggaattcgcacgagaccattacctagaacatcctaatcgaaaactcgtctccctccccagatccaaatcgcgcaggaccaggcatcccatccaggcggttattggtcttcttgcgtgcgcaggtgagccctctccctctctccctcctctgcgtgctcccttttttttcgatcaagccgctgtgccgtggccatgtcccctgcggcagggcgtcttcaatccatggctgcctcccctgcgtgctccctctattttcctcggtcgacggctgcggagtggccagacccgacgtactcggtactacctctacaggcgagacagcttcgagcaagccgacattgntcgtcctcttcatcgccggctacggcatctccatgctcttcgggaccatcgtcggcatcgctctggtataatcaggggcggaagaggccgtgcggcacgtactgcatcagctacatcctcaggtggatcaccaagtagtctccgcagaacaaagttcttatgattgggcgggtccttggtgccattgccacttcgctgctcttctcaccgtttgagtcccgggtcgtggcatatcacagcaagaaaggatttgatccacaatgcttgtctataatgttcccagggatatatttcttgcaaggt

SEQ ID NO: 30597 - protein, 48 aa, Zea mays
  misc_feature: Ceres CLONE 1406168-F
MIGRVLGAIATSLLFSPFESRVVAYHSKKGFDPQCLSIMFPGIYFLQG

SEQ ID NO: 30598 - DNA, 658 bp, Zea mays
  misc_feature: Ceres CLONE 1406169-F
  misc_feature: Encodes the peptide sequence at SEQ ID NO. 30599
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (598)..(598): n is a, c, t, g, unknown, or other
aagctggagctccccgcggtggcggccgctctagaactagtggatcccccgggctgcaggaattcgcacgagaccattacctagaacatcctaatcgaaaaaccacgctccggtcagcctcgcctcccttctccgtctcattcccccaatcccacgccactcccgcaggaatccccacccaaattcccgtctccccgatcgccgcccttctcggtgcccgtaaaccctacccccggagtcgcccgtgcgctgtcgtgcccgcgttgccaccgtcggtggtccgcggcgcccgtaaccaaaacctaaccgcagcctgcagatcccgattccgcagggaggcgggagaggtgaaggccgcctcgccgcagagggagcccgcgggcgcgcgcaaggagtggcgcgccgtccccggttcctcgctccgctccaatggcgccgaggatgccgcggagcacgggaaactggggcagtcggaggacgagctatctacgaggaannnggcggtggactggaggacttctgcgcatcacattgatggggagcgaggctcagcgaggacatctgcacagcgctggagagcgtgtgcgcaaaaggaganctgcagcagtcagatggagttcgtggcgcagcatgcacaccgagatcatcagggaaaaag

SEQ ID NO: 30599 - protein, 218 aa, Zea mays
  misc_feature: Ceres CLONE 1406169-F
  misc_feature (165)..(165): Xaa is any aa, unknown, or other
  misc_feature (166)..(166): Xaa is any aa, unknown, or other
  misc_feature (199)..(199): Xaa is any aa, unknown, or other
AGAPRGGGRSRTSGSPGLQEFARDHYLEHPNRKTTLRSASPPFSVSFPQSHATPAGIPTQIPVSPIAALLGARKPYPRSRPCAVVPALPPSVVRGARNQNLTAACRSRFRREAGEVKAASPQREPAGARKEWRAVPGSSLRSNGAEDAAEHGKLGQSEDELSTRXXAVDWRTSAHHIDGERGSARTSAQRWRACAQKEXCSSQMEFVAQHAHRDHQGK

SEQ ID NO: 30600 - DNA, 715 bp, Zea mays
  misc_feature: Ceres CLONE 1406170-F
  misc_feature: Translation starting site: 327
  misc_feature (397)..(397): n is a, c, t, g, unknown, or other
  misc_feature (467)..(467): n is a, c, t, g, unknown, or other
  misc_feature (701)..(701): n is a, c, t, g, unknown, or other
aagctggagctccccgcggtggcggccgctctagaactagtggatcccccgggctgcaggaattcgcacgagaccattacctagaacatcctaatcgaaaaaacacacaaacacatcagcattcagcagtagctaatcgagcatcgtcgccttagctcctctcctcttctctccgtcgtcgtggaacttctctccgccggctgccatataaaggagaagaagagaacagcaacgctagctagtcggccggcctccatcgccgccggcgtcgactagctagctaactctcgatctccagttcctgccccccaactccgtcgtcagcgatggcaggaggcctcttctccatggctcacccggccatcaccctctccggcatcgcaggaaacatcatctnccttcctggtgttccttgcacccagtggcgactgttcctgcaggtgtaccggaagaagtcgacgggcggnttcagctcggtggccgtacgtggtggcgctcttcagctcgggtgctgtggatcttctacgcgctggtgaagaccaactcgaggccgctgctgaccatcaacgccttcggctggcggcgtggaggcggcctacatagtcctctacctggcgtacgcgccgcggcgggcgcgcctgcggactctggctacttctccctggtgggacgtggcggcttcgcgcttcgtcgtcgcgtcngggctcttcgccgt

SEQ ID NO: 30601 - DNA, 712 bp, Zea mays
  misc_feature: Ceres CLONE 1406171-F
  misc_feature: Translation starting site: 137
  misc_feature: SWISSPROT Homolog: EC 1.3.3.9 Secologanin synthase
  misc_feature (518)..(518): n is a, c, t, g, unknown, or other
  misc_feature (591)..(591): n is a, c, t, g, unknown, or other
  misc_feature (623)..(623): n is a, c, t, g, unknown, or other
  misc_feature (642)..(642): n is a, c, t, g, unknown, or other
tggagctccccgcggtggcggccgctctagaactagtggatcccccgggctgcaggaattcgcacgagaccattacctagaacatcctaattgaaaaacacaaaagagagaaccggcggcgagctaggagctagccatggacggacacggcgcggtctcaccgtggagcgtgctaggcggggcggcggctgtgctgctcctgtggttggcgtcgcaggtgctggagtgggcctggtgggcgccccggcgcgtgaaccgtgcgctgagggcgcagggcctgaggggcacccggtaccgcctcctctgcggcgacctcatcgaggagcagcgtctccgcgcggcggccctggcaaggcccgtcccccgtggatcggccacacgacttcgtccctcgcgtcgcgcctttccttcaccgcgtcctccaagagcacggcaagtctcgtttaaccatgggtttggggccgaccccaagagttctaatcaccgatcccgagcttgggccgggggagtgctgtcgnaaataggtgtggcgaccttcgtgaagtcgctgctctctcccctgtcacgctggctggttgctggggctcgccncccttgacgggggaaaagtgatccacgcatcngaggattctgaatccggcnatcaacggcgagaagcttgagggaatgctgcccgcattcctagcatggtgcaacgaactgggtgaacaga

SEQ ID NO: 30602 - DNA, 715 bp, Zea mays
  misc_feature: Ceres CLONE 1406174-F
  misc_feature: Encodes the peptide sequence at SEQ ID NO. 30603
ggagctccccgcggtggcggccgctctagaactagtggatcccccgggctgcaggaattcgcacgagaccattacctgaacatcctaatcgaaaaaactacatcccacctacctcctcgcatcaggcaggcgggcctcgcgtttataagccacccttcctctcctccacggccctcgccctgcaaagcacagacacaaaccacgagcgcgaggcacgacctacatcgaatcggccacgaaccaccatggcggcctcacgcgcgctcctccccagcccgcaggtgagccctgcgagcgcgcggctccgcctggccgcggccgtgccgtcgtcgctcacgctcgcggcgcgcggcgggtccgtggtcggcgcgcgtctcagcgtgaggagcgcgatcttgacgtcgcccgagcccgtggcgcccaccgagtggatggcagcacgtcgaatctcagcagccgccgctgaacgatacggtgggacccaagtcgtgggagctgggccaccgagatctgaatgagggcagatatgacccgggcttggtaactctcgcgtacgctggatagggcctacgggaatgcccccgggcgcagttccttcgcgaagggtggccaagttcgacgcggttcatcaagggcaaagggaaccaagggggccccgcacaggggggggcggcccgaacaggcccgggtttcccaagggagggcccccccgcct

SEQ ID NO: 30603 - protein, 90 aa, Zea mays
  misc_feature: Ceres CLONE 1406174-F
MAASRALLPSPQVSPASARLRLAAAVPSSLTLAARGGSVVGARLSVRSAILTSPEPVAPTEWMAARRISAAAAERYGGTQVVGAGPPRSE

SEQ ID NO: 30604 - DNA, 637 bp, Zea mays
  misc_feature: Ceres CLONE 1406177-F
  misc_feature: Encodes the peptide sequence at SEQ ID NO. 30605
  misc_feature (151)..(151): n is a, c, t, g, unknown, or other
  misc_feature (177)..(177): n is a, c, t, g, unknown, or other
  misc_feature (210)..(210): n is a, c, t, g, unknown, or other
  misc_feature (219)..(219): n is a, c, t, g, unknown, or other
  misc_feature (233)..(233): n is a, c, t, g, unknown, or other
  misc_feature (254)..(254): n is a, c, t, g, unknown, or other
  misc_feature (277)..(277): n is a, c, t, g, unknown, or other
  misc_feature (297)..(297): n is a, c, t, g, unknown, or other
  misc_feature (348)..(348): n is a, c, t, g, unknown, or other
  misc_feature (416)..(416): n is a, c, t, g, unknown, or other
  misc_feature (533)..(533): n is a, c, t, g, unknown, or other
ggagctccccgcggtggcggccgctctagaactagtggatcccccgggctgcaggaattcgcacgagaccattacctagaacatcctaatcgaaaagcaccaccaaccaaccagtgctgccctccgccgatccactgacctaccgcgagcngccatggcgacccgcgcggtcctggnccgcacattagggctgttcctccccgcgcgcgncgcaaacgncgcgaacggtggcngggaaggcggaccggatccgnaagtttgctgggcagcccccggnaactccttcatgaatccggntacagcaccggggagcggggggggggggggggccctttttacggtttattngagggcccgggggcccccgaaaccccgccttttggtgttggttcaaaggggccccgggggccctcccntaataagggggaaaaaagattgggctttttggaaaaccccgggggggggcctttttttaacccccccccccgaaaaaaaggggaaaaatttttttttttttccccccccgggggggnttataaaaaacacacaccccccccccaaggggggggtgcgggggggaaaaaaaaaaacctcgggggcccaaaattttgtgtggggggagggggggggggggccc

SEQ ID NO: 30605 - protein, 161 aa, Zea mays
  misc_feature: Ceres CLONE 1406177-F
  misc_feature (8)..(8): Xaa is any aa, unknown, or other
  misc_feature (19)..(19): Xaa is any aa, unknown, or other
  misc_feature (22)..(22): Xaa is any aa, unknown, or other
  misc_feature (27)..(27): Xaa is any aa, unknown, or other
  misc_feature (34)..(34): Xaa is any aa, unknown, or other
  misc_feature (48)..(48): Xaa is any aa, unknown, or other
  misc_feature (65)..(65): Xaa is any aa, unknown, or other
  misc_feature (88)..(88): Xaa is any aa, unknown, or other
  misc_feature (127)..(127): Xaa is any aa, unknown, or other
MATRAVLXRTLGLFLPARXANXANGGXEGGPDPXVCWAAPGNSFMNPXTAPGSGGGGGALFTVYXRARGPPKPRLLVLVQRGPGGPPXIRGKKDWAFWKTPGGGLFLTPPPEKKGKNFFFFPPPGGXIKNTHPPPKGGVRGGKKKTSGAQNFVWGEGGGGP

SEQ ID NO: 30606 - DNA, 718 bp, Zea mays
  misc_feature: Ceres CLONE 1406178-F
  misc_feature: Translation starting site: 256
  misc_feature: SWISSPROT Homolog: EC 2.7.7.27 Glucose-1-phosphate adenylyltransferase
  misc_feature (52)..(52): n is a, c, t, g, unknown, or other
aaagctggagctccccgcggtggcggccgctctagaactagtggatcccccngggctgcaggaattcgcacgagaccattacctagaacatcctaatcgaaaaaaaaaaacgcacgggggagcttgggagacttcacgacaaatcgacgatcgccgcttctcttggccattgtagagggagagagagagcgcgagcgacctaggtcagtcggtttcggttttgggcgtcagcttcagctatccgcgaccgcgacgatgggtctgcgcgtggccgccaccgcgccagctccggccggagtgcgcgtgctcggcaggggcgccgcgcgcgtgacgccgcgaccgtgggcggctgtcggaggcaggagacgcttctccgtgcggatgtccgtcgcgaccaccgaggccaccaccaccatcgccgtgtgcgcctcggaggaccgagcgctggaggctaggaactcccagacggtggtgagggtcatcctcggaggtggcgccgggacccggctcttcccgataccagacgtagggcccagcccgaggtgccaattggcgcggcgtacccgctcatcgaggtgtcgatgaccagctgcataaacagggggaacaggaaggcccacctcctcccgcaggttaacttgcaatccctcaatcgccacctctccaaaagctacaatttcgcaatgggggggccatcggagacggattcgccaaggtc

SEQ ID NO: 30607 - DNA, 679 bp, Zea mays
  misc_feature: Ceres CLONE 1406180-F
  misc_feature: Encodes the peptide sequence at SEQ ID NO. 30608
  misc_feature (246)..(246): n is a, c, t, g, unknown, or other
  misc_feature (289)..(289): n is a, c, t, g, unknown, or other
  misc_feature (377)..(377): n is a, c, t, g, unknown, or other
  misc_feature (399)..(399): n is a, c, t, g, unknown, or other
  misc_feature (418)..(418): n is a, c, t, g, unknown, or other
  misc_feature (436)..(436): n is a, c, t, g, unknown, or other
  misc_feature (437)..(437): n is a, c, t, g, unknown, or other
  misc_feature (440)..(440): n is a, c, t, g, unknown, or other
  misc_feature (476)..(476): n is a, c, t, g, unknown, or other
  misc_feature (483)..(483): n is a, c, t, g, unknown, or other
  misc_feature (647)..(647): n is a, c, t, g, unknown, or other
tggagctccccgcggtggcggccgctctagaactagtggatcccccgggctgcaggaattcgcacgagaccattacctagaacatcctaatcgaaaagctggtgcttctacggggcctggcgatttgaattcgagtggtgcgtgtatagagcgtgagagagagaaaagagagtggctcttgcgctctgcagtccagttcttgaatccagagctgcgattcgtgctcgcctgacgccgatgggccgnagcctgagcccgctgctacggcaggagctggacaacctggacnaggacgctgacagcccgcgcgccgccatgaaggcgcttcagtcgtacgccagaacacctggactccagtccatcccgcacttcgtcgncgaggtctccgacaccaacgcngccgggggccgggggcggnagcggcatgcccaccggnnggngattcaccatctcgctctaccaggggcttggccggntgcaggnccccaacattggggcccaaaatcggaacatcagggccaccatcatgggccgctctccttccgggggggggtccttcccgctcaacaggctggttcccaggggggggcccgccattcggggggacgggatcgacccctcccgccacaagaggggaaaaagggcgnatatattgccctccctctggagccgcttgagg

SEQ ID NO: 30608 - protein, 85 aa, Zea mays
  misc_feature: Ceres CLONE 1406180-F
  misc_feature (5)..(5): Xaa is any aa, unknown, or other
  misc_feature (6)..(6): Xaa is any aa, unknown, or other
  misc_feature (18)..(18): Xaa is any aa, unknown, or other
  misc_feature (20)..(20): Xaa is any aa, unknown, or other
  misc_feature (75)..(75): Xaa is any aa, unknown, or other
MPTGXXFTISLYQGLGRXQXPNIGAQNRNIRATIMGRSPSGGGSFPLNRLVPRGGPAIRGDGIDPSRHKRGKRAXILPSLWSRLR

SEQ ID NO: 30609 - DNA, 700 bp, Zea mays
  misc_feature: Ceres CLONE 1406185-F
  misc_feature: Encodes the peptide sequence at SEQ ID NO. 30610
  misc_feature (569)..(569): n is a, c, t, g, unknown, or other
  misc_feature (629)..(629): n is a, c, t, g, unknown, or other
  misc_feature (665)..(665): n is a, c, t, g, unknown, or other
gagctccccgcggtggcggccgctctagaactagtggatcccccgggctgcaggaattcgcacgagaccattacctagaacatcctaatcgaaaagacccaggcaagaggcaacacagcaagcagcagaaaacatctccgggagtccgaaccacccacaggcggcaggccacaccacaggttccgcttccgcacagctgctagctagctagcgttcgcaagtagcagtagcgttccatcgaggtcgaggcaatgacggtgatggccgaagtagtctcgaccaccggcgcggcgctccggagcccggcctcgcagccgctgccggccgcggtgaagaacgcagacgctgagaagctccagttcatcgaggagatgacctccaacgtggacgccgtgcaggagcgcgtgctgggggagatcctcgcccgcaacgccggcaccgagtacctcgccaagtacggcctcgccgccgctactacggaccgcgccaccttccgcgccaagggtgcgatggcgacgtacgaggacctgcagccgtacatccgccgcattttgcgacgcgaccgctcngcccatctgtcggggcacccggtctcccgagtcctcaccagctccggcacgtcccgcggngagcgcaagctcatgcccaccatcgaggacgagctncaccgccgccagctgctgtacagcctccagatgcc

SEQ ID NO: 30610 - protein, 149 aa, Zea mays
  misc_feature: Ceres CLONE 1406185-F
MTVMAEVVSTTGAALRSPASQPLPAAVKNADAEKLQFIEEMTSNVDAVQERVLGEILARNAGTEYLAKYGLAAATTDRATFRAKGAMATYEDLQPYIRRILRRDRSAHLSGHPVSRVLTSSGTSRGERKLMPTIEDELHRRQLLYSLQM

SEQ ID NO: 30611 - DNA, 745 bp, Zea mays
  misc_feature: Ceres CLONE 1406188-F
  misc_feature: Translation starting site: 120
  misc_feature (262)..(262): n is a, c, t, g, unknown, or other
  misc_feature (263)..(263): n is a, c, t, g, unknown, or other
  misc_feature (376)..(376): n is a, c, t, g, unknown, or other
  misc_feature (377)..(377): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (426)..(426): n is a, c, t, g, unknown, or other
  misc_feature (448)..(448): n is a, c, t, g, unknown, or other
aagctggagctccccgcggtggcggccgctctagaactagtggatcccccgggctgcaggaattcgcacgagaccattacctagaacatcctaatcgaaaaactacacacaaacacacaatggcaccagaaacgatgctcctcggcgtctgtgccgtgctgatggtggtcggcgtcacgaacgcggcggagggccaggtggcgtcggtcgtcgtgggcctggcgaggtgcgccgacagcacgaggaagaacatgaaagctgnnagccgttttcaagggtcttcaggtggcgatcaagtgcaagaaacagcacggcgagtacgagacaaaggccgtgagtgagatcccaagctcccggagcttcagggtcccactcnngcgcgaccctcaggnnngcgactggcacgcgcagcttcaacagggccgncaataacgcgccttgccctggncaagagcccgtcaggatccggcccatggaagggggcacctttcttccccgggcctggaaaaatggcctaccccttccggggaggggcggtcccggtttttcttgtccccaaaaaaaaaagatttgttaaatcttttcccaagggcacccctgcgggggcgggaaataccccccggggctgaacacaaaaaagcccccgggggggaaaaaacccccgggggtgaaaaaaaaaaaggggggcggaaaacccccccccccgggggaaacccccccctcccccccggggggggggcaaaaa

SEQ ID NO: 30612 - DNA, 692 bp, Zea mays
  misc_feature: Ceres CLONE 1406194-F
  misc_feature: Encodes the peptide sequence at SEQ ID NO. 30613
  misc_feature (444)..(444): n is a, c, t, g, unknown, or other
  misc_feature (546)..(546): n is a, c, t, g, unknown, or other
  misc_feature (664)..(664): n is a, c, t, g, unknown, or other
  misc_feature (690)..(690): n is a, c, t, g, unknown, or other
tggagctccccgcggtggcggccgctctagaactagtggatcccccgggctgcaggaattcgcacgagaccattacctagaacatctaatcgaaaactccactccctcccccccgcctccactaccccactcccaggcgccgcacaggtacgtcgccggcggcgatgacgacgcgcttcaagaagaaccgcaagaagcgcggccacgtgtccgccgggcacggccgcatcggcaagcacaggaagcatcccggaggtcgcggtaacgccggtggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccgaaaaggcggcggaagccggcggcgacnaggccccgcagatcgacgtcacgcagttcggctacttcaaggtgctcggggaagggggtgctgccgcccaagcccatcgtcgtcaaggccagctcatctccnaggtcgccgagaagaaagatcaggccgccggcggcgccgtcgtgctcacgaagcttggggaggcgagcaccccgatccggcgaggtgccgcgagcgaggcagcgatgagaggccgtgngtcccatctccgcgcgctcctctcgngg

SEQ ID NO: 30613 - protein, 175 aa, Zea mays
  misc_feature: Ceres CLONE 1406194-F
  misc_feature (94)..(94): Xaa is any aa, unknown, or other
  misc_feature (128)..(128): Xaa is any aa, unknown, or other
  misc_feature (167)..(167): Xaa is any aa, unknown, or other
MTTRFKKNRKKRGHVSAGHGRIGKHRKHPGGRGNAGGMHHHRILFDKYHPGYFGKVGMRYFHKLRNKFYCPAVNIERLWSMVPAEKAAEAGGDXAPQIDVTQFGYFKVLGEGGAAAQAHRRQGQLISXVAEKKDQAAGGAVVLTKLGEASTPIRRGAASEAAMRGRXSHLRALLS

SEQ ID NO: 30614 - DNA, 701 bp, Zea mays
  misc_feature: Ceres CLONE 1406196-F
  misc_feature: Encodes the peptide sequence at SEQ ID NO. 30615
aagctggagctccccgcggtggcggccgctctagaactagtggatcccccgggctgcaggaattcgcacgagaccattacctagaacatcctaatcgaaaaattttgccaatgcgacggtgaaatcccgcacctacctccttcctctctcaccgaggaccctcgcaccaagaactgagcgggaagagaggtagagaggcaagcgcacgagagtttctgctcctagtctcgtctcgccccgcctccggctcctttccctctctggttctctctctgcgattctcgtcgcattggttccgttccctcacgaaaggcggtagctttctgtcttccctgatctatctagataatggcgaccacgacgtcagcgaccaccgccgcagcagcagccgccaccaccgccaagccgcgggggtcgtcgtcggccctctgccagagggtggccggcggcgacaggcggcgctccggagtggagcggagcgacgccgccggcgtggagggccaagcgcaggccgcggcagaggcggccagcgacgccgccctcgagcaggtcaagatatgcgccgaccggcacatgcaggatcggagtaccatagctgtgataggcctcagtgtacactacaggaccagtggagatgcgtgaaaaccttgctgctgcagaggaactgtggccccctgctatgcatgaagtcacgtagctga

SEQ ID NO: 30615 - protein, 97 aa, Zea mays
  misc_feature: Ceres CLONE 1406196-F
  misc_feature: SWISSPROT Homolog: EC 1.2.1.70 Glutamyl-tRNA reductase
MATTTSATTAAAAAATTAKPRGSSSALCQRVAGGDRRRSGVERSDAAGVEGQAQAAAEAASDAALEQVKICADRHMQDRSTIAVIGLSVHYRTSGDA

SEQ ID NO: 30616 - DNA, 678 bp, Zea mays
  misc_feature: Ceres CLONE 1406197-F
  misc_feature: Encodes the peptide sequence at SEQ ID NO. 30617
aaagctggagctccccgcggtggcggccgctctagaactagtggatcccccgggctgcaggaattcgcacgagaccattacctagaacatcctaatcgaaaaccatccttccatccctgtagctatctatcacggtatgtgaggtataataagcaggcgagggcaaccgatgaacaacatgctgcgaactcgccgccgcctggacctcctgcaggtggtcgctcttcgccgctgtgctcctcgtcggcgacaccgacgccgtcgtgacgagccaataccgacaaaagctgaaggcgacgatggagatgacactggacgacgacgtcttctgcgtctcgtcggtgtactatgccccgcagcaggtgcacatcacgctgggtgaccagtaggtcacggagatgatcgcgtcatgcgtgacggccaatgagctgttcagcaccaccgtcatgtacagagaggcgtctccggacccgaagaagatggagctccggctgtaggtcacccacatgcgctactactacttcaactacacctccgtcttcatccaccactgcaccctcacaaacctcaagtatagcaccaagtactactactccatggagtgtcgccacactgtgaggagcttctgcttaacacgacacccatgccggtgcctgacgtgactttcaagttgcgcct

SEQ ID NO: 30617 - protein, 51 aa, Zea mays
  misc_feature: Ceres CLONE 1406197-F
  misc_feature: SWISSPROT Homolog: EC 3.1.3.2 Acid phosphatase
MRYYYFNYTSVFIHHCTLTNLKYSTKYYYSMECRHTVRSFCLTRHPCRCLT

SEQ ID NO: 30618 - DNA, 686 bp, Zea mays
  misc_feature: Ceres CLONE 1406202-F
  misc_feature: Encodes the peptide sequence at SEQ ID NO. 30619
aagagctggagctccccgcggtggcggccgctctagaactagtggatcccccgggctgcaggaattcgcacgagaccattacctagaacatcctaataaaactgtcccgccgagttcggagcgcagcgcaaggcggggggaggagcaagaagccgccggcctccctcctccggctcaccaccaggcttactccgcaccgcgctgccacgggtaggagcggcgtcaaattcgggattcccaagcggcttcagcccggaggttcagccaaagctattttctaagaaaaatggcggcaatgatggtggcgatgactgcgaggagcaagaacagcatattacccgtggagaagaagcagggctggtctattcagctaccagagctccggttcccttgggattcacatgaagacaagggtttctctctgagtctgcaagcatctgcaccttctcatggcggcctgtttgctagcgtgggtcttaaagtgtcgacaggtgccccagcagtggcgcccggaccgggtgacaaggatattaagatcccatcactgatcattgtatgaaggacgtgcctgaggcagttgggaaccaggttattaacactgaaaccgcagccagtggaagaaggtgggggatgctaaagccaaaaacccagcccaagaaacgggggctggcacctgaaaaataaaa

SEQ ID NO: 30619 - protein, 90 aa, Zea mays
  misc_feature: Ceres CLONE 1406202-F
MAAMMVAMTARSKNSILPVEKKQGWSIQLPELRFPWDSHEDKGFSLSLQASAPSHGGLFASVGLKVSTGAPAVAPGPGDKDIKIPSLIIV

SEQ ID NO: 30620 - DNA, 692 bp, Zea mays
  misc_feature: Ceres CLONE 1406203-F
  misc_feature (299)..(299): n is a, c, t, g, unknown, or other
  misc_feature (308)..(308): n is a, c, t, g, unknown, or other
  misc_feature (314)..(314): n is a, c, t, g, unknown, or other
  misc_feature (347)..(347): n is a, c, t, g, unknown, or other
  misc_feature (348)..(348): n is a, c, t, g, unknown, or other
  misc_feature (362)..(362): n is a, c, t, g, unknown, or other
  misc_feature (365)..(365): n is a, c, t, g, unknown, or other
  misc_feature (442)..(442): n is a, c, t, g, unknown, or other
  misc_feature (462)..(462): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (513)..(513): n is a, c, t, g, unknown, or other
  misc_feature (520)..(520): n is a, c, t, g, unknown, or other
tggagctccccgcggtggcggccgctctagaactagtggatcccccgggctgcaggaattcgcacgagaccattacctagaacatcctaatcgaaaaaagtgttctaaaatctgaatggcatcttgctcctctgtccacgccgcaccatcgctcctcgtctcggcgccgcctagtaggcggcgcacaagtacggccgtatgtcttcagggtgttcgccgcggcagggtcgcgtcctgccgcgtgcggtgtagcgccggggccggacaggtcggggtcaaggtccctgcgaaagctgcgnagctgtgantcgcgncgaagagcgcgcctcccctgaccgtgctcgcgnngtagtgcgcgacgntgncaatatacaaggtcgggtccagtctcctttgcgcgcgccatcccccgacccgtcgggtggaggccagacggccctgncgcctacagtcccggagccngtgcagggtggcgagataacggagaggactacnnnaaaaaacgacgggatnccctccnaatatgaacagcggcaggctttcaattcgttccttcaatggatttaaaaatatgaggccattgaaacgttaccactgagaggggggtctttgcctctccctgtggggtaacctgaaaccccttccaagatggagcgaaccaattttttgtgggagaggttttcaaaaaacct

SEQ ID NO: 30621 - DNA, 658 bp, Zea mays
  misc_feature: Ceres CLONE 1406206-F
  misc_feature: Translation starting site: 138
  misc_feature: SWISSPROT Homolog: EC 4.2.3.1 Threonine synthase
  misc_feature (347)..(347): n is a, c, t, g, unknown, or other
  misc_feature (361)..(361): n is a, c, t, g, unknown, or other
  misc_feature (396)..(396): n is a, c, t, g, unknown, or other
  misc_feature (397)..(397): n is a, c, t, g, unknown, or other
  misc_feature (407)..(407): n is a, c, t, g, unknown, or other
agagctggagctccaccgcggtggcggccgctctataactagtggatcccccgggctgcaggaattcgcacgagaccattacctagaacatcctaatcgaaaaactctccaatctcgccgccaagcctcaccgcaccatggcgaccttcaccgcggcctcctccctctccctcctcttctcccacccgcactcccactcccgccaaccatccgcccaggggcccaccgccagctcccacctccacctgcatccgcgcgccagccgcgcgcgctgcgcctcttccgacacgacggccacgaagcaccgccgcccagcggaggagaacatccgcgaggaggcggcgcgnctccgaggcccggncccaggtttctctgcgtggtacgagcccttcccgnncggcgccggnggcgacccgacgagcgctactcgctggacgaggtcgtctaccgctccagctcggggggcctcctcgacgtgccgcacgaacatggagccctggcccgctacccggggtccctactggggggacctcttccactcccggggcggccgcaccggctgggccctaaggttcggggggttggtccaaaaaggagtttgggctccccaaaaatgaatcccaacccattgtctccccttttggagggaaaccccaac

SEQ ID NO: 30622 - DNA, 697 bp, Zea mays
  misc_feature: Ceres CLONE 1406207-F
  misc_feature: Encodes the peptide sequence at SEQ ID NO. 30623
  misc_feature (495)..(495): n is a, c, t, g, unknown, or other
  misc_feature (535)..(535): n is a, c, t, g, unknown, or other
  misc_feature (584)..(584): n is a, c, t, g, unknown, or other
aaagctggagctccccgcggtggcggccgctctagaactagtggatcccccgggctgcaggaattcgcacgagaccattacctagaacatcctaatcgaaaaaaacaacgccgcgacgagaagagagaagagggcgggcatcggccagtgggggctcggaggccgagggaggcgaggaaagcggcgggtgccgggccgcccgcgccggtgccgaggccctcaccagtcaccaccccctcccctcttccgtctgtcccccgcttgccgccaccgccgctgcctgctcgcgacccttcccccttttaacgctcccgcggccccgcgtcgtgctcccttttgtcgccgctgccttcgtgcccgtactcgcgggttctcctcgctcctcaatctccgcgcctgggcgcggcgttcgccgccggatctgggcgcgggacggtgccccggacggtcgatggcgcgggtggcgctccggttgggcgcccgcgcgctcgcggntctcgtcctcgtgtcagtggctctgcttccacttgtcagntccgacgatgaacacaaacactgcgaggggtgtgtcaggggctgggcgnatccctccacggggcgcgtggaggacggggacaaactgagccctcaggatttgctctttctcctccacatcctaggactggagggcgcacctactttcactggaatgcccgcg

SEQ ID NO: 30623 - protein, 82 aa, Zea mays
  misc_feature: Ceres CLONE 1406207-F
  misc_feature (15)..(15): Xaa is any aa, unknown, or other
  misc_feature (28)..(28): Xaa is any aa, unknown, or other
  misc_feature (45)..(45): Xaa is any aa, unknown, or other
MARVALRLGARALAXLVLVSVALLPLVXSDDEHKHCEGCVRGWAXPSTGRVEDGDKLSPQDLLFLLHILGLEGAPTFTGMPA

SEQ ID NO: 30624 - DNA, 700 bp, Zea mays
  misc_feature: Ceres CLONE 1406210-F
  misc_feature: Encodes the peptide sequence at SEQ ID NO. 30625
  misc_feature (307)..(307): n is a, c, t, g, unknown, or other
  misc_feature (352)..(352): n is a, c, t, g, unknown, or other
  misc_feature (358)..(358): n is a, c, t, g, unknown, or other
  misc_feature (365)..(365): n is a, c, t, g, unknown, or other
  misc_feature (373)..(373): n is a, c, t, g, unknown, or other
  misc_feature (399)..(399): n is a, c, t, g, unknown, or other
  misc_feature (402)..(402): n is a, c, t, g, unknown, or other
  misc_feature (409)..(409): n is a, c, t, g, unknown, or other
  misc_feature (410)..(410): n is a, c, t, g, unknown, or other
  misc_feature (413)..(413): n is a, c, t, g, unknown, or other
  misc_feature (414)..(414): n is a, c, t, g, unknown, or other
  misc_feature (420)..(420): n is a, c, t, g, unknown, or other
  misc_feature (425)..(425): n is a, c, t, g, unknown, or other
  misc_feature (469)..(469): n is a, c, t, g, unknown, or other
  misc_feature (474)..(474): n is a, c, t, g, unknown, or other
  misc_feature (484)..(484): n is a, c, t, g, unknown, or other
  misc_feature (487)..(487): n is a, c, t, g, unknown, or other
  misc_feature (516)..(516): n is a, c, t, g, unknown, or other
ggagctccccgcggtggcggccgctctagaactagtggatcccccgggctgcaggaattcgcacgagaccattacctagaacatcctaatcgaaaagattcaaaccgtcgccgccgtcgccgagagagttgtgactcccccagcggcggcctgcgaccgcccgttccccagtcgtctcttctctccggaccgcatttgcgcccgtcccgtcccctcccctctccctcggcgaggtccgagagcagagctgcctcgggagggtcgtagtccagtccacccgtccgctgcggcggcggttacgaggcgnagaatttccggcgcgggttgccgcgatccccgcagtgaggtgcgnatcggntcatggntgtgaccnagccgggaagtagtggaggctgtggnagnactaggnncgnnactggnagctngcgccacgacgatgtacgtccgcccggaagtctaccaagctgtnggagnagggtgtgcncgnaaaacaacagcggagctgcagcttctggntcgagaagtgccattgctccttgcaggggtggtgtttcagtacatccatggattggctgctccaggagtgaattacttgcatcggcccggacactgctccaggacttgggatttatggcctttcagagcttggccaagagaaaggtatcttagggagaggttatcactttcatcttcatttctt

SEQ ID NO: 30625 - protein, 88 aa, Zea mays
  misc_feature: Ceres CLONE 1406210-F
  misc_feature (13)..(13): Xaa is any aa, unknown, or other
  misc_feature (27)..(27): Xaa is any aa, unknown, or other
MYVRPEVYQAVGXGCARKTTAELQLLXREVPLLLAGVVFQYIHGLAAPGVNYLHRPGHCSRTWDLWPFRAWPRERYLRERLSLSSSFL

SEQ ID NO: 30626 - DNA, 697 bp, Zea mays
  misc_feature: Ceres CLONE 1406211-F
  misc_feature: Encodes the peptide sequence at SEQ ID NO. 30627
  misc_feature (448)..(448): n is a, c, t, g, unknown, or other
ggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtgatgctgacggcggcgctggctgccatgtggtggcgtcggtgctccaagaccggcgtagtcgacggcctcccgccggggcctccgggttggccggtggtgaagaacctgttccaggtgatcctgcagcgacggcccttcatgtacgtggtgcgcgacctccgggagaagtacggccccatcttcaccatgcggatggngcagccaccctcatcgtggtcacctcggaggagctcatccacgatgcgctgggtgaagcaggtccccatgttcgcgagccggcccgaggacagccccacccgcctcctcttcagcgtcggcaagtgcaccgtctactcgaggactacggcccccctgtggcgtgctctgcgccgaatctccgtcgccgagatcgtgtccccgcacgcgtcagggcttctctgggatccggaaggttgccccgtgtacgg

SEQ ID NO: 30627 - protein, 157 aa, Zea mays
  misc_feature: Ceres CLONE 1406211-F
  misc_feature (75)..(75): Xaa is any aa, unknown, or other
MDVNDVLLVMLTAALAAMWWRRCSKTGVVDGLPPGPPGWPVVKNLFQVILQRRPFMYVVRDLREKYGPIFTMRMXQPPSSWSPRRSSSTMRWVKQVPMFASRPEDSPTRLLFSVGKCTVYSRTTAPLWRALRRISVAEIVSPHASGLLWDPEGCPVY

SEQ ID NO: 30628 - DNA, 699 bp, Zea mays
  misc_feature: Ceres CLONE 1406212-F
  misc_feature: Encodes the peptide sequence at SEQ ID NO. 30629
  misc_feature (476)..(476): n is a, c, t, g, unknown, or other
  misc_feature (503)..(503): n is a, c, t, g, unknown, or other
  misc_feature (536)..(536): n is a, c, t, g, unknown, or other
ggagctccccgcggtggcggccgctctagaactagtggatcccccgggctgcaggaattcgcacgagaccattacctagaacatcctaatcgaaaagccgccaccgtcaccgtggcccgccgccatataagtaaaccctcgcctcgtcctcctcccaggctcgccaccctccgcctccgacacatggcccacccgcacctcgtgctcccctccccgaagtccctcctccccgccgccgcaactccatcgcgccgcgccgtcgccatccgcgcggcgctctccaccactttgtctccggccaaggcggcagctggagcagaggcggtgcgatcgatccgcgcgcggcagatcgtggacagccgcgggaaccccaccgtcgaggtcgacctcgtcgccggggacggacgcctccaccgctccgcggtgcccagcggggcgtccacggggatctacgaggcgctggagctccgcgacgntgacaaggcccgtatacgcgggaaggncgtactccaagctgtgcgcaacatcaacgaggntatcgcgcctaagctcataggcgtcgatgtgaggaacaaaagcgatgttgatgcagtcatgctagacattgatggaactcaaaataaatcgaagttgggggcaatggcatttctcggagcctccttgagtgattgaaggccagcgctggtgcaaaggaatttc

SEQ ID NO: 30629 - protein, 162 aa, Zea mays
  misc_feature: Ceres CLONE 1406212-F
  misc_feature (47)..(163): Pfam Name: Enolase_N Pfam Description: Enolase, N-terminal domain
  misc_feature: SWISSPROT Homolog: EC 4.2.1.11 Phosphopyruvate hydratase
  misc_feature (98)..(98): Xaa is any aa, unknown, or other
  misc_feature (107)..(107): Xaa is any aa, unknown, or other
  misc_feature (118)..(118): Xaa is any aa, unknown, or other
MAHPHLVLPSPKSLLPAAATPSRRAVAIRAALSTTLSPAKAAAGAEAVRSIRARQIVDSRGNPTVEVDLVAGDGRLHRSAVPSGASTGIYEALELRDXDKARIRGKXVLQAVRNINEXIAPKLIGVDVRNKSDVDAVMLDIDGTQNKSKLGAMAFLGASLSD

SEQ ID NO: 30630 - DNA, 698 bp, Zea mays
  misc_feature: Ceres CLONE 1406214-F
  misc_feature (533)..(533): n is a, c, t, g, unknown, or other
  misc_feature (632)..(632): n is a, c, t, g, unknown, or other
  misc_feature (656)..(656): n is a, c, t, g, unknown, or other
aagctggagctccccgcggtggcggccgctctagaactagtggatcccccgggctgcaggaattcgcacgagaccattacctagaacatcctaatcgaaaactctctcgcgcgtccgcgcccgcgcccgcggcctcgttcaatccgccagcgctcccccgccccccggtggtagcgggctctacggcagcgctcctctccggttcccctgcgctccgcgtcttcatctgtggcggccgacgctccgtcggtgtctcgtcggacggagcgagcggagctagggttccgtttcatgctcaggatcggcgagatctagggtctcgatttcagggtgattgtactggatagctgctgctgatattgcaagacaatgaaagctcatcagcagcaaggtaatgcatctggcacaggagcaaagaccaaatctttttttgataagatacaaagcctggaagctggtgcacatatcaacaaatcatcaggcaatgtggctgcaaagcgtagaaaggtctctcctttttgatcacataccanaagcaagatagcatcaaagactggcagtcttatggaagcgccagcaagtgatgctaaagtgtctgctcggccacctatcactctggaaagatcaacttncacttttcccattatatgaaaccnattcagagatatgcagcaagaaacacaatccttaccttgatt

SEQ ID NO: 30631 - DNA, 686 bp, Zea mays
  misc_feature: Ceres CLONE 1406216-F
  misc_feature: Encodes the peptide sequence at SEQ ID NO. 30632
  misc_feature (437)..(437): n is a, c, t, g, unknown, or other
tccccgcggtggcggccgctctagaactagtggatcccccgggctgcaggaattcgcacgagaccattacctagaacatcctaatcgaaaagatccgatggcccgcgccgccgctcgcctcctccccatcttcctcccatggcggcgtcctcccccgccctgcctcctccgccggggcttcctaaaccctagcagccccagaacctccgcgcgcgtcgacaccctcgttctccctggagacgagcgcttgcccttcccctcgcccccacgcctcccgaaccagctgcgtcctgactacgggagtggcggcggaggcggcgctccctcgaccatcgcggccatcgtcacctcactcggcggaggccctgcagcggtggggatcgtgcggatctccggccccgatgccgtcgccgtcgccgaccgcgttttccgccagnctggaccaggaggtcgtcgacgccgtggcaactgcgcagtcactttgttgagtacggactcgcgctcgacgcggacggcagcgttaatgacgagtttttggtggtgccaatgctctccccgaggtctacacgcgagaggatggtgtggagcttcagtgccatggcaacgatctctgcttgcgccgcgtgctcagggcttgctagaaactgcacccgacttgctgatcctggggagatcaccttcgggca

SEQ ID NO: 30632 - protein, 196 aa, Zea mays
  misc_feature: Ceres CLONE 1406216-F
  misc_feature (114)..(114): Xaa is any aa, unknown, or other
MARAAARLLPIFLPWRRPPPPCLLRRGFLNPSSPRTSARVDTLVLPGDERLPFPSPPRLPNQLRPDYGSGGGGGAPSTIAAIVTSLGGGPAAVGIVRISGPDAVAVADRVFRQXGPGGRRRRGNCAVTLLSTDSRSTRTAALMTSFWWCQCSPRGLHARGWCGASVPWQRSLLAPRAQGLLETAPDLLILGRSPSG

SEQ ID NO: 30633 - DNA, 678 bp, Zea mays
  misc_feature: Ceres CLONE 1406217-F
  misc_feature: Encodes the peptide sequence at SEQ ID NO. 30634
  misc_feature (415)..(415): n is a, c, t, g, unknown, or other
  misc_feature (448)..(448): n is a, c, t, g, unknown, or other
  misc_feature (486)..(486): n is a, c, t, g, unknown, or other
aaagctggagctccccgcggtggcggccgctctagaatagtggatcccccgggctgcaggaattcgcacgagaccattacctagaacatcctaatcgaaaaaaaacccggtttcacactagttctgtattcgtgtcctctggtctctcgcaggccaaacaaaagcgccgctgccgccggcaatgttccgccgcctcctcccccaccgtcgctacatctccacctcgcccgcctccaactccaacccgaccctctactctgacggaaccatcccattctctatcctctcgtggggccgtggcgcttccggacagctcggcggtggcaagagggagcgccgctctacccatcccccgtcgcccacctactttctcccgaatcagaacccacgccttgctccccaccccggacgcttnccctctgcagaagagacgtctggagtggaggtngggatctctttgggggttcttcactcctcgctcctcgncaaggaagcgcctggttgtggggcaaggccaacgaaggcgcctccggcctcggggacaagttttccgctttggggccccgtttaaacccaaatctccggaatttccccctccttggggttgggggggattcaattccgccgggtttaaaccatttcgggggaacttttttcccttggggttaagggggaatt

SEQ ID NO: 30634 - protein, 129 aa, Zea mays
  misc_feature: Ceres CLONE 1406217-F
  misc_feature (78)..(78): Xaa is any aa, unknown, or other
  misc_feature (102)..(102): Xaa is any aa, unknown, or other
MFRRLLPHRRYISTSPASNSNPTLYSDGTIPFSILSWGRGASGQLGGGKRERRSTHPPSPTYFLPNQNPRLAPHPGRXPSAEETSGVEVGISLGVLHSSLLXKEAPGCGARPTKAPPASGTSFPLWGPV

SEQ ID NO: 30635 - DNA, 672 bp, Zea mays
  misc_feature: Ceres CLONE 1406221-F
agagctggagctcaccgcggtggcggccgctctagaactagtggatcccccgggctgcaggaattcgcacgagaccattacctagaacatcctaatcgaaaagatacccgttcgacgttcgcatcagcttgttgctgctgctgaaggaaaagacaattttctccttacctcctgggatcaggcctcaggcgcacagccttctgcttctcttcctctcctcgcgtccccccaccaaaccctaacccgagcacccagcccctcctcgcgtctgctcgcgccggcctttggggctctcactctgagcggcagggacccgcagggctctggttgtgtccaggacacatcacatatgttgctcagagaccaatagatgccgaataacgaggtagcgtatgtagcagtgaaagagatgaaagactgtagaggaaagcgaagcaaagtagtgacacgcgaaatgtccctcatcgatgccttgacatcgcccccgtgcgctgaacgccgccgcactaacgaaaccgccctcagggatcgggcgcctccgattgccccaaaataaatcattatcccaaagactgctaggggtggaaaactaataaggtggaggaaaaatctaaaaaaggaaaaaaagtgtccaagggaaaaacccctatttgggaacctcccagaaagggt

SEQ ID NO: 30636 - DNA, 627 bp, Zea mays
  misc_feature: Ceres CLONE 1406223-F
  misc_feature (246)..(246): n is a, c, t, g, unknown, or other
  misc_feature (263)..(263): n is a, c, t, g, unknown, or other
  misc_feature (282)..(282): n is a, c, t, g, unknown, or other
  misc_feature (315)..(315): n is a, c, t, g, unknown, or other
  misc_feature (333)..(333): n is a, c, t, g, unknown, or other
  misc_feature (334)..(334): n is a, c, t, g, unknown, or other
  misc_feature (446)..(446): n is a, c, t, g, unknown, or other
  misc_feature (453)..(453): n is a, c, t, g, unknown, or other
tggagctccccgcggtggcggccgctctagaactagtggatcccccgggctgcaggaattcgcacgagaccattacctagaacatccctaatcaaaaaagcaaccacttctgctctgcatcccgtctgggcctctgcatttgcttggctgctgctcccttctcccaccgaccaactcgatcccgcgccatggatcgcgccgaccccgcgcggggccgccttgccgtgctctcctcccacctcgtgntgcaggggccgaagaanggcgcgagctgaagagtcncccgtatcgcgccggcgcccgggccccgcgcgngcgcttgccgtgtgacgnnagaccggaagcgcacgagtcaggtctccgagacgcacgtgcgcgcacgacttcagagatacactgaaagacgacaggtcttagaatatgatctggtacctacactgccctgntcctcgncatctgtactcgaggagagaggaatcctccttaagggtatccatcaaaaatggtgaaccactctttgttagggcctactttaaggaggggactgccacccaaccaatggcgggtgggattttttttttaaaatttggttgcccccaggtggtggaaaaaaaaaaagccccgggt

SEQ ID NO: 30637 - DNA, 709 bp, Zea mays
  misc_feature: Ceres CLONE 1406225-F
  misc_feature: Encodes the peptide sequence at SEQ ID NO. 30638
  misc_feature (482)..(482): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (659)..(659): n is a, c, t, g, unknown, or other
  misc_feature (660)..(660): n is a, c, t, g, unknown, or other
ggagctccccgcggtggcggccgctctagaactagtggatcccccgggctgcaggaattcgcacgagaccattacctagaacatcctaatcaaaaaactactaccagctgctccctccctccttcccttccctcctacctctctctctctcttcctccgttcgtctcttgactcttctcttctccccatcagccagcagtctctctctctctcacacacacaagcagcgacttgctcacagtagtgctccccggacagaatgaccaaagacgaggagttcaagctggtcaagatccagaaccatgcgctgaaggtgaacatacactgcgacgggtgcaagcacaaggtcaagaagcttcttcagaagatcgaaggcgtgtactcggtggccattgatgtggacaaccacaaggtctcggtgacgggcgatgtgggactcgagacccttatcaggaagctcaccaggggcggcaagcacgcgnagctgtgggtcgcagcccaggggcggcggcaactagggcccacagggcaatagtgggcagcagcagaaacagcagcagccgcagaaccagaccagaacccacagcagaagcagaaggcaggtgctatctcagagagatggggcacacaagaacagcactgcgtcagaagccnnnggnnaaaccagggaggaggaggaagggctggggccctcatgcaggggctcagg

SEQ ID NO: 30638 - protein, 91 aa, Zea mays
  misc_feature: Ceres CLONE 1406225-F
  misc_feature (16)..(76): Pfam Name: HMA Pfam Description: Heavy-metal-associated domain
  misc_feature (75)..(75): Xaa is any aa, unknown, or other
MTKDEEFKLVKIQNHALKVNIHCDGCKHKVKKLLQKIEGVYSVAIDVDNHKVSVTGDVGLETLIRKLTRGGKHAXLWVAAQGRRQLGPTGQ

SEQ ID NO: 30639 - DNA, 713 bp, Zea mays
  misc_feature: Ceres CLONE 1406227-F
  misc_feature: Encodes the peptide sequence at SEQ ID NO. 30640
aaagctggagctccccgcggtggcggccgctctagaactagtggatcccccgggctgcaggaattcgcacgagaccattacctagaacatcctaatcaaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggaagcgcgcgcctcgccctacgacgacgaccgcatcggggacatggcccgcttcgcggacacgctgtcggacacctcccccggctcgcccgcgcagcgcttcgtgtcggaggacggtgtcatcaactcgcgcccgcgggtgctgggcggcggcagctgcatcaacgccggattctacacgcgagacagcgacgactaacgtgcggggcctcgggggggaacctgggccgcccccgggtcggcttaccggtgggtgaagaacctgattggccttcacaccggaattgggctccttgccagcccgcgctgaagggcgacctgctcaagccggggtccg

SEQ ID NO: 30640 - protein, 141 aa, Zea mays
  misc_feature: Ceres CLONE 1406227-F
  misc_feature: SWISSPROT Homolog: EC 4.1.2.10 Mandelonitrile lyase
MSGRSRHFTMSTLLATSFFFVLLCSSLQVRGVNYTFVKDAALAPSVSYYDYIIVGGGTAGCPLAATLSERFRVLLLEARASPYDDDRIGDMARFADTLSDTSPGSPAQRFVSEDGVINSRPRVLGGGSCINAGFYTRDSDD

SEQ ID NO: 30641 - DNA, 663 bp, Zea mays
  misc_feature: Ceres CLONE 1406228-F
  misc_feature: Translation starting site: 151
  misc_feature: Pfam Name: 2OG-FeII_Oxy Pfam Description: 2OG-Fe(II) oxygenase superfamily
  misc_feature: SWISSPROT Homolog: EC 1.14.11.2 Procollagen-proline dioxygenase
  misc_feature (485)..(485): n is a, c, t, g, unknown, or other
  misc_feature (585)..(585): n is a, c, t, g, unknown, or other
ggagctccccgcggtggcggccgctctagaactagtggatcccccgggctgcaggaattcgcacgagaccattacctagaacatcctaatcgaaaaaagcgatctcccgtccccgtagtccgcaggagagagatttttttctcggttgcaatgaagagttatccgtgggcgggggcccgccctcttgccgtcgtgcagctcctcctcttcctcgcccacctcgtcgaccgcggcggtgctgccggtggaggcagcaagggcagctcggtgtacccggcggctgtcgtctacccgcatcactcccgccagatctcctgcaaacccagggtgttcctgtatcagcacttcctcagcgacgacgaggctaaccacctgatctccctcgcgagagcggagctcaagaggtcagcggtcgccgaatatatgtctggcaagagcacgctcagtgaggtccgcaccagctccggcaccttcctcaggaaggnccaggatcctattggtgagggaatagaggacaaaattgctgcatggacattccttcaaaaagaggatgggtgaagatatccaagtcctaagatataagcntggggagaagtatgaaccaccctatgattacttccctgaccatggtaacactgtccggggtgggcatcgctacgctac

SEQ ID NO: 30642 - DNA, 728 bp, Zea mays
  misc_feature: Ceres CLONE 1406234-F
  misc_feature: Encodes the peptide sequence at SEQ ID NO. 30643
  misc_feature (334)..(334): n is a, c, t, g, unknown, or other
  misc_feature (382)..(382): n is a, c, t, g, unknown, or other
  misc_feature (393)..(393): n is a, c, t, g, unknown, or other
  misc_feature (394)..(394): n is a, c, t, g, unknown, or other
tggagctccccgcggtggcggccgctctagaactagtggatcccccgggctgcaggaattcgcacgagaccattacctagaacatcctaatcgaaaagcctttgcctgccttcccattcccccgtctcctcttcccttccgccatggcccagcccgctttcctctcctctctccgctcccgcctctgctccgcgccgccgcccccgccgaaccatcgcctccagcctaggcgcggctaccacgtcgagctcggggctcgcgaaaaagcgctttggaggaggatgttgctttgaagaggtcaaatcatacaaaaacagtgtgaaacaggtctccnagatcgggaatgctctcactttagctggtgtacttggctgcagctacnagctttgctgnngtggcgactagcacaaaaatgaaaaaactccggtcatggtggggggcaccgttattcccgggaaagggatccatcagcatggactggggaccctcccccctccggggttttaaaccccggttggtggatcccccgaaccgggaaaaaaaaaaaaaaccagggtaaaccttggatgggaaaaaaaattcttggttttaaagggcccaagtggcaaaaaggggggaaaaaattttctttcccggggaaaaccgagaaaaaaagggcccccctttttttttaacccctggggggggtgcccggcccaaatttgaaaacaaggggttttttttgatat

SEQ ID NO: 30643 - protein, 49 aa, Zea mays
  misc_feature: Ceres CLONE 1406234-F
MAQPAFLSSLRSRLCSAPPPPPNHRLQPRRGYHVELGAREKALWRRMLL

SEQ ID NO: 30644 - DNA, 724 bp, Zea mays
  misc_feature: Ceres CLONE 1406235-F
  misc_feature: Encodes the peptide sequence at SEQ ID NO. 30645
  misc_feature (481)..(481): n is a, c, t, g, unknown, or other
  misc_feature (558)..(558): n is a, c, t, g, unknown, or other
  misc_feature (628)..(628): n is a, c, t, g, unknown, or other
  misc_feature (631)..(631): n is a, c, t, g, unknown, or other
  misc_feature (654)..(654): n is a, c, t, g, unknown, or other
aagctggagctccccgcggtggcggccgctctagaactagtggatcccccgggctgcaggaattcgcacgagaccattacctagaacatcctaatcaaaaaaaaacaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgtgttctccgggtcggtgaacctcaagcacgtcaagctggggtaccagtacctggtgaaccacttcctgacgctgctgctggtgccggtgatggccgccacggcgctggagctggcgcgcctcggccccggcgagctgctctcgctgtggcgctcgctggagctggacctggtccacatcctctgctccgcgntcctggtcgtcttcgtcggcaccgtgtacgtgatgtcgcgccccaggccggtgtacctgttggactacgcctgctancagccccccgccagctggcgcgtgcccctcgccaccttcatggagcacacgcgcctcatcagcgacgacnacnagagcgtgcgctaccagaccagnatcctggagcgctcggggctcggcgagaaaagtgcctcccgcccggcaacactacatcccgcccacccca

SEQ ID NO: 30645 - protein, 150 aa, Zea mays
  misc_feature: Ceres CLONE 1406235-F
  misc_feature: SWISSPROT Homolog: EC 2.3.1.119 Icosanoyl-CoA synthase
  misc_feature (70)..(70): Xaa is any aa, unknown, or other
  misc_feature (95)..(95): Xaa is any aa, unknown, or other
  misc_feature (119)..(119): Xaa is any aa, unknown, or other
  misc_feature (120)..(120): Xaa is any aa, unknown, or other
  misc_feature (127)..(127): Xaa is any aa, unknown, or other
MPSGSVFSGSVNLKHVKLGYQYLVNHFLTLLLVPVMAATALELARLGPGELLSLWRSLELDLVHILCSAXLVVFVGTVYVMSRPRPVYLLDYACXQPPASWRVPLATFMEHTRLISDDXXSVRYQTXILERSGLGEKSASRPATLHPAHP

SEQ ID NO: 30646 - DNA, 704 bp, Zea mays
  misc_feature: Ceres CLONE 1406236-F
  misc_feature: Encodes the peptide sequence at SEQ ID NO. 30647
  misc_feature (302)..(302): n is a, c, t, g, unknown, or other
  misc_feature (380)..(380): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (683)..(683): n is a, c, t, g, unknown, or other
aaagctggagctccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgtgctgctcccgctgcnggacatcatcgagtgcggctacgtggaggagacgggcttcgtgtggctcccgcagcgccgcagggtggacactacttncgcaggccggggcgcacgtgtctacgggggcaagtgggcggcggggccgaaagggcccgttcaagaaaatcccgggcggcagggccagggaatgcttgtgggggccccccccagaaaattggggaaaacccccccccgtgaaatctcccgtgggggccttgggggcgtggcccaatttccccggggggttttggggcaagaacccggcccccgaacgggggctttaagaggggggggggggaaaaaaaaaaaannnaatnnnnnnnannnnnnnnnnnnnnnnntttttttttgggggggggncaggggggggtttattctttg

SEQ ID NO: 30647 - protein, 176 aa, Zea mays
  misc_feature: Ceres CLONE 1406236-F
  misc_feature (43)..(43): Xaa is any aa, unknown, or other
  misc_feature (69)..(69): Xaa is any aa, unknown, or other
  misc_feature (154)..(154): Xaa is any aa, unknown, or other
  misc_feature (156)..(156): Xaa is any aa, unknown, or other
  misc_feature (157)..(157): Xaa is any aa, unknown, or other
  misc_feature (158)..(158): Xaa is any aa, unknown, or other
  misc_feature (159)..(159): Xaa is any aa, unknown, or other
  misc_feature (160)..(160): Xaa is any aa, unknown, or other
  misc_feature (161)..(161): Xaa is any aa, unknown, or other
  misc_feature (162)..(162): Xaa is any aa, unknown, or other
  misc_feature (163)..(163): Xaa is any aa, unknown, or other
  misc_feature (164)..(164): Xaa is any aa, unknown, or other
  misc_feature (170)..(170): Xaa is any aa, unknown, or other
MTLTIPDEVRAKAEVYVGDAAGQEKTRLLLQETGLPSVLLPLXDIIECGYVEETGFVWLPQRRRVDTTXAGRGARVYGGKWAAGPKGPVQENPGRQGQGMLVGAPPRKLGKTPPREISRGGLGGVAQFPRGVLGQEPGPRTGALRGGGGKKKKXNXXXXXXXXXFFWGGXRGGFIL

SEQ ID NO: 30648 - DNA, 658 bp, Zea mays
  misc_feature: Ceres CLONE 1406237-F
  misc_feature: Encodes the peptide sequence at SEQ ID NO. 30649
  misc_feature (172)..(172): n is a, c, t, g, unknown, or other
  misc_feature (217)..(217): n is a, c, t, g, unknown, or other
  misc_feature (218)..(218): n is a, c, t, g, unknown, or other
  misc_feature (223)..(223): n is a, c, t, g, unknown, or other
  misc_feature (228)..(228): n is a, c, t, g, unknown, or other
  misc_feature (247)..(247): n is a, c, t, g, unknown, or other
tggagctccccgcggtggcggccgctctagaatagtggatcccccgggctgcaggaattcgcacgagaccattacctagaacatcctaatcgaaaaattatccccagctttttctccaagcgtccgttcaggaagctgtccggcaacgagccgctcggcactgggcggtggncgtgcaagagcgatcgggaacgcatcgctcgtctgctcctcaggnnctcgnctccntcatcatcactgcagcggngaaaaagaaccaggggacgtcccgcggggggcttcactgacatcgcctaccatgggtaccatggtgcgccgggggatgggggaattgggccccgctgtggcctcttccgaggggtcccagaaccgatttcttttggaggccaacatttttttaatggggaagccacttccacaaggggttttctaaaagttttacaaggaagggtggccccggtgctctaggaaaaacttttttggcggggaagaaaaggtttaaaaatttgttcttggaaaccttttggggcgggggagccaactattaggggcgccaccaccctgggtgtaaataaaaccttcaattaaggggaagaaaatttgcctttttatttttaaaaaagaaaaaaatctccaaaaaggggttatataaaaattt

SEQ ID NO: 30649 - protein, 44 aa, Zea mays
  misc_feature: Ceres CLONE 1406237-F
MGTMVRRGMGELGPAVASSEGSQNRFLLEANIFLMGKPLPQGVF

SEQ ID NO: 30650 - DNA, 719 bp, Zea mays
  misc_feature: Ceres CLONE 1406238-F
  misc_feature: Encodes the peptide sequence at SEQ ID NO. 30651
  misc_feature (644)..(644): n is a, c, t, g, unknown, or other
aagctggagctccccgcggtggcggccgctctataactagtggatcccccgggctgcaggaattcgcacgaaccattacctagaacatcctaatcgaaaaatcagtgctcgctagcccaccacgccctgaacctagcccggacaccagccagaacaggccatgtccatgggctccccggtgcagctcaggcggctgaagcctctgtaccagttcgtggagaacaacatcctggccatcgtgggcgtgccgctcgccaccgcggtcctgctcaaggcgtcttccctcgggcccaaggagatcctgacgctccggccggcgcacttggtcctggccagcgttcctgactgcagcggccacggtgttgtacctgatgctcccgccccccaccgggaacctggagaactaccggtgtttccgaccacccccaggtggcgggtccctttccggaacgttccctggaacaccccccgggggggccgggtttccaacagccaagtgccggttcattgacccccttggtggaaggggtccggggcttggggagagaaaacttcctttttgttaagggaaaaaatacctccccgccgttggggaaaagtaattcccccccggcccgggggccgaaatattttttttttccggngaccccaaaacctttgctcaaaaagcggggggttcccccccggggaaaaaacaaaaatttcggtgggggaaaaaa

SEQ ID NO: 30651 - protein, 116 aa, Zea mays
  misc_feature: Ceres CLONE 1406238-F
MSMGSPVQLRRLKPLYQFVENNILAIVGVPLATAVLLKASSLGPKEILTLRPAHLVLASVPDCSGHGVVPDAPAPHREPGELPVFPTTPRWRVPFRNVPWNTPRGGRVSNSQVPVH

SEQ ID NO: 30652 - DNA, 705 bp, Zea mays
  misc_feature: Ceres CLONE 1406239-F
  misc_feature: Encodes the peptide sequence at SEQ ID NO. 30653
  misc_feature (211)..(211): n is a, c, t, g, unknown, or other
  misc_feature (217)..(217): n is a, c, t, g, unknown, or other
  misc_feature (218)..(218): n is a, c, t, g, unknown, or other
  misc_feature (230)..(230): n is a, c, t, g, unknown, or other
  misc_feature (231)..(231): n is a, c, t, g, unknown, or other
  misc_feature (255)..(255): n is a, c, t, g, unknown, or other
  misc_feature (371)..(371): n is a, c, t, g, unknown, or other
  misc_feature (380)..(380): n is a, c, t, g, unknown, or other
  misc_feature (418)..(418): n is a, c, t, g, unknown, or other
  misc_feature (430)..(430): n is a, c, t, g, unknown, or other
  misc_feature (500)..(500): n is a, c, t, g, unknown, or other
  misc_feature (560)..(560): n is a, c, t, g, unknown, or other
ggagctccccgcggtggcggccgctctagaactagtggatcccccgggctgcaggaattcgcacgagaccattacctagaacatcctaatcaaaaaacggggccgccggccggactcttctgacttggcaaccgccgcgcagcgcgacgagcgccacctgcttgctgccgcgtgcctgcgtgcgtgtgcgtccaccaatgaccccgcgccngcccgnncgccctgccccnntcactcacttgctcactcgtcggntcgtcgcggcccgcttcccccccggacaagggatggacgcgcttcgcctaacggcgtccctcctccccgtgcggcccggcgcgcccgcccgcgagatcattttctaccaccatggntgtccatancacgagatgggtgagggacgaattttgttttctagccngaaggacccaanggtcctaccttgcatcaccatcagaaattcttcgaatggaaatcctcctagtgtaggatatcacatcggncattaaatacttctgttaatgcttcgggcaacagctgcagtctgacctgaaacacatgantctacaaccatctggagggcattatcatcttctctagatgcatttacagattttcccgcccaatactgtcataggaacagcattaggaatagctcagtttcctttctagctgccagaggttggctgaaaatcaccttggtcctct

SEQ ID NO: 30653 - protein, 72 aa, Zea mays
  misc_feature: Ceres CLONE 1406239-F
  misc_feature (31)..(31): Xaa is any aa, unknown, or other
  misc_feature (44)..(44): Xaa is any aa, unknown, or other
  misc_feature (48)..(48): Xaa is any aa, unknown, or other
MDALRLTASLLPVRPGAPAREIIFYHHGCPXHEMGEGRILFSSXKDPXVLPCITIRNSSNGNPPSVGYHIGH

SEQ ID NO: 30654 - DNA, 678 bp, Zea mays
  misc_feature: Ceres CLONE 1406240-F
  misc_feature (349)..(349): n is a, c, t, g, unknown, or other
  misc_feature (392)..(392): n is a, c, t, g, unknown, or other
  misc_feature (397)..(397): n is a, c, t, g, unknown, or other
  misc_feature (407)..(407): n is a, c, t, g, unknown, or other
  misc_feature (412)..(412): n is a, c, t, g, unknown, or other
  misc_feature (413)..(413): n is a, c, t, g, unknown, or other
  misc_feature (491)..(491): n is a, c, t, g, unknown, or other
  misc_feature (652)..(652): n is a, c, t, g, unknown, or other
tggagctccccgcggtggcggccgctctagaactagtggatcccccgggctgcaggaattcgcacgagaccattacctagaacatcctaatcgaaaactacatgccaaatctggaggcaagagaaccgggagagggcgtgttgggttgctcgtcgtgatcccggacggcaatacctgcccttgcctacttgccactgcttgcgtacactgatgtccttgttcaatcccctctagaaagtagaaacattgcttaattggcttggctattgctgttagctccacacaaaagagagaaccggcggcgagctaggagctagccatggacggacacggcgcggtctcaccgtgnagcgtgctaggcggggcggcggctgtgctgctcctgtggttgncgtcncaggtgctgnagtgnngcctggtgggcgccccggcgcgtgaaccgtgcgctgagggcgcaggggctgaggggcacccggtaccgcctcctctgncgcgacctcatcgaggagcagcgtctccgcgcggcggccctggcaaggcccgtccccgtggatcgggcacacgacttcgtccctcgcgtcgcgcctttccttcacgcgtcctccagagcacggcaagctctcgttttacatggtttgggccaccccaggangtctaatcaccgatcccgagcttgcc

SEQ ID NO: 30655 - DNA, 687 bp, Zea mays
  misc_feature: Ceres CLONE 1406243-F
  misc_feature: Encodes the peptide sequence at SEQ ID NO. 30656
  misc_feature (655)..(655): n is a, c, t, g, unknown, or other
  misc_feature (685)..(685): n is a, c, t, g, unknown, or other
aagctggagctccccgcggtggcggccgctctagaactagtggatcccccgggctgcaggaattcgcacgagaccattacctagaacatcctaatcgaaaaacgcacggaagaagccactagctctccgctctcgcctctcggccttctccttgtgccgccgaacaccctcacaagagtcggactctcgatttctcaggacaggcgcggcagcccccttccctccctcctccatcaggtgtagcctcccgcagatccaagtcggaattcggtccgtcgtccccaaaccaccaatccggttgcattctatgggtttgctcacagcgcacacaaagccattttactgctgcgaatggtggctggcacttagcgtctccggctcttgagtgatctccaagtcctttgaaatgctacaggtaagtcgagtgatgggggagtgcgacgacgaccaggagtacagttgctgggaggagctgctgccgcacgcgcatggcctcatctaccgcatactgccgctgcatgaggcgctcaccgtactgactgcggtgaagcagtcctgactacgggaggtgaacagaccctactgctggcatgagatcgacttctaggagtggaccagcaggggagcaagccggagcacatccccgcatggtacnagctactccagggccgcagcggcgggtctngc

SEQ ID NO: 30656 - protein, 43 aa, Zea mays
  misc_feature: Ceres CLONE 1406243-F
MGECDDDQEYSCWEELLPHAHGLIYRILPLHEALTVLTAVKQS

SEQ ID NO: 30657 - DNA, 701 bp, Zea mays
  misc_feature: Ceres CLONE 1406244-F
  misc_feature: Encodes the peptide sequence at SEQ ID NO. 30658
  misc_feature (284)..(284): n is a, c, t, g, unknown, or other
  misc_feature (419)..(419): n is a, c, t, g, unknown, or other
  misc_feature (420)..(420): n is a, c, t, g, unknown, or other
  misc_feature (519)..(519): n is a, c, t, g, unknown, or other
tggagctccccgcggtggcggccgctctagaactagtggatcccccgggctgcaggaattcgcacgagaccattacctagaacatcctaaaaaaaaaggaattctgccttcttctctcatcttcctgctcaacatcagtagcagctttagctgtagcagcgccaccggccaccgccacgctatggccaccacgttgcacaagcccctgggggcgatcaccgttgacgacctcgccgcggcggcgcctgggtcggacgccaccgcgctccacgcagcgctccggngcgcgctcgactcgcacggacccaccgaagtgtggggcgagctctgccggtccgtgctctgtccgtctgtccccttcgccgtccaccggatgctctactaagcgttgcttcgcgggttcccgtctccccacgcgnncgctggacgcccgaccccaagaggctgtcttgaccaatgtcgggcgtgtcctcgaggcgcgtggtagggacttcatcggcgacgcgtacaaggatcccnatcacagcttcccagacctccacaaagtctccaacgagaacccagaggcgtactggaagatgggtatttgagatatggttatcccattcagcgtagagccatcctgcatctggagagagacactgcatatcctggtggcgagtggctaccagggccgagctcacgctgctgctaatgttgac

SEQ ID NO: 30658 - protein, 67 aa, Zea mays
  misc_feature: Ceres CLONE 1406244-F
  misc_feature (35)..(35): Xaa is any aa, unknown, or other
MATTLHKPLGAITVDDLAAAAPGSDATALHAALRXALDSHGPTEVWGELCRSVLCPSVPFAVHRMLY

SEQ ID NO: 30659 - DNA, 707 bp, Zea mays
  misc_feature: Ceres CLONE 1406245-F
  misc_feature: Translation starting site: 238
  misc_feature: Pfam Name: DMRL_synthase Pfam Description: 6,7-dimethyl-8-ribityllumazine synthase
  misc_feature: SWISSPROT Homolog: EC 2.5.1.9 Riboflavin synthase
  misc_feature (671)..(671): n is a, c, t, g, unknown, or other
  misc_feature (672)..(672): n is a, c, t, g, unknown, or other
aaagctggagctccccgcggtggcggccgctctagaactagtggatcccccgggctgcaggaattcgcacgagaccattacctagaacatcctaatcgaaaatggatgctcggtttcgcacatcaggagggtaggacaaaggacgggcgtacctgttgggtgctcgtcgctggcgaatggcgcagcgaagacctggggcacctgttgtaggggtctttgaacaacaacgagggactcatgtttggggtggttgtggcacggttcaacgaggtcgtgacaaatttgttactacagggtgccctggaaactttcgagcgatactcttaaagcagaaaatataacagttgttagtgttcctggaagctttgaagttcctataacggcacaaaagcttgggaaatctggaaaatttgatgcaattctgtgcattgcagctgtgattagaggtgacacaacccactatgatgccgttgcaaactcagctgcatcaggtgtactcaatgctggattatctgctggtgttccttgtgtatttggtgttctaacctgtgaagacatggatcaggcactgaaccgtgctggtggcaaggctgtaaacaaaggagctgaagctgctcttactgccattgagattgcctcgctggtccggcacacttaggctgacaccctgnngtactctatttctatacacgaggcgcagcatttct

SEQ ID NO: 30660 - DNA, 685 bp, Zea mays
  misc_feature: Ceres CLONE 1406246-F
  misc_feature: Encodes the peptide sequence at SEQ ID NO. 30661
  misc_feature (365)..(365): n is a, c, t, g, unknown, or other
gagctccccgcggtggcggccgctctagaactagtggatcccccgggctgcaggaattcgcacgagaccattacctagaacatcctaatcgaaaagaacgcactctactctcgcacacagccgccgggcgggcacagtgacgcggccacgcgggcgccggagctagggtttccctgatccggcagggccggggagccgccggaaaccgttgctcgatttcggcgccggaggcgcggcatcggtgtctccgaggacggcggacgcgaggcgggttggggagctgaggcgcggcgcccggggctcagatctggtatgaccgacggcggcgaagacgggaatgcgggggcgcccagggccccctcgcngcgaaggggacctgtgccggccagcctcgatgccgacgagttcatggcgctgatgcacggctcggatcccgtcagggtcgagctcacccgcctggagaacgagctcagggacaaggagagggagcttggggaggcacagacggaaatacgcccactgcccttgtcgaagaggggccggaaaaaagcgtccaggaacttaagatggaatggaaagaatgctggaaaactccagctgacaggatctctccttggaaggcaaggcccccacttatccttgcttttggccggggcccccaatggatggatggaaataacacacc

SEQ ID NO: 30661 - protein, 124 aa, Zea mays
  misc_feature: Ceres CLONE 1406246-F
  misc_feature (18)..(18): Xaa is any aa, unknown, or other
MTDGGEDGNAGAPRAPSXRRGPVPASLDADEFMALMHGSDPVRVELTRLENELRDKERELGEAQTEIRPLPLSKRGRKKASRNLRWNGKNAGKLQLTGSLLGRQGPHLSLLLAGAPNGWMEITH

SEQ ID NO: 30662 - DNA, 676 bp, Zea mays
  misc_feature: Ceres CLONE 1406248-F
  misc_feature: Translation starting site: 231
  misc_feature: SWISSPROT Homolog: EC 1.14.13.41 Tyrosine N-monooxygenase
aaagctggagctccccgcggtggcggccgctctataactagtggatcccccgggctgcaggaattcgcacgagaccattacctagaacatcctaatcgaaaaaccctcccccaccgccattggtcagcatcagtagtaaagccacgcctgacagacagctggttcatttctgggtgctgccttgctggtggtagccctcggcgcaggcagccaacaccagatagatcgagatggatgtcaacgacctgctgctactggtgctggcggcggcgctggctgccatgtggtggcgtcggtgctccaagaccggtggtgtcgacggcctcccgccgggggctccgggttggccggtggtggggaacctgttccaggtgatcctgcagcgaccgcccttcatgtacgtgttgcgcgacctccgggagaagtaccggcccctcttcaccatgcggatgggggagccaccctcatcgtggtcacctcggaggagctcatccacgatgcgctggtgaagcagggccccatgctcgcgagccggcccgaggacagccccacccgcctcctcttcagcgacggaaagtgcaccgtcaactcggagccctacgggcccctgtggagggctctgcgccgcaacttcgtcgcagagatcgtgtcccgcaccgcgccacaggtttctcct

SEQ ID NO: 30663 - DNA, 679 bp, Zea mays
  misc_feature: Ceres CLONE 1406253-F
  misc_feature: Encodes the peptide sequence at SEQ ID NO. 30664
aaagctggagctccccgcggtggcggccgctctagaactagtggatcccccgggctgcaggaattcgcacgagaccattacctagaacatcctaatcgaaaaacacaaatccaatctcgctacgtgaagttcgcctcgcggccggctgggtcgcgggctccatcggcgtcgccgccgccggctccgccacgctctactgcatgttgctactcgtggactgcagggataaactcaaagaggaagaaactgaagagtgctgtcatggtcactatacatatggggatttgggtgacaggtgcttcgggactataggccgatgcttgacagagaccctcgtccttgtttcgcaggctggtggttctgtagcatacctgatattcattggccaaaatctccattccacattcagccagctgatgtcaccagctggcttcatctttgccatcctcctgcctctgcagatagcgctctccttcatccgctcactgtcgtccctttctccgttcagtatatttgcagacgtgtgcaatgtccttgccatggcaatcgttatcaaagaggatcttcagctctttgaccaccccttttcaaacagaagcgcttttaatggactgtgggcagtaccattcaccttcggtgttgcagtcttctgtttcgaaggattcagcatgacccttgc

SEQ ID NO: 30664 - protein, 159 aa, Zea mays
  misc_feature: Ceres CLONE 1406253-F
MLLLVDCRDKLKEEETEECCHGHYTYGDLGDRCFGTIGRCLTETLVLVSQAGGSVAYLIFIGQNLHSTFSQLMSPAGFIFAILLPLQIALSFIRSLSSLSPFSIFADVCNVLAMAIVIKEDLQLFDHPFSNRSAFNGLWAVPFTFGVAVFCFEGFSMTL

SEQ ID NO: 30665 - DNA, 614 bp, Zea mays
  misc_feature: Ceres CLONE 1406256-F
  misc_feature: Encodes the peptide sequence at SEQ ID NO. 30666
cgctctagaactagtggatcccccgggctgcaggaattcgcacgagaccattacctagaacatcctaatcgaaaaagttagtagttcaccagagttcacacaaaaatcacaagcaagcagtcgcgtgtgtagctcgcaacaatggcgacgaaccccggcctcttcaccgagtggccgtggaagaagctcggcaacttcaagtacctgctgctggcgccgtgggtggcgcacggcggctaccaagcggcgaccaaggggtggagggcggccgacctggggtacgtggccatcctcccgtcgctgctcctccgggcgctgcacaaccaggcgtggatcaccgcgtcccgcctgcagagcgcgcgcggccggcggcaggtcgtggaccgcggcatcgagttcgagcaggtggaccgggagcgcaactgggacgaccagaatctggttagggggattcccccctgaacctggggtccccccccaaacgtggggggggggggggggccacccaccccccccccccctgggtgggggagccccacaaggaagggaggggggggggggggtttttcttcctctgtgtgggtggccccgccccccccatagaattattttat

SEQ ID NO: 30666 - protein, 106 aa, Zea mays
  misc_feature: Ceres CLONE 1406256-F
MATNPGLFTEWPWKKLGNFKYLLLAPWVAHGGYQAATKGWRAADLGYVAILPSLLLRALHNQAWITASRLQSARGRRQVVDRGIEFEQVDRERNWDDQNLVRGIPP

SEQ ID NO: 30667 - DNA, 736 bp, Zea mays
  misc_feature: Ceres CLONE 1406264-F
  misc_feature: Encodes the peptide sequence at SEQ ID NO. 30668
  misc_feature (581)..(581): n is a, c, t, g, unknown, or other
  misc_feature (582)..(582): n is a, c, t, g, unknown, or other
cagagctggagctccccgcggtggcggccgctctagaactagtggatcccccgggctgcaggaattcgcacgagaccattacctagaacatcctaatcgaaaagtttttcctgatctcgcctcccgagccacacacgttgccgccgtgagccgccgcccacaaggctaagcaccaaccatggccttcggagctctcgtcacgtcgaggctggccaggtccggccgcacccttgcatctgccgttgcccagggtcccgttgcccagcggatagcacctcctctgctctccaggcttggagcagtagctcgtcttctcagcacaaagccagccgcaacagatgtcatcggtatcgatctaggcactacgaattcctgcgtctccgtcatggaaggaaagacaccacgggtgattgaaaatgcagaaggcgcgaggacgacaccctccattgttgccaagaatcagaatggtgacctgttgattggtatcacagcgagccggcaggcagtaaccaatgccccagacacaatcccgtgggtcaaagcgtcttatcgggtagacttttgatgacccacagacccannaagagatgaagatggtgccttacagaaatgtcaagcccccaatggtgatgcctggggtcaaatgggtggcaacagtacctcccctagccagattggggcatttgtcccccctagatgaggaaactgcaaagcttaactttggaaaacggtttca

SEQ ID NO: 30668 - protein, 128 aa, Zea mays
  misc_feature: Ceres CLONE 1406264-F
MAFGALVTSRLARSGRTLASAVAQGPVAQRIAPPLLSRLGAVARLLSTKPAATDVIGIDLGTTNSCVSVMEGKTPRVIENAEGARTTPSIVAKNQNGDLLIGITASRQAVTNAPDTIPWVKASYRVDF

SEQ ID NO: 30669 - DNA, 659 bp, Zea mays
  misc_feature: Ceres CLONE 1406268-F
  misc_feature: Encodes the peptide sequence at SEQ ID NO. 30670
  misc_feature (599)..(599): n is a, c, t, g, unknown, or other
aaagctggagctccccgcggtggcggccgctctagaactagtggatcccccgggctgcaggaattcgcacgagaccattacctagaacatcctaatcgaaaaacctcctatggccaccgtcgactgccccctgccctctcccgcggacctcgacgacaacggattcccggctctaccctcatcccccgctgcctgtagcagcggcttcgcggaggacttctaccgcagcggcaccgactggtcctccttacgcgcccctccgccgctggggccgcccagaaggcacccggtgtgaaggagagaggaggcggctcggccgtgcagagcagcctcttccaggcgtgggggatcgagaagccgcggcgggacgggcgtggggctgattcatcgcttgtgcagaggagcctcttccaggcatgggggatcgagagaccgcagagggagggtctcggggctggagattcctccccctcctcctccctttccggttctttgttggcaaggaagcggaggcgaggaagcaccgaagagggagcgggtggcggccaaagagccccctcgcgtgccccttctacaagaagatccctggcacaccattncacgggggatgcatttcggaaaggacaaggtggagggggggtcggcctatttcctaaacc

SEQ ID NO: 30670 - protein, 61 aa, Zea mays
  misc_feature: Ceres CLONE 1406268-F
MATVDCPLPSPADLDDNGFPALPSSPAACSSGFAEDFYRSGTDWSSLRAPPPLGPPRRHPV

SEQ ID NO: 30671 - DNA, 643 bp, Zea mays
  misc_feature: Ceres CLONE 1406272-F
  misc_feature: Encodes the peptide sequence at SEQ ID NO. 30672
tctgaactagtggatcccccgggctgcaggaattcgcacgagaccattacctagaacatcctaatcaaaaatcacctctcactaccaccaccactgccccggatccataccagctgcagcagcagcgctcgcgagctagcttcggtcggtcgatagatcgatcgatcgctctgccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtgctcgccttcctcggcggtctcgccttcaccatctccggctacatcatgtccaggcccagggccgtgtacctcatcgacttcgcatgctacaagccggccgacgagctcaggtgtccaaggggggagttcatctaccgggcgcggaagtccggcaaggtccag

SEQ ID NO: 30672 - protein, 155 aa, Zea mays
  misc_feature: Ceres CLONE 1406272-F
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLAFLGGLAFTISGYIMSRPRAVYLIDFACYKPADELRCPRGEFIYRARKSGKVQ

SEQ ID NO: 30673 - DNA, 740 bp, Zea mays
  misc_feature: Ceres CLONE 1406280-F
  misc_feature: Encodes the peptide sequence at SEQ ID NO. 30674
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (50)..(50): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (117)..(117): n is a, c, t, g, unknown, or other
  misc_feature (299)..(299): n is a, c, t, g, unknown, or other
  misc_feature (740)..(740): n is a, c, t, g, unknown, or other
nnnnnnnnnnnnnnnnncccccccccaccccccnnnnccnnnangnnnanggggggggnnnnnnnacaagctggagctccccgcggtggcggccgctctagaactagtggatccccncgggctgcaggaattcgcacgagaccattacctagacatcctaatcgaaaaagcgcaaaaccctagcctcgcccgtcccaaaccctggcggctacggtctctgatcccggtccaatggcgtcgtcgccggacttgttccctaacgttgccttctccgacgtctctgccgccgcccccgcggncgaggccaccgccgcgttcgggctcggcgccgccaccggggccccgcgcctctgcctcgtcaagtccgggaaggacgaggcggaagccacggtcgacatcgacctcggccgatggcgcaggattttaagttgcgacccaccgcatgggcttgggggtgggcaacaaatccgaaggttaagggctggcgggggaaaaaaaaatcattttttcaagaagcaattaaagggttggtccctaaggaccaaaagcttgagaaaaaaaggcccttccccttttaactttttccaaaaaggggaaaaacttccagggtattttagggggaacaaacttgggtgaaaaaggttgggaaaaaaagggaccaaaaaaatgtgggtctccaaaaagacaaaattttgataacaaaaaatttgggggggcctccccccccccccaaaaagttn

SEQ ID NO: 30674 - protein, 134 aa, Zea mays
  misc_feature: Ceres CLONE 1406280-F
  misc_feature (23)..(23): Xaa is any aa, unknown, or other
MASSPDLFPNVAFSDVSAAAPAXEATAAFGLGAATGAPRLCLVKSGKDEAEATVDIDLGRWRRILSCDPPHGLGGGQQIRRLRAGGGKKNHFFKKQLKGWSLRTKSLRKKGPSPFNFFQKGEKLPGYFRGNKLG

SEQ ID NO: 30675 - DNA, 747 bp, Zea mays
  misc_feature: Ceres CLONE 1406281-F
  misc_feature: Encodes the peptide sequence at SEQ ID NO. 30676
agagctggagctccccgcggtggcggccgctctataactagtggatcccccgggctgcaggaattcgcacgagaccattacctagaacatcctaatcaaaaaacgacaaatcgacgatcgccgcttctcttggccattgtagagggagagagagagcgcgagcgacctaggtcagtcggtttcggttttgggcgtcagcttcagctatccgcgaccgcgacgatgggtctgcgcgtggccgccaccgcgccagctccggccggcgtgcgcgtgctcggcaggggcgccgcgcgcgtgacgccgcgaccgtgggcggctgtcggcggcaggagacgcttctccgtgcggatgtccgtcgcgaccaccgaggccaccaccaccatcgccgtgggcgcctcgtaggaccaggcgctggaggctaggaactccaagacggtggtggcggtcatcctcggtggtggcgccgggaccaggctcttcccgcttaccagacgcagggccaagcccgcggtgccaattggcggcgcgtacaggctcatcgacgtggcgatgagcaactgcataaacagcggcatcaacaaggcctacatcctcgcgcagatcaactcgcaatccctctatcgccacctcatgagagcctacgatttcagctatgccgtgctcatcggagacagattcgtcgaggttctaggagcaacccagaggcctggaacggaggggaaaggtgacttcaggctactgctgatg

SEQ ID NO: 30676 - protein, 66 aa, Zea mays
  misc_feature: Ceres CLONE 1406281-F
  misc_feature: SWISSPROT Homolog: EC 2.7.7.27 Glucose-1-phosphate adenylyltransferase
MSNCINSGINKAYILAQINSQSLYRHLMRAYDFSYAVLIGDRFVEVLGATQRPGTEGKGDFRLLLM

SEQ ID NO: 30677 - DNA, 553 bp, Zea mays
  misc_feature: Ceres CLONE 1406282-F
  misc_feature: Encodes the peptide sequence at SEQ ID NO. 30678
  misc_feature (199)..(199): n is a, c, t, g, unknown, or other
  misc_feature (209)..(209): n is a, c, t, g, unknown, or other
  misc_feature (216)..(216): n is a, c, t, g, unknown, or other
  misc_feature (235)..(235): n is a, c, t, g, unknown, or other
  misc_feature (236)..(236): n is a, c, t, g, unknown, or other
caaagctggagctccccgcggtggcggccgctctagaactagtggatcccccgggctgcaggaattcgcacgagaccattacctagaacatcctaatcgaaaaaacggtgtcctgcacttgcacccctatgccgtcgccgcggcggcagcggcattgatctcggcgtacatggtgtgggtctgggcgctgacgcgacgnctgtccgggnccgcggnatggtggcccctcgtcggnnagccttggccagggtcgtcctgaatcggggggggggttcacggagtggatgggcgaaaaacctggggtttcaaggggggaaaaggggtccaccgaaacaaaaagggggattttgggcggtggggggttttttgggggggggcccccccgggggttgggggaacccccaaggggaaaccccccggaaaaactggggaaaaaatccggggggggggggggttttaaaaaaaaaaaccccccaagggggccccccgtggggggggggggggggggcaacaaaaaaatccctgggggggggggagggtgttttttttcccc

SEQ ID NO: 30678 - protein, 85 aa, Zea mays
  misc_feature: Ceres CLONE 1406282-F
  misc_feature (70)..(70): Xaa is any aa, unknown, or other
  misc_feature (72)..(72): Xaa is any aa, unknown, or other
  misc_feature (79)..(79): Xaa is any aa, unknown, or other
KAGAPRGGGRSRTSGSPGLQEFARDHYLEHPNRKNGVLHLHPYAVAAAAAALISAYMVWVWALTRRLSGXAXWWPLVGXPWPGSS

SEQ ID NO: 30679 - DNA, 713 bp, Zea mays
  misc_feature: Ceres CLONE 1406287-F
  misc_feature: Encodes the peptide sequence at SEQ ID NO. 30680
aaagctggagctccccgcggtggcggccgctctagaactagtggatcccccgggctgcaggaattcgcacgagaccattacctagaacatcctaaaaaaaaccttaatcctatactttcatcgggcgcggcgtgccccctcgcctccaaggctccaacgcatcaatcaatatagcgagcgcgctgtggcatggagcacaaggatgggggcacagcttctgctggtggtctgcccgccggaagcagcttgtgctcgggctcgccgttgctcgacgcgccgatcctccgccgcctctacggcgggcaaatccttgccagatggggcgcgagacatcctctctcgtggtgctcggtcccgtggaggggacgctcgttggaagggccacataccttcaggttttgggcatctggctgctgtcgcaaagcatatccttgattgtcgctggaacctcgatgaccaccctgctcatgtatgccaacctgagagccacaagcttcccggcattcatggcgctggtcgccgttaccaacgtctccggcgctctagctgccctctcagctctcgccggcaccatactgatccagagagaatgagtggaggtgatctctagcggtcatcctccgtcagcgcggacggatatcaactcggtggtccggcggatcgacctgtgctgctcgctgctgacccccgtgatgtcgtctctcgtcatcacc

SEQ ID NO: 30680 - protein, 91 aa, Zea mays
  misc_feature: Ceres CLONE 1406287-F
MGRETSSLVVLGPVEGTLVGRATYLQVLGIWLLSQSISLIVAGTSMTTLLMYANLRATSFPAFMALVAVTNVSGALAALSALAGTILIQRE

SEQ ID NO: 30681 - DNA, 747 bp, Zea mays
  misc_feature: Ceres CLONE 1406291-F
  misc_feature: Encodes the peptide sequence at SEQ ID NO. 30682
aaagctggagctccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaatcaatttcttcgtccgccttcgcccctgcttacgtccccgctactaaccctaggatcattctgtcttttctcgtttcttatccgactcttcttcgttttatgcctatcagttatgaggttgaacgccttcagaagcttctctactagattagtgtaaatagtagacttgttcgagtttagcttggctggaagaattagtctctggtccgtgtttatatctgctagcaataatggctgcgatgaacggagaggtattgggtgaatgtggaaggaacataaatagtctcaagagaaagcgggagagccccgctgcatatgctgctggcgtattctgcaccctctgattgcatcagcatactgtcaatgattctgctgttaggtttcatcttgataaagacgtaagggcaaagatcgtgtgccacttcacaa

SEQ ID NO: 30682 - protein, 37 aa, Zea mays
  misc_feature: Ceres CLONE 1406291-F
MAAMNGEVLGECGRNINSLKRKRESPAAYAAGVFCTL

SEQ ID NO: 30683 - DNA, 658 bp, Zea mays
  misc_feature: Ceres CLONE 1406294-F
  misc_feature (611)..(611): n is a, c, t, g, unknown, or other
aaagctggagctccccgcggtggcggccgctctagaactagtggatcccccgggctgcaggaattcgcacgagaccattacctagaacatcctaatcgaaaaagctctgagacttttcacaaggagcagagaggacaccgcaccagcccgttctcgttgcactcggggcaccgcctgaatgtggccgcctcctcgacgaacaccttgcagctgccggagcactcctcgcagggcacgaaccgcacgccgccgcagccggagcacgcctccagggcaacgcccttgccgcccgggcagctcggcgggggcgccatctcgcaggcctcgagcgcctccgacagctcgccggcctcgtgcatccggcggacctcctcggcgccgcccaggtgcctgccgtccgcgaacacctgcgggagcctgcccgcgctggagccgcccagcgcggcgtggagctcgtccttgaaccccgcgtgcatcgacaggtctcgctcgtcgacgcgcacgccgtagctctggaggacggaccttgtggaccagcagtcctcgtacgtcttgcggacgccgcggaggctggtcaggtacccaccaccttccggcgctgtcccggcggngcggcacggccggggggggggcggcgccaggctggcgaggcttccgg

SEQ ID NO: 30684 - DNA, 675 bp, Zea mays
  misc_feature: Ceres CLONE 1406296-F
  misc_feature: Encodes the peptide sequence at SEQ ID NO. 30685
  misc_feature (626)..(626): n is a, c, t, g, unknown, or other
aaagctggagctccccgcggtggcggccgctctagaactagtggatcccccgggctgcaggaattcgcacgagaccattacctagaacatcctaatcgaaaaacacacgcgggcgcgctagctagtgagagtcggagatgtcgtcgccgcggccacacttcctcgtgctcaccttccctttccagggccacatcgccccggctctccgcctcgccaggcagctgctcgcggcggcgcccgacgcgctcgtgaccttctccaccaccgaggtcgcgcacaggcgcatgttcccggcaaagcccaacgacggcgccaaggactccgacgaagacggccgcctcgagttcctcccgttctccgacggcacggaggccgggtacgtccggagcgccgacctgggctcgttcaacgcctacatgacgtctttccacgccgcgggggcgcgcagcgccgcggagatcgtgacggtccttccgggcgcggggccgccccgtggtcccgcgtcgtgtacacgctgctcctcccgtgggcggccgacgtcgcgcgggaccgcgggatcccgtccgcgctctacggggatccagccggtctccgtgttcgccatctaccaccactacttccacggncacggccgggcgtcgtcgccgaccaccttcacgacccgtcggtccggtg

SEQ ID NO: 30685 - protein, 179 aa, Zea mays
  misc_feature: Ceres CLONE 1406296-F
MSSPRPHFLVLTFPFQGHIAPALRLARQLLAAAPDALVTFSTTEVAHRRMFPAKPNDGAKDSDEDGRLEFLPFSDGTEAGYVRSADLGSFNAYMTSFHAAGARSAAEIVTVLPGAGPPRGPASCTRCSSRGRPTSRGTAGSRPRSTGIQPVSVFAIYHHYFHGHGRASSPTTFTTRRSG

SEQ ID NO: 30686 - DNA, 694 bp, Zea mays
  misc_feature: Ceres CLONE 1406300-F
  misc_feature: Encodes the peptide sequence at SEQ ID NO. 30687
aaagctggagctccccgcggtggcggccgctctagaactagtggatcccccgggctgcaggaattcgcacgagaccattacctagaacatcctaatcgaaaaatcaccatttcgctagctccatagcacttgctccagctagataggcacagagagctttgtttacgcggcggccagatgaccacgacgcctggagactgggactgcagggcgtgccagcacctcgacttcagccggcgtgatgcatgccaccgctgcactgaaccacgtggagttgctgatcgtatcggcgctgttggcgacttggacgatcgtgtcgcgtcctccttcgacggtgtctttggcgctgagtctgatgtccgacctgatgactggtactgctgctgcggcgcacacaacttcgccaggcgctaccactgctacaggtgctctgcctagcatggagtagctgtcggcgactttatactaacatgtcaggctcacgccgttaccccggcttcgcaggcgggctgccgcccgtaccaacagccccggatggaagtactggaaactggatctgccccatgggccggctggcacgagcccaacttccctagcaggttggatggtttaggtgcaaccccccccggaactccggaagccctcccctacaacctacaaaattacttgtcctggaggggaccttaagcaacct

SEQ ID NO: 30687 - protein, 86 aa, Zea mays
  misc_feature: Ceres CLONE 1406300-F
MTTTPGDWDCRACQHLDFSRRDACHRCTEPRGVADRIGAVGDLDDRVASSFDGVFGAESDVRPDDWYCCCGAHNFARRYHCYRCSA

SEQ ID NO: 30688 - DNA, 835 bp, Zea mays
  misc_feature: Ceres CLONE 1406300-R
  misc_feature: Encodes the peptide sequence at SEQ ID NO. 30689
  misc_feature (1)..(1): n is a, c, t, g, unknown, or other
  misc_feature (2)..(2): n is a, c, t, g, unknown, or other
nnggccgattgggtaccgggccccccctcgaggtcgacggtatcgataagcttttttttttttttttttgggccaacagtcaccgttaaatgctgcgaaggtccgatagaacatagcagataacgacaatctggtgacgacatcgacgcctccagcagagtataataattaagaaataagggcatattaacacgattaatagacgtaacttagaagaacaaagtcgacctgaaactacttccccaaagcatttccatatgcgagtagcaaaaaagaaataacaggctcagttagttctataataacaaaatggctccccccgacctctgctcctcaaacaaaacagtcagctcgagctaggcgtttgcacccagctcaaccctcccaggatggccatggccgcctgcctgtgcacctccaccatggttgttgtaataagagttgcgaccaccccggcctctgttgttgtagttcctcggctggtagtatccagattcgtagtacccaccgcctccgccacggccattctggtatccaccgccacctcggccattctggtacccacgcactccacgaccattaggatagcccctcctgccgccaccacgaccgccgccactacgctggttctggtaagagcgccgctgggtgaattgttggtctttttgttcctgatcgtccacataatcgtcaaatgtctcctgctctgcctcagctgaaggaacttcatgagctggggtcaccaagccttcatcatccacatgttcagcgtcaacaacaggagcctgatggtcactgtagatttctgtagcctgagaatcttccttctcggtct

SEQ ID NO: 30689 - protein, 109 aa, Zea mays
  misc_feature: Ceres CLONE 1406300-R
MAMAACLCTSTMVVVIRVATTPASVVVVPRLVVSRFVVPTASATAILVSTATSAILVPTHSTTIRIAPPAATTTAATTLVLVRAPLGELLVFLFLIVHIIVKCLLLCLS

SEQ ID NO: 30690 - DNA, 722 bp, Zea mays
  misc_feature: Ceres CLONE 1406302-F
  misc_feature: Encodes the peptide sequence at SEQ ID NO. 30691
  misc_feature (525)..(525): n is a, c, t, g, unknown, or other
agagctggagctccccgcggtggcggccgctctagaactagtggatcccccgggctgcaggaattcgcacgagaccattacctagaacatcctaatcgaaaaatcatctccagcggcttcttccaaagctccaactacgacgagaaccgccactcctcgaaatctccaaggattttctgcggcgaaccccttcgtgacgtgacccaatgggagaggcctcgccgtcgatcgccaaggacgtcaccgagttgatcgggaacacgccgctggtgtacctcaacaaggtgaccgatgggtgcgtcggccgcgtcgccgccaagctcgagtccatgtagccctgctccagcgtcaaggataggattggctacagcatgatcacggacgcagaggagaaagggctgattactcccagcgtgagtgttctgattgacccaactagccggcacacaaggcattggactggcctttatgggctgcttgcaaggggttaaaaacttacccctcacatggccggcctcccatgancatggggggggaggatcttttgggaagggtttttggggggggaaatttggccctttagggacccccactcccgggaaataaaaaagaatttcttccaaaaaaaggggggaaaaaaaaaaacggcgaaaaagaccccccccttttggagaattctttctaaaaaaattttgggaaaccccccccccccccccccccca

SEQ ID NO: 30691 - protein, 42 aa, Zea mays
  misc_feature: Ceres CLONE 1406302-F
  misc_feature: SWISSPROT Homolog: EC 2.5.1.47 Cysteine synthase
MGEASPSIAKDVTELIGNTPLVYLNKVTDGCVGRVAAKLESM

SEQ ID NO: 30692 - DNA, 586 bp, Zea mays
  misc_feature: Ceres CLONE 1406310-F
  misc_feature (259)..(259): n is a, c, t, g, unknown, or other
  misc_feature (260)..(260): n is a, c, t, g, unknown, or other
  misc_feature (278)..(278): n is a, c, t, g, unknown, or other
  misc_feature (361)..(361): n is a, c, t, g, unknown, or other
  misc_feature (362)..(362): n is a, c, t, g, unknown, or other
  misc_feature (366)..(366): n is a, c, t, g, unknown, or other
  misc_feature (399)..(399): n is a, c, t, g, unknown, or other
  misc_feature (520)..(520): n is a, c, t, g, unknown, or other
aaagctggagctccccgcggtggcggccgctctagaactagtggatcccccgggctgcaggaattcgcacgagaccattacctagaacatcctaatcaaaaaggaaaaggggacaaaccaccaacaacaaccagaatatcgcatcgccgtcgcgtcgtcgtcgatctccccgccccgccccgcccgcgccgcggaatctgacacatctccctaaatctctcctaggaccgggtgcccttacatccacgcccgcacgcannatcgccgttcccggaagnccccctttccggggtttctccgtttccccggggaaaaggaccccgaaaaaaggggtggcccaggggggggggttttgtggggnngggnaaaaaaaaaaccggagggggggggggaaaaaantatttccccccccccacaagggggccccggagggctttttttttctcccccgccctgtggggggaaaagaaaaaaaacccccccccggggggggggggggggaaaaataatggggggggcncgcccccccccttttgggggggaaaaacccccccccgggggggggggggggggacacccccccccc

SEQ ID NO: 30693 - DNA, 588 bp, Zea mays
  misc_feature: Ceres CLONE 1406311-F
  misc_feature: Encodes the peptide sequence at SEQ ID NO. 30694
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
aaagctggagctccccgcggtggcggccgctctagaactagtggatcccccgggctgcaggaattcgcacgagaccattacctagaacatcctaatcgaaaagtttttcctgatctcgcctcccgagccacacacgttgccgccgtgagccgccgcccacaaggctaagcaccaaccatggccttcggagctctcgtcacgtcgaggctggccaggtccggccgcacccttgcatctgccgttgcccagggtcccgttgcccagcggatagcacctcctctgctctccaggtttgaagcagtactcgtctctcacacaaaagccagcgaacagatgtatcggtatcgattaggcactacgaattctgcgctgcgcatgaaaggaagacccacgggtgatgaaatgggaagggcgaggagaaccctccatagtggccaaaatcaaagggggcctgttaattggatacccggggccggcggggaaaacccatggcccaaaaaaaaatcggggggggaacggggnnnnnnnnnnnnnnnnnnnnnnnnnnnnnnnnnnnnnnnnnnnnnnnnnnnnnnnnnnnnnnnnnnn

SEQ ID NO: 30694 - protein, 115 aa, Zea mays
  misc_feature: Ceres CLONE 1406311-F
MAFGALVTSRLARSGRTLASAVAQGPVAQRIAPPLLSRFEAVLVSHTKASEQMYRYRLGTTNSALRMKGRPTGDEMGRARRTLHSGQNQRGPVNWIPGAGGENPWPKKKSGGERG

SEQ ID NO: 30695 - DNA, 761 bp, Zea mays
  misc_feature: Ceres CLONE 1406313-F
  misc_feature (32)..(32): n is a, c, t, g, unknown, or other
tgtatcccaccccaccaagcacccccccgccnggaccccaagcggctcggccaaaactggagctccccgcggtggcggccgctctagaactagtggatcccccgggctgcaggaattcgcacgagaccattacctagaacatcctaaaaaaaaaaccgctatggtccatccacatccacagtcgccatcgcccccacctctcaccgtcgtcttcgtgcaccactcggcctccactgccggtcgcgcctcccagccacctcgtgccgctctgccaccccgcgcatcctccaccgcccctatggctgccacgggcgagcgctgcccgagcagtcgaccgccctttccgtgccgccccgcctccccgctaggcctccactgcccactgctccggcgcctacagtggaaggcaaggagaaggacatcgggcggcggtagctggatctggcaagcacaaggccgcgcccccggcggcgcctggatctgcgttgcttgcaaccccccccccccccccccccgacacacacacacacacaacagatctgctacggggaaaatctgatggtcggccgcatcgccaaaaaggccgggggacgggaaaataaagcctccatcagcccttaatcctcacgtcgttcccgcaccgagaaatcccgcgccaagggcgccctgggacccggacaatggacgatttattccttattggcctaaacaccccaatgggcggatgggtggcccaacaggctgggaatgttttggcctaa

SEQ ID NO: 30696 - DNA, 599 bp, Zea mays
  misc_feature: Ceres CLONE 1406315-F
aagctggagctccccgcggtggcggccgctctagaactagtggatcccccgggctgcaggaattcgcacgagaccattacctacaacatcctaatccaaacatccagcacaagcttcaatacaagtcctcggctccgcatccatctggaagcaaccaagtttctgccaaagttcaactgcctgccttaaataacttccctgcatgttagcggaacaattctatgatttctgggaggatatcaatcatttccttgcagaggatgtgaaacacgccaattaagatgtgtacgcccacttctgttatgatataaaacaactttctgatcgcttcctcctgtgcagaggtatttgtcattaggggccacagcaaccgcattagcacatcgagtatgggcaacgatatgtctgacacaagggtgacctagagtaacgtcccacattccaacactgccatcaccacctacagtgacaagtacagggttcggtatggcaacactgtgtggaatttacccgcctgatcacccctcgtcaaaatgaccctggaaggttgacctgggggtattctgaagaaaggcttttgatttccatggctcaacgca

SEQ ID NO: 30697 - DNA, 771 bp, Zea mays
  misc_feature: Ceres CLONE 1406317-F
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (35)..(35): n is a, c, t, g, unknown, or other
  misc_feature (37)..(37): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (139)..(139): n is a, c, t, g, unknown, or other
  misc_feature (142)..(142): n is a, c, t, g, unknown, or other
  misc_feature (145)..(145): n is a, c, t, g, unknown, or other
  misc_feature (685)..(685): n is a, c, t, g, unknown, or other
  misc_feature (716)..(716): n is a, c, t, g, unknown, or other
  misc_feature (758)..(758): n is a, c, t, g, unknown, or other
ccccccccagaggggttttnnnnnnntttgagggncntgggggggnnntcaaagctggactccccgcgggggcggaaatttgtttctagaacgaggcggcggggggctttaattcacacaaccccattaccgagaacanccnaancaaaaatcgctctctcctttgcacccctagctagctagtactactgctgctcctccttttccatcttagcgcagcaggacggagaaacaagaaccatccctccccctaccggctaccgctgctactcatggtcgcgcgcactgcctcctggtgccgccgcgtatgatccagacatgaatagggcgcacagcagcagctccaagctcatcaacgagaagctcgtggaacaccggatctccactgcgaagcactgcccccactgcggtgagaaaatcgacagcaaaccggattgggtggggctgccggcaggcgtcaagttcgatccaactgaccaggagctgatcgagcacctcgaggcgaaagcgaaggatgaaggctcgagatctcaccctctcatcgacgagatcatacccacaacagcatggggaggacggcctatgatacctcccaaacaccaaaacctttcccacgcagcgaccaagtcattgggccaaagaccacggctcttccacaccacaaggcaatacaaaaggcccttcnccccccttgtcccccccagcgaacccctccngccacccaaccccgccccactctgtgggcaccctgccccccnacaccaccgggga

SEQ ID NO: 30698 - DNA, 777 bp, Zea mays
  misc_feature: Ceres CLONE 1406326-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (777)..(777): n is a, c, t, g, unknown, or other
nnnnccccccccccccccnnnnnnnnnnnnnnanagcggggcgggggggggccaaagctggagctccccgcggtggcggccgctctagaactagtggatcccccgggctgcaggaattcgcacgagaccattacctagaacatcctaacgaaaattccaccgccgcacacctcctgtcttccttcaccttcgcgctccgccgccgccgtcgattcgtgctgctctcacccctaacctgtccaacatcgccggggagggaagcagcagaagaacctccccttacctccggctatcgccctgaggataaagtggggtctgtaggggagtcttaggggcgagcaaaagggataggatagggagagatgaagcaatcaatttcttcgtccgccttcgcccctgcttacgtcccccctactaacccctaccaccgttctggggggtcgcggttcttatcccacctcttcttcgttttatgccctatagttatgagggtgaaacgccctcaaaagcttttcctactagattaggggaaaatagtaaaactttgtcccaagtttaacttgggcttggaaaaattaagtctcctgggcccggggtttatatctgctatagaaaaaatgggctgcgataaaacgggaaaagtgatttgggtgaaatgggggaaagaaaatataatagtccccaaaaagaaaggcgggaaaagcccccctggaaaagggggggctggggaattttcggccccccttggaattgcatcgacatacgtggcaagggttn

SEQ ID NO: 30699 - DNA, 803 bp, Zea mays
  misc_feature: Ceres CLONE 1406327-F
  misc_feature (19)..(19): n is a, c, t, g, unknown, or other
  misc_feature (20)..(20): n is a, c, t, g, unknown, or other
  misc_feature (41)..(41): n is a, c, t, g, unknown, or other
  misc_feature (48)..(48): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
gggggggcccccccccccnngcaaaaaaacaacatcccccngggcgcngaccaagctggagctccccgcggtggcggccgctctagactagtggatcccccgggctgcaggaattcgcacgagaccattacctagaacatcctaaaaaaatctctcgtctctatcgccgcatcgccttctctgccggagctccaacaacctcgcctcgcgcagcactccgctgaccctccctgactccctccctgccgctgggatggccgggaaacgagttacgggccgtgatggggaagacaagggcggggcctagggtcggtctccccggggaaggacctttctcccctcccgttccccgcagggcaaagcctgcctccattttcccggcgccccggttggtattattacccagaccagatggtcggcgggaccaggtgaagagggcttctaactggggtggagcgtccacgcgggatttctgggcaaaaaagaacctcgctcccccctttatgccaagggaaaccgggggaaaagcggcggaggtcttccgatgttaagtggccctttggccaaaaatctttgccaaggcgcctggggcggcctcgcctggcggggtgcaccaataagatcgcgcaactgtgcgaagcccccagcgcgccttttcccgatgttccggcgccggggggcgggggtttcctcaggtgaaagcagaagcttgggcgnnnggagcccacgaagccccacgccctggcgtcgccgcggcgttggcgaagcggggggagagcacgccccgcggggggggggggggg

SEQ ID NO: 30700 - DNA, 701 bp, Zea mays
  misc_feature: Ceres CLONE 1406329-F
  misc_feature: Encodes the peptide sequence at SEQ ID NO. 30701
caaagctggagctccccgcggtggcggccgctctagaactagtggatcccccgggctgcaggaattcgcacgagaccattacctagaacatcctaatcaaaaatcgctctctcctttgcacccctagctagctagtactactgctgctcctccgacttgctcttcgcgcagcaggacggagaaacaagaaccatccctccccctaccggctaccgctgctactcatggtcgcgcgcactgcctcctggtgccgccgcgtatgatccagacatgaatagggcgcacagcagcagctccaagctcatcaacgagaagctcgtggaacaccggatctccactgcgaagcactgcccccactgcggcgagaaaatcgacagcaaaccggattgggtggggctgccggcaggcgtcaagttcgatccaactgaccaggagctgatcgagcacctcgaggcgaaagtgaaggatgaaggctcgagatctcaccctctcatcgacgagttcatacccacaatagatggggaggacggcatatgttacacccaccccgagaaacttccaggtgtgacaagggatggcctaagcaagcacttcttccacccgggcgtcaagggcctacacgacggggcacgagggaagaaggaggaagatacagacgggagtgcggacgtcccacaaaggggggaggacgaaggtggcac

SEQ ID NO: 30701 - protein, 143 aa, Zea mays
  misc_feature: Ceres CLONE 1406329-F
  misc_feature (43)..(133): Pfam Name: NAM Pfam Description: No apical meristem (NAM) protein
  misc_feature: The sequence is a functional homolog of SEQ ID NO 562 in the 11/435,388 US patent application
MNRAHSSSSKLINEKLVEHRISTAKHCPHCGEKIDSKPDWVGLPAGVKFDPTDQELIEHLEAKVKDEGSRSHPLIDEFIPTIDGEDGICYTHPEKLPGVTRDGLSKHFFHPGVKGLHDGARGKKEEDTDGSADVPQRGEDEGG

SEQ ID NO: 30702 - DNA, 675 bp, Zea mays
  misc_feature: Ceres CLONE 1406333-F
agagctggagctccccgcggtggcggccgctctagaactagtggatcccccgggctgcaggaattcgcacgagaccattacctagaacatcctaatcgaaaaagcggaaggcccgccgcttccccttcttcattcccgtcccacacacgccgccgccgccggtgcggctcgcttccgtcccccccggtccgcgcgggctgcctgcgggagcagggtggcagggcactccggcaaccacgtgggtggggatgcgacgacaccaccctatgctctgtcctcgcccgcagagtaagattgcagcagcagtgaatttgggagcttgaagcattcatctgagacatggaaaaagtgatctgctgggcatatctccttcaacgcaagcagttctcgaaagaaactcttgattgctgtgtcttagctcgtgggaacactcctctctcctctctcgtgaactacacatagtggttatatggtcctctatgctcaacaacagcaggctgatgcgatattttgctggaggtattatatttcagtctatgccagacatctacatgtagatggtgctcatataaggggggttgaaatatttgctggggtcagcttacatctgttgcgggcctaagtagctatttgccttttgggactatctggaggcagagatggatcagctaggac

SEQ ID NO: 30703 - DNA, 644 bp, Zea mays
  misc_feature: Ceres CLONE 1406340-F
  misc_feature: Translation starting site: 176
  misc_feature: SWISSPROT Homolog: EC 1.2.1.3 Aldehyde dehydrogenase (NAD(+))
  misc_feature (538)..(538): n is a, c, t, g, unknown, or other
  misc_feature (547)..(547): n is a, c, t, g, unknown, or other
agagctggagctccccgcggtggcggccgctctagaactagtggatcccccgggctgcaggaattcgcacgagaccattacctagaacatcctaatcgaaaaactgcgcctgcggaggatcggaggaaccagtagcggaggcttcgattttcggctggcgcaataaatttcccgcatggctcggagggccgcgtcctcgctcgtctcccgctgcctcctggcgagggcccctgccggcgcgccgcccgctgccccctctgcgctgcgcaggacagtgcctgcagatgggatgcacaggctgttgccaggtgtccttcagaggttcagcactgcagcagcagtagaggagcccatcacgccgtcagtccatgtgaactacacaaagctcctcattaatggcaactttgttgattccgcatccggcaagaccttcccaactctggaccctcgtacaggggaggtgattgctcatgtggctggaggtgacgcagaggacattaccgtgcagtagctgcgcctcgcaaggcttttgatgaangggcatggncgaagatgactggctatgaaaggtcccgtatcctactggcggttgctgatttgaaaaaaagcacatggcgagcttgctgcctttgaaacttggaaaa

SEQ ID NO: 30704 - DNA, 685 bp, Zea mays
  misc_feature: Ceres CLONE 1406342-F
  misc_feature: Encodes the peptide sequence at SEQ ID NO. 30705
  misc_feature (652)..(652): n is a, c, t, g, unknown, or other
  misc_feature (685)..(685): n is a, c, t, g, unknown, or other
cccaagagctggagctccccgcggtggcggccgctctagaactagtggatcccccgggctgcaggaattcgcacgagaccattacctagaacatcctaatcgaaaaattttttcatttcttccccccttctcgtcacgtccaaaggggggaaaacttctttctctctcttttttttccctcccccgcccgaatctgatgcttaaaccctcgccgggaggaggattccaatgccgacgcaccagcccgcgcccgccacctacagccgcgcccggatctccgccatggccgccgcgccgcaccaggcccagggccccgcagatagtgtgattccgctgcagtctgaacccgcacttgataataacccctccaagagtgcaaacggcagggaccagattctttctggtacggagaatgtgactacaggcaatgcacgcggcggcagctccttgaaatcgcaaaaaggcccgccagagaaggctagctctgttggaaaacctggagaacaaccttttccctaccagcaaaatgtgtatgcaccacagccacaaccactctatcctggaggctacatgaacccttcaggacaatgggaggaatatccccattatgtgagtatggaggggctccattccgtatctcccggaatctacnatgacaaccaatccctcatgctatctcctggan

SEQ ID NO: 30705 - protein, 134 aa, Zea mays
  misc_feature: Ceres CLONE 1406342-F
  misc_feature (124)..(124): Xaa is any aa, unknown, or other
MAAAPHQAQGPADSVIPLQSEPALDNNPSKSANGRDQILSGTENVTTGNARGGSSLKSQKGPPEKASSVGKPGEQPFPYQQNVYAPQPQPLYPGGYMNPSGQWEEYPHYVSMEGLHSVSPGIYXDNQSLMLSPG

SEQ ID NO: 30706 - DNA, 677 bp, Zea mays
  misc_feature: Ceres CLONE 1406346-F
  misc_feature: Translation starting site: 264
  misc_feature: SWISSPROT Homolog: EC 5.1.3.2 UDP-glucose 4-epimerase
  misc_feature: SWISSPROT Homolog: EC 4.2.1.46 dTDP-glucose 4,6-dehydratase
agagctggagctccccgcggtggcggccgctctagaactagtggatcccccgggctgcaggaattcgcacgagaccattacctagaacatcctaatcgaaaagcgaaacagaagcacggcaatctcgatctcgttcgttcccctgagcggcagtcagtgcgagcgagcgcgcacacagacaactcatcctctcccctctctctctcacacacacacatccatcatcccatccctgtgacgggcgatccgagggcctaccgacgatggtgtccgccgtgctccggaccatcctcgtgacgggcggcgccgggtacatcggcagccacacggtgctgcagctgctgcagcagggcttccgcgtcgtcgtcgtcgacgggggcgaggacgcctccgaggccgccctcgcccgcgtcgccgagctcgccgggcacgacggcgccaacctcgtcttccacaaggttgaccttcgcgacagggcacgcgttggtggacatcttctcgtcgcacaggttcgagggtgtcattcactttgctgggctcaaggctgttggggagagcgtgcacaagcccctactttactacgacaacaacctggtcggcaccatcaccctcctggaggtgatggctgcgaacggctgcaagaagctggggttctcgtcatctgcaactgtctatgg

SEQ ID NO: 30707 - DNA, 627 bp, Zea mays
  misc_feature: Ceres CLONE 1406349-F
  misc_feature (155)..(155): n is a, c, t, g, unknown, or other
  misc_feature (163)..(163): n is a, c, t, g, unknown, or other
  misc_feature (189)..(189): n is a, c, t, g, unknown, or other
  misc_feature (192)..(192): n is a, c, t, g, unknown, or other
  misc_feature (195)..(195): n is a, c, t, g, unknown, or other
aaagctggagctccccgcggtggcggccgctctagaactagtggatcccccgggctgcaggaattcgcacgagaccattacctagaacatcctaatcgaaagagcctcgcaggagggagaggggggagagcggaggaaaaacacctttctttccngttcagancagctcccagctttgaccggcgccgncgncgncgctgtgtgtgtgtgctcccttaggagtagtccctgtcgcgtccccgggatcgagctcccctcgtggacggggaaacggcgggtcggggtgctcactcccccccggaatgataaggtccccctcccaagaaaaggaaacatggaggggcctggctttctgggtggggacaaccaaagaaaggggccgccctaaagcgggcctcctcggggccgggggccaaaaaaacggggggggggggccgccccgggaaaaaatcccccccttgaagggggtccacacggagggcccgccaattagggggggggaaaacccccccttttctggggggccggtaaaaagggggggggtccccttttttggaggaagaaggggccccccccatttttccggggtttttttggggtgggggggggggggttttttttgggggg

SEQ ID NO: 30708 - DNA, 689 bp, Zea mays
  misc_feature: Ceres CLONE 1406350-F
  misc_feature: Encodes the peptide sequence at SEQ ID NO. 30709
  misc_feature (314)..(314): n is a, c, t, g, unknown, or other
  misc_feature (385)..(385): n is a, c, t, g, unknown, or other
  misc_feature (430)..(430): n is a, c, t, g, unknown, or other
  misc_feature (461)..(461): n is a, c, t, g, unknown, or other
  misc_feature (689)..(689): n is a, c, t, g, unknown, or other
aaagctggagctccccgcggtggcggccgctctagaactagtggatcccccgggctgcaggaattcgcacgagaccattacctagaacatcctaatcgaaaaattccacgctgcctcggccggcacctacctcccccacttcgccgccggcgggtggagtcgggccggagcagccgctagctcgcctctgttaccccaaaaaagacaaaaaaaataaagagagagtaccaagcaagccgccggcagctcgggcagccatggggcacggcgtcagctgcgctcgcacgggcgacgagacactacttcgcggcggnggcaggtcggggacctcgacgccctggacgcgctcctcgccgccgacccctccctcgcccgccgcgccacngctctacgaccgtctctccgcgctgcacatcaccgccgccatggnccacctcccgaggtgatgtccatgatcttgnaatcacggggtaccggccggacgccgtgaaccggcacaagcaagacgccgctgatgctcgcggcgatgcacggcaagatcgactgcgcgcggaagctcctgcaggccggcgcaatatatcctgatgttcgactccctgcacgggcggacctgcctgcaccacgcgtcctacttcggccactcgaactgcctgcggccatcctcgcgggcgggggggaccaggccgggn

SEQ ID NO: 30709 - protein, 62 aa, Zea mays
  misc_feature: Ceres CLONE 1406350-F
  misc_feature (43)..(43): Xaa is any aa, unknown, or other
  misc_feature (58)..(58): Xaa is any aa, unknown, or other
MGHGVSCARTGDETLLRGGGRSGTSTPWTRSSPPTPPSPAAPXLYDRLSALHITAAMXHLPR

SEQ ID NO: 30710 - DNA, 683 bp, Zea mays
  misc_feature: Ceres CLONE 1406352-F
  misc_feature: Encodes the peptide sequence at SEQ ID NO. 30711
  misc_feature (670)..(670): n is a, c, t, g, unknown, or other
aaagctggagctccccgcggtggcggccgctctagaactagtggatcccccgggctgcaggaattcgcacgagaccattacctagaacatcctaatcgaaaacctcactctgtctcttcctcagtcccggcatcagcgctcaaaccctaacacgccacgcgatcccgatgcgcaggggtctgggcagcgaggcatcgttgcgccggcggcgcgggccggcgcggctttgggtggcagtggcggcgctggtggtcggcaccgtgtgcctcttctcctcctcttcggtcggcctgttgggcgcctcttacagggtccaggatgttgatgtaaataagttgtggagaactgcagattcaaatggttggagagcatcttctgcaccacgcacctactggcctcccccaccaactgaatctgagagcaatggctacttgcgcgtccggtgcaatggtggcttgaaccaacaacgtagtgcaatatgtaatgctgttgttgctgcacggatcatgaatgctacactggtgctgccagaattagacacaaattcattctggcatgatgaaagtggctttgtaggtatttatgatgttccccacttcatcaagacactgaaatatgacgtccgaattgttatgagcattcctgaaatcactacaaatggaaagaccangaagctcaaaggc

SEQ ID NO: 30711 - protein, 172 aa, Zea mays
  misc_feature: Ceres CLONE 1406352-F
  misc_feature (168)..(168): Xaa is any aa, unknown, or other
MRRGLGSEASLRRRRGPARLWVAVAALVVGTVCLFSSSSVGLLGASYRVQDVDVNKLWRTADSNGWRASSAPRTYWPPPPTESESNGYLRVRCNGGLNQQRSAICNAVVAARIMNATLVLPELDTNSFWHDESGFVGIYDVPHFIKTLKYDVRIVMSIPEITTNGKTXKLKG

SEQ ID NO: 30712 - DNA, 662 bp, Zea mays
  misc_feature: Ceres CLONE 1406364-R
tcgaggtcgacggtatcgataagcttttttttttttttttttgaagattttaggaggagcagcagctctggtacgcacggtacattaacatcacacagcaaacttgaaatgcagacattcagaaccactcatcagagtcttttagaacaccaaacggacaggtagcagtagcagcagcagcagcaacgaagatgtcattcagacatggtcgctagccgtacatgcatgctatatattattcgtccattcaggaaccgaggacgcgaagacacagacagataacagctagagcggaggaggacgaattaggcggcggcggcagcagctaggtaaggttccttggattcatctagctcgtctctgttcacgttcaccaggggaggatcttccagcgctggttgtcgcccttggcccactcccagaggacgacggtggtggcgtcgtggacgccgccgtggaccttgtcgccgtggaaggcgtccatgttgaggtagatgttgttcaccatgcgcacgcagcggaagccgtgaccgaagtcgcgggtctccgtccacggaccgactcggcaaagtactcggggttgtaaggcacaaggcgtaccggggggcctctgtcccaccgagtgcttggatggcttcccccgggaactttgatcaccagag

SEQ ID NO: 30713 - DNA, 695 bp, Zea mays
  misc_feature: Ceres CLONE 1406364-F
  misc_feature (657)..(657): n is a, c, t, g, unknown, or other
  misc_feature (658)..(658): n is a, c, t, g, unknown, or other
aaagctggagctccccgcggtggcggccgctctagaactagtggatcccccgggctgcaggaattcgcacgagaccattacctagaacatcctaatcgaaaaatatagaattctttctgccttccgatgcagactatgtcaggggcggacgcgcgctataacacccgatccagtgggcgcggccagtgtcaccactcattattcacatcgaggactcagcttcaggaaagggaaggaatcatgtgcgggcatgatcaacactacggtcacggttggcatcactagggcccgccgtcgaatgagaagacggtgctcaggatcttctgccgcgccaacgaggcgtactgcctcaccgtgcagcacgatgacgacgtcttcgcgaccaacagcccctcgctacgagtgacactgctggtgcaagccacatgaggcacacctacaaagtgaaaggacgcgtagggcccagacgaagattgtggtttattaacagggccaagcgggctttacaataaggagttcgttcgggcaagtccatcccgggaaagtgtagtcctaaaaaccgtttatacgggaaccagggggtgttggtggcagaaaaccccctctttgggccaggggattttctctgggtaccaaaatggtgaaaaaaaaattttnnttatatattttaaacattttcccgcggaaaaagaaat

SEQ ID NO: 30714 - DNA, 688 bp, Zea mays
  misc_feature: Ceres CLONE 1406365-F
  misc_feature (549)..(549): n is a, c, t, g, unknown, or other
  misc_feature (557)..(557): n is a, c, t, g, unknown, or other
  misc_feature (652)..(652): n is a, c, t, g, unknown, or other
aaagctggagctccccgcggtggcggccgctctagaactagtggatcccccgggctgcaggaattcgcacgagaccattacctagaacatcctaatcaaaaatcgagctgagctgagcatcatggggtagtgtgtgtgtgaggcgatagagaagctagtgctcataaccaaccaccactcagtcctcctcctctaccctttcccttccgccgcgttcctacttggtcctagagggagagagatctcgaactccaagggcgcatgctccggttgctagctacgatgccgtgtgcgtagctgcggcagcccttgatcgatcaatcgatcgcttgtgcggaatgagccggatcgagtggagtcagctagctagatactccgtggtcgtcgtcgtcgttggacgtacgccagaagagggagctagagaagaataccgtacagctgcttccaacatggcagctgcctcgcctgcccacctggtcggaactcggcgacgggcagatgcagatgcagccgcagcagcagcaggcgcgcctccctcctcttgtgaancacccggncgcgccgccgcccaaagaagaagcggaaccaacccggtacccaaccttggacgggggaaggtgatcgcgctttcccccaagacgctgaggcgacnaaacccggttcggggggggaggtgggcaaacagggt

SEQ ID NO: 30715 - DNA, 662 bp, Zea mays
  misc_feature: Ceres CLONE 1406367-F
  misc_feature: Encodes the peptide sequence at SEQ ID NO. 30716
  misc_feature (436)..(436): n is a, c, t, g, unknown, or other
aaagctggagctccccgcggtggcggccgctctataactagtggatcccccgggctgcaggaattcgcacgagaccattacctagaacatcctaatcaaaaacatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccggatgcacgctcatgttccgcgggccgtggctcgcccgcgcggacttcctgctgacgtgcgacccggcggncgtccagcactgcctggcgtccaaccacgggggctacgacaggtgccgagactttgcggagatgttcgacctcctgagcgacgggctgctgggtgcggacgccgcgtcgtgagcgcgtcagcgggacgtcgccgccaccgtcttcgagacccccgggttccggtccttcgtactgtgcaccatggcgcgccagacggagcggctgctcgtgccgttactggactgg

SEQ ID NO: 30716 - protein, 129 aa, Zea mays
  misc_feature: Ceres CLONE 1406367-F
  misc_feature (93)..(93): Xaa is any aa, unknown, or other
MGALRSLAISYPEFLVAGLCFVSLSALRHAMRERRQRAPLSWPVVGMLPFVLANLGRLYDAITDALHGSGCTLMFRGPWLARADFLLTCDPAXVQHCLASNHGGYDRCRDFAEMFDLLSDGLLGADAAS

SEQ ID NO: 30717 - DNA, 808 bp, Zea mays
  misc_feature: Ceres CLONE 1406370-F
  misc_feature (12)..(12): n is a, c, t, g, unknown, or other
  misc_feature (34)..(34): n is a, c, t, g, unknown, or other
  misc_feature (36)..(36): n is a, c, t, g, unknown, or other
  misc_feature (42)..(42): n is a, c, t, g, unknown, or other
tttaaaaacccnaacccctcaaacaacaaataantngggggnccccgggggtggggcaaagtgggactccccgcggtggcggccgctctagaatagtggatcccccgggctgcaggaatcgcacgagaccattacctagaactcctaatcgaaaagtcctcttggctttctctttcccgctctcctcctcgcttgccccccgccagctcgatctccagggagtggactagtgcagggagggagggaagaaaggagtggtgcagctgtgagtgaaaccgcctctcgtttccttgattgattggacccgagccggaatgtgatgcgagagaagtgcgcagattaccacccgttcccaggaacacaactgaccaatccctctgaaggacaaacgaccccctttcagttaggccatcttctgaaaagaacataacagggctgtgtgcgtaagaataagccatgggcaagaacttcaaaggatcggtaagggctgggatgggcccaacccacccaagggggacaggaaaatggggggcctatttggcccggcccacccccggaaaagggaattcctggcgcggctgccccaatccccagggggaccgcgacttttcaaaaaagaacggggcaaaaagaagcccccaaaaccccggcagggggtcagcgccccaaaaaggggggcgagaccacccccccgggccgcactttgcgaaaggggcggccctccggggatccaaaagggggtttcccaaaccggtttgtctttccaaaaaagaaaaaaaaaaaacaaccccccactccccaaaaatag

SEQ ID NO: 30718 - DNA, 658 bp, Zea mays
  misc_feature: Ceres CLONE 1406373-F
  misc_feature: Encodes the peptide sequence at SEQ ID NO. 30719
  misc_feature (235)..(235): n is a, c, t, g, unknown, or other
agagctggagctccccgcggtggcggccgctctagaactagtggatcccccgggctgcaggaattcgcacgagaccattacctagaacatcctaatgaaaactgctctagcgaaggcacagccgccgctgtttcttcatcttcctcgcagcgccggcgctccatcttactctccctcccttactagcgcttgacacgcaggtgacggcggcagcgacggcgctcaggctcgggcntcttagtgacggcatcagcggcttcccctcccgcctcttgccagtcccatcgcgccctcgcctcgggtcctctgcacaccgtccagtgaccttgcgtgatggactggataaagttttgcagcgattttactgcaagtgatgggaaacagcatgcattgcttgataatcttaatcaggaattgtcccagaagtctgtactatctgggtgatggttttaaactgtcagctgctgataatgatgtgtttgcaactgttcatccttttgtgatccgtgttagggacagcgagttgcagaaatatccacatggactggcggtggatggactacattcagaacactggttggtgctggatacactttgcaaaagatagatgtgggccaggctgacttggatccaccttcctctcccaggaagctggtaa

SEQ ID NO: 30719 - protein, 36 aa, Zea mays
  misc_feature: Ceres CLONE 1406373-F
MDWIKFCSDFTASDGKQHALLDNLNQELSQKSVLSG

SEQ ID NO: 30720 - DNA, 617 bp, Zea mays
  misc_feature: Ceres CLONE 1406416-F
  misc_feature: Encodes the peptide sequence at SEQ ID NO. 30721
  misc_feature (359)..(359): n is a, c, t, g, unknown, or other
cactactgtagctccccgtcggtggcggccgctctagtactagtggatcccccgggctgcaggaattcgcacgagaccattacctagaacatcctaatcgaaaactgcctgagcgaagctccctccatatttgcattcttcaccctcgcttcacgtcaccaccattgccatccaagaacaaattaagcggacacaggaaacaaagagaggaatggggcttcgcggcggagctcttgccctgcttctgctcctgttcgtccacggaggccagcgagcagcagaggccggcggggacgcgttcgtgagggtccagggcacccgcttcgtgcagggcggcaagccgttcttcgccaacgggntcaacgcctactggctcatgacattcgggggcgaccccgcgcggaggggaaagccacctcggcgctcagccaggccgccggggccgggctcttcggggccaggaactgtggcgttcaccgaccggcggcggcgggcggaaaccccgctgaagatactctcccgggcgggtaaacggaaaaaaccttccggggggtgggattttcggggttggtggagggtaggaaaggagggggattaagaagggttttggaggcctg

SEQ ID NO: 30721 - protein, 128 aa, Zea mays
  misc_feature: Ceres CLONE 1406416-F
  misc_feature: SWISSPROT Homolog: EC 3.2.1.78 Mannan endo-1,4-beta-mannosidase
  misc_feature (50)..(50): Xaa is any aa, unknown, or other
MGLRGGALALLLLLFVHGGQRAAEAGGDAFVRVQGTRFVQGGKPFFANGXNAYWLMTFGGDPARRGKPPRRSARPPGPGSSGPGTVAFTDRRRRAETPLKILSRAGKRKKPSGGWDFRGWWRVGKEGD

SEQ ID NO: 30722 - DNA, 647 bp, Zea mays
  misc_feature: Ceres CLONE 1406446-F
  misc_feature: Encodes the peptide sequence at SEQ ID NO. 30723
aagctggagctccccgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagaggaggccacgaacacgctctccatcatcgacagcggcatcggcatgaccaagtccgaccttgtcaacaacctcggtaccatcgccaggtccgggaccaaggagttcatggaatcccttgctgccggcgctgatgtgtccatgattggccagttccggcgtcggtttctactctgcctacctcgtcgcggaatagaggtgtcgtgaccaccaagcacaacgatgacgagcagtaccgtgtgggagtccaaaggcgggcgggttcgtt

SEQ ID NO: 30723 - protein, 138 aa, Zea mays
  misc_feature: Ceres CLONE 1406446-F
MASETETFAFQAEINQLLSLIINTFYSNKEIFLRELISNSSDALDKIRFESLTDKSKLDAQPELFIHLVPEEATNTLSIIDSGIGMTKSDLVNNLGTIARSGTKEFMESLAAGADVSMIGQFRRRFLLCLPRRGIEVS

SEQ ID NO: 30724 - DNA, 651 bp, Zea mays
  misc_feature: Ceres CLONE 1406450-F
  misc_feature: Encodes the peptide sequence at SEQ ID NO. 30725
aaagtggagctcaccgcggtggcggccgctctatactagtggatcccccgggctgcaggaattcgcacgagaccattacctagaacatcctaatcgaaaaatacttttgctccttctatcttaattaaatcctatcgcagtgtgtctaccagcgaatatgtgaactatgccaatcttgttggattctcaacgatctcctatggaaaaaggattactaaactagcatgtttctcggagctgataccagatgctggtgctcgcatcaggatcatatacagtcgaaggacgatccccacaccagcggatggattccgccgtcgaggccatctcgaccgtctctactaccggctcacgtgcacctgaatcagttgctgctcctgtacatgatcctggcatcacagagcgttactgtccacttcaactacacgaagccgcacctgcgtgaggcccccacgcgcctgcacggctggccgcccaaccccacgtctcagtgattccgcgcgctggacgtgcccgcggatgatgctccctccccggactcgtcctccccgatacctgcgcatatgcaggccctggaacatgacttctacgccggagcgcgggcctcactacccacgctcctggggaagctggtcgcatcgcaccgaagaa

SEQ ID NO: 30725 - protein, 89 aa, Zea mays
  misc_feature: Ceres CLONE 1406450-F
  misc_feature: SWISSPROT Homolog: EC 2.4.1.215 Cis-zeatin O-beta-D-glucosyltransferase
MFLGADTRCWCSHQDHIQSKDDPHTSGWIPPSRPSRPSLLPAHVHLNQLLLLYMILASQSVTVHFNYTKPHLREAPTRLHGWPPNPTSQ

SEQ ID NO: 30726 - DNA, 956 bp, Zea mays
  misc_feature: Ceres CLONE 1406450-R
cgaattgggtaccgggccccccctcgaggtcgacggtatcgataagcttttttttttttttttttggcctaaaaccttcggatttcttttcaactaaaatagcccagggaaacaaatctttaatgcgggcagcagcccccccacggggaaaagtccccgcaggggccatcgcaacggaatcacctcgtcacgtacgcaacaagttcctccgggtcctgcctaaacaacccgccctcggccacggccccccaaagggcctccccaagcgccccggcccgccgccggatttaagccctttcctccaaggccataaccctgtcaatagcgtcccgaatgtcggccgcgggggtcacctcatggcccccctcccacgggcgacacaggaccccgggcgcgaaggtactttgcacacaagcttgggcgtcccagggcttggtccctttccaggggcccaacccgggaagggccttccccgggggctgaggcccctccaggggggaatttcccacccccaatgggctcaaaaaacccccccgggggggcccctttggcccaaggaattttccggttgggggggccccaccccggggaaacacccaacccccggggcctttttggggggccaaaattttggaaaacccccggggggggttgggaaagggcccccccgcccaaaaaaaaccccccccttttccccccccgcaaatacccccccgggggggtggggtgtcccccgaaggccccccacaaaaaaagagggccccccctttttttcccaaaagggggggggggcaaatttttgacaccttttcctccggggggggggaaacaaaactttttttctcaaaaaaaaaccctttaagagccccccccaaaggggggggggggtgcctttttaaccacccccccgggagtcttttgggggagaatccctccttttccccgggggggaggga

SEQ ID NO: 30727 - DNA, 645 bp, Zea mays
  misc_feature: Ceres CLONE 1406454-F
  misc_feature: Encodes the peptide sequence at SEQ ID NO. 30728
tggagctccccgcggtggcggccgctctagaactagtggatcccccgggctgcaggaattcgcacgagaccattacctagaacatcctaatcgaaaaaccagtctcgtcgtgtccgttcgcgatcgggcaaacctgcaaccctttcctcttcgtccccccgctatctcgttgccccaagccggagtacggagtacggcagtcgcacccccgtcgtcccgttccttgctcgccccaacttcgccgccgcatccccctcggctgctcgctcctcgtctgcccctagtgatgtctggtggtaacgcgtggtcgccgctcccttcgcacggatttgacgacgactcctgcttgctcttttttattttgctcgtgtcgtcggatcgtggcttgattgatctccgcatcccgcagatccgactccggcggcatggggagccgcgcaggcgagcctgtggcgaggaccaacagcggcggcggcagcagcagcaaggattcgggcagcttcgagtgcaacatctgtctggacctggcgcaggatcccgtggtcaccctctgcggccacctcttctgctggccatgcctctacgagtggctccacgtgcacgcgcactcccaggagtgtcccgtctgcaaggccgtcgtcgagg

SEQ ID NO: 30728 - protein, 73 aa, Zea mays
  misc_feature: Ceres CLONE 1406454-F
  misc_feature (28)..(68): Pfam Name: zf-C3HC4 Pfam Description: Zinc finger, C3HC4 type (RING finger)
MGSRAGEPVARTNSGGGSSSKDSGSFECNICLDLAQDPVVTLCGHLFCWPCLYEWLHVHAHSQECPVCKAVVE

SEQ ID NO: 30729 - DNA, 640 bp, Zea mays
  misc_feature: Ceres CLONE 1406473-F
  misc_feature: Encodes the peptide sequence at SEQ ID NO. 30730
aagctggagctccccgcggtggcggccgctctagaactagtggatcccccgggctgcaggaattcgcacgagaccattacctagaacatcctaatcgaaaaaccaaaatgtaagaaaacgcacgccccggcgctggccgctagtcaccccaaagctccgcctccgcaccttctctcactcgcccagccgcggatatggcggccaccacatccacggcggcggcggaagtatccttctccctcccctcaccaccgcactgccgcggggcccggcgccgccgcgcgccttccctcctccgtgccgcctccaccgccgcgcccccctcccccgacctctccatccagctctcgccccgcgagtccccgcccgcgactaccaacggcgccgccaccgtgcttggaccccccgtgaccgcctcctttgcccgtgaccgcgccgaagacctgcatgacgaggcccgcgcgatggtccgcgacgctgatgccacaggctacaggcccgagctcctcggcgtctgctacgggtcccgcccctacaagagacgctccgggcagcagagagatgtccatactgctatcattcgcagtgaacgtcctactgcacaactgaagagatgaggcgtcctcgcaaatgacgcgcg

SEQ ID NO: 30730 - protein, 50 aa, Zea mays
  misc_feature: Ceres CLONE 1406473-F
MVRDADATGYRPELLGVCYGSRPYKRRSGQQRDVHTAIIRSERPTAQLKR

SEQ ID NO: 30731 - DNA, 657 bp, Zea mays
  misc_feature: Ceres CLONE 1406477-F
  misc_feature: Encodes the peptide sequence at SEQ ID NO. 30732
aagctggagctccccgcggtggcggccgctctagaactagtggatcccccgggctgcaggaattcgcacgagaccattacctagaacatcctaatcgaaaactcgaaccatagatgatttggcagagatgtcttctgccggcatcagcggatgcgtgcctacaactgaacaccatatacaaacgaatcatggacctgtatctgttgcagtgtatggtgaccatgacaagcctgcccttgttacttaccccgatattgctttaaactatatgtcctgcttccaaggactattgttctgtcccgaagccgcttcgctgctgcttcataatttttgcatttaccatattagccccccaggacatgagttaggagctgctccaatttcaccaaatgctcctataccgtctgttgacgatttggcagatcaggttgcggatgtcctcgatttctttggattaggctctgttatgtgcttcggtgtcactgcaggtgcctacattctaactctgttcgcggcaaagtatagggagcgggtactaggtcttatccttgtttcacctctgtgtaaaggccccacttggactgagtggttatacagtaaggtaacatccaatctgctgtattactatggcatgtgtgggttagtgaaggagtgcct

SEQ ID NO: 30732 - protein, 176 aa, Zea mays
  misc_feature: Ceres CLONE 1406477-F
  misc_feature (14)..(176): Pfam Name: Ndr Pfam Description: Ndr family
MSSAGISGCVPTTEHHIQTNHGPVSVAVYGDHDKPALVTYPDIALNYMSCFQGLLFCPEAASLLLHNFCIYHISPPGHELGAAPISPNAPIPSVDDLADQVADVLDFFGLGSVMCFGVTAGAYILTLFAAKYRERVLGLILVSPLCKGPTWTEWLYSKVTSNLLYYYGMCGLVKEC

SEQ ID NO: 30733 - DNA, 819 bp, Zea mays
  misc_feature: Ceres CLONE 1406490-F
  misc_feature: Encodes the peptide sequence at SEQ ID NO. 30734
  misc_feature (36)..(36): n is a, c, t, g, unknown, or other
  misc_feature (70)..(70): n is a, c, t, g, unknown, or other
  misc_feature (73)..(73): n is a, c, t, g, unknown, or other
  misc_feature (77)..(77): n is a, c, t, g, unknown, or other
tcccgggccgttggcgccccggcacccgtagcgcgnaccttctcaacctccccgattaatagaaaaactnggngctntttcaaagctggcactccccgcggtggcggccgctctataactagtggatcccccgggctgcaggaattcgcacgagaccattacctagaacatcctaatcgaaaactactgtccggggaacccagcccagcccccgagccccacaccacacacagggttgcccacccacgccacgcacgcgcagccgcggcggaagccaccccacccgggggtgggctccgatgggttgctgcggctcctcgcagcgggcggggacgcacccggagaataagccgccgggggtgctccccccgcaccgtccctcctactcgctcaaccagcaccaggcgccgccgccgccgccctccctccgcgggatcgcggccggcgcccgcccgggtggccgcccgctccagggaggttctcgctccccgaaggttgcgtcgccacccacgggcccggctttcccgggcgggggaaacatccggggtatggagaaagcggccgaaccaacgtgcacccaatttttcgtaggcacagggggtcccgcctttgtaggacccggcccggttcgccccgcatccgggcgtccaaaaacagttcaaccaacaacatgggccgggcgcccccgattccccaacccagtctccccctgtaaggaccgccccaagggtgggtgcccggggaacagactggggacccacccgcccccgccctggggccaaacccctcattcggggctcaccggcttggagaagaggg

SEQ ID NO: 30734 - protein, 196 aa, Zea mays
  misc_feature: Ceres CLONE 1406490-F
  misc_feature (24)..(24): Xaa is any aa, unknown, or other
  misc_feature (25)..(25): Xaa is any aa, unknown, or other
  misc_feature (26)..(26): Xaa is any aa, unknown, or other
SRAVGAPAPVARTFSTSPINRKTXXXFKAGTPRGGGRSITSGSPGLQEFARDHYLEHPNRKLLSGEPSPAPEPHTTHRVAHPRHARAAAAEATPPGGGLRWVAAAPRSGRGRTRRISRRGCSPRTVPPTRSTSTRRRRRRPPSAGSRPAPARVAARSREVLAPRRLRRHPRARLSRAGETSGVWRKRPNQRAPNFS

SEQ ID NO: 30735 - DNA, 648 bp, Zea mays
  misc_feature: Ceres CLONE 1406495-F
  misc_feature: Encodes the peptide sequence at SEQ ID NO. 30736
aagctggagctccccgcggtggcggccgctctagaactagtggatcccccgggctgcaggaattcgcacgagaccattacctagaacatcctaatcgaaaacttaaagcacgcgcgcgccctgtgctccccctcagtcctcgctagtcctttctccatcacaaacgctattcttttttccctaaagctcggagaccgccggaagcgagcgatggcgtgcaagacgaagagcctgctgttggcgctcagcgtggcggcgctgctcgcggcgcagtcggactcccacggcctgggggacttcacgagcgggagcggcgaggcgacgacgacgccggagatgcagaccttcttcaagccccaggccgctgcggcgctcccggaggccctcgacgcctccatgcccgccaagccggaggggggcggcggcggcgctcccggccacgacaagggccggcacggcgccgtcagccacgccgcgcaagcgcgtgtccgtggccgccggcgtggcctgcgacgtggtggacggggacgagggcggaatctgtgatgccgcggcgcacgtgatgcaccatgcgtggggcgagaagtaagtgcaacatcgctgccccccgtgagtccagtatcgccgtgactctctagaagaacaaca

SEQ ID NO: 30736 - protein, 111 aa, Zea mays
  misc_feature: Ceres CLONE 1406495-F
MACKTKSLLLALSVAALLAAQSDSHGLGDFTSGSGEATTTPEMQTFFKPQAAAALPEALDASMPAKPEGGGGGAPGHDKGRHGAVSHAAQARVRGRRRGLRRGGRGRGRNL

SEQ ID NO: 30737 - DNA, 640 bp, Zea mays
  misc_feature: Ceres CLONE 1406496-F
  misc_feature (610)..(610): n is a, c, t, g, unknown, or other
aaagctggagctccccgcggtggcggccgctctagtactagtggatcccccgggctgcaggaattcgcacgagaccattacctagaacatcctaatcgaaaagcaagaggtaacactcgcgtctcattctcccgttcttgaggggcaatcgcgaatcgcgctcctcgcggtagcggtcgattacccggctccgcccagatccgccgcggctgcgctccagttccctgtcgcgtgcgtagggctcctcgtccctccctctatccccggctgtgtacggactggggatcggggatccctccggaccgggataggattttcgttttgctggcgaggaagggagcttcccccgatagatgtctcacctccgataccctggatttcgtccgtggcgagtggctaccgcttctgctccttttgtgacagctgaatctttgtggttcgaaggcgattgacttgggttcactgacgcggtgacgcccaatgagctcccacgtctccacatcgcggggtcttcatcccccaggcaagcttgggacgttggactcacccggtgcgtggcagccgccagcacctatggctcagcccgaagcaggccgcggtgatgaccagnaggtcaggctgttgtcggttgcttggaatc

SEQ ID NO: 30738 - DNA, 647 bp, Zea mays
  misc_feature: Ceres CLONE 1406509-F
  misc_feature: Encodes the peptide sequence at SEQ ID NO. 30739
  misc_feature (361)..(361): n is a, c, t, g, unknown, or other
aagctggagctccccgcggtggcggccgctctagaactagtggatcccccgggctgcaggaattcgcacgagaccattacctagaacatcctaatcgaaaaatttttcccgttcaccgtcgcttgattttcgaatcgaatcgctcattcattcctcaccgcctccatccccgctccggcctcccctccggaagtcccaaaccctaggaaccagctgaactgccgaagctttcagaaccccaggcggcaagaacaattgcggcgagatgattctccggactccaccacagcggaagcgccgcgcaggctccggcgccggcgatgacgccgatctcggctgtcaaaacccgggggggcgggcncgagcgccaaccgccccagggcgggggtccgatcgccgcctggccctctacgaccgccccaccgccctcgcgctggccgacgccccgggggagccgtccgacaacatggtctggacgtaccactgccgccagatggtcaaatccgagttcatggtgggacttgacacggaagagaaacaagcccaggaatataaaacaaaacttgttggcttgggagacccatttatctaaaagggaggtcgaaaaaatgccacctcctggacaaacttacctatgtggcaacaga

SEQ ID NO: 30739 - protein, 108 aa, Zea mays
  misc_feature: Ceres CLONE 1406509-F
MILRTPPQRKRRAGSGAGDDADLGCQNPGGRARAPTAPGRGSDRRLALYDRPTALALADAPGEPSDNMVWTYHCRQMVKSEFMVGLDTEEKQAQEYKTKLVGLGDPFI

SEQ ID NO: 30740 - DNA, 644 bp, Zea mays
  misc_feature: Ceres CLONE 1406515-F
  misc_feature: Translation starting site: 309
  misc_feature: SWISSPROT Homolog: EC 5.3.1.1 Triose-phosphate isomerase
  misc_feature (590)..(590): n is a, c, t, g, unknown, or other
aagctggagctccccgcggtggcggccgctctagaactagtggatcccccgggctgcaggaattcgcacgagaccattacctagaacatcctaatcgaaaaccaagcagtgaaatccaatatagaagagcccctctccctctctctctctctcttcgccgaccgaagctccgcaccccgatctaatccacacctcagcgagatggaccgcaaggtcctcaccagtggcgactgaaaatgcaatggaaccacagatcacgtccagaagataggcaaaaccctgaatgaaggacaggcgtcccccttcaaatggtggggaggtcggtgccacccctcctgatggcgtccttcctgtgggcaagagccatgtgcgccaagaggtccatgttgcgggtcaaaactgctggctcaagaatggaggtgcttacaccggtgaatgcagagatggagatgctcgtcaaccttggagttcccggggtcatgcatggacactctgaaaggagagctctgcagtgagaatcaaatgaatttgttggatacaaagctgcgtatgcccagtcgcagggactatagggcattgcatgagttgangatacacttgaccagagggagaatggctctaccatgcaggttgttgctgcacac

SEQ ID NO: 30741 - DNA, 663 bp, Zea mays
  misc_feature: Ceres CLONE 1406542-F
  misc_feature: Encodes the peptide sequence at SEQ ID NO. 30742
  misc_feature (269)..(269): n is a, c, t, g, unknown, or other
  misc_feature (280)..(280): n is a, c, t, g, unknown, or other
  misc_feature (326)..(326): n is a, c, t, g, unknown, or other
  misc_feature (338)..(338): n is a, c, t, g, unknown, or other
tggagctccccgcggtggcggccgctctataactagtggatcccccgggctgcaggaattcgcacgagaccattacctagaacatcctaatcgaaaaaatcttccaagtcaccaacgcaaattgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtngccgggtgggncattccgcacaacccgctcccgagctgccgctggtacgtgaccagnccggactgcggnatcggggccgcgctccccgtggcggaactgaaaaggagatgctgcccggaagctggcgaaaatccccggggtactggcggtgcacggggcttaacatcctcatggacggggggattccgccgggcccgaacggcaaattgaaggcccccctaaaaaaccttgccggtttccccggggaagggcaaaaggggattcccccccccccctcccccgggggccggggggaaacctggcccccctaaggggggtcccccaaatgcccctgaatttttctcgggggggaaaagtggccccccccaaaaaatgtggaaaaaaaaaattgggt

SEQ ID NO: 30742 - protein, 104 aa, Zea mays
  misc_feature: Ceres CLONE 1406542-F
  misc_feature (39)..(39): Xaa is any aa, unknown, or other
  misc_feature (54)..(54): Xaa is any aa, unknown, or other
MASSSSSSHRRLILAAAVLLSVLAAASASAGTSCVAGWXIPHNPLPSCRWYVTXPDCGIGAALPVAELKRRCCPEAGENPRGTGGARGLTSSWTGGFRRARTAN

SEQ ID NO: 30743 - DNA, 621 bp, Zea mays
  misc_feature: Ceres CLONE 1406543-F
  misc_feature: Translation starting site: 208
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (380)..(380): n is a, c, t, g, unknown, or other
  misc_feature (381)..(381): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (471)..(471): n is a, c, t, g, unknown, or other
  misc_feature (472)..(472): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (486)..(486): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (504)..(504): n is a, c, t, g, unknown, or other
  misc_feature (509)..(509): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (531)..(531): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (550)..(550): n is a, c, t, g, unknown, or other
  misc_feature (551)..(551): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (565)..(565): n is a, c, t, g, unknown, or other
  misc_feature (570)..(570): n is a, c, t, g, unknown, or other
  misc_feature (577)..(577): n is a, c, t, g, unknown, or other
  misc_feature (578)..(578): n is a, c, t, g, unknown, or other
  misc_feature (580)..(580): n is a, c, t, g, unknown, or other
  misc_feature (584)..(584): n is a, c, t, g, unknown, or other
  misc_feature (585)..(585): n is a, c, t, g, unknown, or other
  misc_feature (587)..(587): n is a, c, t, g, unknown, or other
  misc_feature (588)..(588): n is a, c, t, g, unknown, or other
  misc_feature (605)..(605): n is a, c, t, g, unknown, or other
tggagctccccgcggtggcggccgctctagaactagtggatcccccgggctgcaggaattcgcacgagaccattacctagaacatcctaatcgaaaaacttaggccgtcacaaggagaccctcctcagccgctagtaccagtagtcgtcgcgtttgcagctaggcagatctgagttagccggcggatccgatccgtgcgcgggccaaatgtgtgtgtgnnnnnnnnnnnnnnnnnnnnnnnnnnnnnnnnnnnnnnnnnnnntnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggnngnnnnnnnnnnnnnnnnnnnnnnnnnnnnnnnnnnnnnnnnnnnnnnnnnnnnnnnnnnnnnnnnnngnnnnnnnnnnnnnnnnnnnngnnggggnnnngggggngggnnnnggggggggggnggggngggggggggggggnnnnnnggnggggggnnngggggggggnnggnnnnnggggggnggggnggggggnngngggnngnnggggggggggggggggngggggggggggggggg

SEQ ID NO: 30744 - DNA, 635 bp, Zea mays
  misc_feature: Ceres CLONE 1406552-F
  misc_feature (207)..(207): n is a, c, t, g, unknown, or other
  misc_feature (212)..(212): n is a, c, t, g, unknown, or other
  misc_feature (213)..(213): n is a, c, t, g, unknown, or other
  misc_feature (219)..(219): n is a, c, t, g, unknown, or other
  misc_feature (220)..(220): n is a, c, t, g, unknown, or other
  misc_feature (316)..(316): n is a, c, t, g, unknown, or other
  misc_feature (453)..(453): n is a, c, t, g, unknown, or other
  misc_feature (464)..(464): n is a, c, t, g, unknown, or other
  misc_feature (466)..(466): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (488)..(488): n is a, c, t, g, unknown, or other
  misc_feature (499)..(499): n is a, c, t, g, unknown, or other
  misc_feature (505)..(505): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (537)..(537): n is a, c, t, g, unknown, or other
  misc_feature (591)..(591): n is a, c, t, g, unknown, or other
  misc_feature (592)..(592): n is a, c, t, g, unknown, or other
  misc_feature (595)..(595): n is a, c, t, g, unknown, or other
  misc_feature (601)..(601): n is a, c, t, g, unknown, or other
aagctggagctccccgcggtggcggccgctctagaactagtggatcccccgggctgcaggaattcgcacgagaccattacctagaacatcctaatcgaaaaaatttcactttccttctctcctctcctcctgctgctactaggttcgggccgtccgtccttgctcttgatctgcattatttaattcggaccattcccccgccgtccntcccnngcccgnncctggccgggagaatggggagatgggaggaacgggcacgcccagtaacggggtggggccgcctttgtggaagggggaaaaaggggggggggggggnccccccccccgcctttttttttcccaaaaaaaaggggggggggggggggcgccccctcttttttataaaaaaaaaaaaaaaggggggggggggggagaaaaaaccgccccggggggggggggaattttttttttttnctccctttttntncacacccnnnnnnnnnnaaaanggaagaaaagnagaaanttcggcggnnnannnnaaatggggtggtgagnaagagaggtgttttttttttccccccccccccccgggagggggggggagcgggnncgncacaancaaaaaaaaaaaaaaatattttatttttttttgt

SEQ ID NO: 30745 - DNA, 635 bp, Zea mays
  misc_feature: Ceres CLONE 1406555-F
  misc_feature: Encodes the peptide sequence at SEQ ID NO. 30746
  misc_feature (380)..(380): n is a, c, t, g, unknown, or other
  misc_feature (531)..(531): n is a, c, t, g, unknown, or other
  misc_feature (601)..(601): n is a, c, t, g, unknown, or other
  misc_feature (609)..(609): n is a, c, t, g, unknown, or other
aagctggagctccccgcggtggcggccgctctagaactagtggatcccccgggctgcaggaattcgcacgagaccattacctagaacatcctaatcgaaaaaaaccaacaggtgttgcctgcccaagtgcccagcctcgcttctccagtcaattctcagcctcgtcctccgcctccctcccgctctctcctctccttggcctccgcttccgctcctgcctggaggctgcatcaaaccctaccgctccggacctcccggctggccgcgagatgcgacgcctgtccggcccctaatccttctcctcgatactgcccctcgcccgcccgcccgccggcatgggccgctacgggcccttccctgccgccgccggtgatggcggnggctgcctgcccctgccgattgtagcggctgaaggcgcgctggctgtcctggacggcgccattgcgaccgcggccttcgtgcagttagcaaggattcataggcacaaccagctacaaggatggactcggcaaaagatattccattttatgnatggtctatcaaacatagtattcctagtatatttcgtgtctaccatcattgctacttgtcagagatgganttgctggntacatgggatgtggatttgtctcatg

SEQ ID NO: 30746 - protein, 100 aa, Zea mays
  misc_feature: Ceres CLONE 1406555-F
  misc_feature (66)..(66): Xaa is any aa, unknown, or other
  misc_feature (89)..(89): Xaa is any aa, unknown, or other
  misc_feature (92)..(92): Xaa is any aa, unknown, or other
MGRYGPFPAAAGDGGGCLPLPIVAAEGALAVLDGAIATAAFVQLARIHRHNQLQGWTRQKIFHFMXGLSNIVFLVYFVSTIIATCQRWXCWXHGMWICLM

SEQ ID NO: 30747 - DNA, 613 bp, Zea mays
  misc_feature: Ceres CLONE 1406556-F
  misc_feature: Encodes the peptide sequence at SEQ ID NO. 30748
aagctggagctccccgcggtggcggccgctctagaactagtggatcccccgggctgcaggaattcgcacgagaccattacctagaacatcctaatcgaaaagttatatctcctcaaggcacgttcaccacagacctctctttccccggcaccaacaccacccaggttaaccggactggaccgagtgaaggacaacactgagggcgaggcagatagagcgacctcaggcatggagagccgcgaaaatttgcacctggtggtggacccgccgtctctgggcgcgccgtgtggcgacccatccgccgcagagatcccgtcgcagctcctcgccgcgctgagagagtacctctcctccacccgcgtcgaagtgcaccgacctcgcgacaggatgtagacgacgagttcatgaatgccccagtactaggtgcgatgatgcgcgcgcactcggaactcaaaactggaccgtggggcccctacccgcaccccatggaagccggccggaactggaaacccccccctggggactaacccggggaaccggggccggaaataccgcccccgccagaacccgaaaccccttgcccccccggaaccgcctggccccttttccaaag

SEQ ID NO: 30748 - protein, 54 aa, Zea mays
  misc_feature: Ceres CLONE 1406556-F
MESRENLHLVVDPPSLGAPCGDPSAAEIPSQLLAALREYLSSTRVEVHRPRDRM

SEQ ID NO: 30749 - DNA, 688 bp, Zea mays
  misc_feature: Ceres CLONE 1406557-F
  misc_feature: Encodes the peptide sequence at SEQ ID NO. 30750
tggagctccccgcggtggcggccgctctagaactagtggatcccccgggctgcaggaattcgcacgagaccattacctagaacatcctaatcgaaaaatcccctcagtcctcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggcccccatccgcgcgtccatctccctcctcccccaccccgccctacgacctgacgtcccttccggttcagccccatcaaggagtccatcggggtcccgcgagatgacccggcgcttacatggacggaacatgatcacccacgccggacaccgaagcgggaggaatcgtggggccccaggcacccgcggacctattcccgggcgcaaccgtagtctgtctagggtcccttcccgggaacgcgcgccccccccccgtcccccacccccggtgtcacccacaatggcaggcagcgcggcgggccccggccccaatcctttcccacaccgtggtcgcgagccctacctcgcgcctcccttcgacatacgacaaacaa

SEQ ID NO: 30750 - protein, 57 aa, Zea mays
  misc_feature: Ceres CLONE 1406557-F
MATTAASSLLKSSFAGSRLPSATRTTTPSSVAVATPRAGGGPHPRVHLPPPPPRPTT

SEQ ID NO: 30751 - DNA, 650 bp, Zea mays
  misc_feature: Ceres CLONE 1406558-F
  misc_feature: Encodes the peptide sequence at SEQ ID NO. 30752
aagctggagctccccgcggtggcggccgctctagaactagtggatcccccgggctgcaggaattcgcacgagaccattacctagaacatcctaatcgaaaaatcacacatattattgagaccaactagcaacatataaagcacaatagcgtaccaacaatggcagcaaaatatcttgcttccttatgctccttggtatttctggaagagctgctaccgcaaccattttcccacaatgctcacaagatcctatagcttcctttcttcccccatacctctcaccagaggtgtcttcagaatgtgaaaacccaattcttgcaaccctacaggatccaacaggaaatcgcagcagagcatcttacctttatcaaccttgttcctccaacaaccgatcaccctattacaccatgtacctttggggcatttgctggcacacaaacatcaaggcacaacaactacaacaacttgtgttaggaaaccttgctgcctactcacaggaacagccgtttcttacattcaaccaactgggtggattgaactctgctggttatttgcgacaacaactaccattcatccacctaactgctgcctacccccagctaatttcttccattcaaccaactggcagcattgaaatctgctgcttattta

SEQ ID NO: 30752 - protein, 81 aa, Zea mays
  misc_feature: Ceres CLONE 1406558-F
MYLWGICWHTNIKAQQLQQLVLGNLAAYSQEQPFLTFNQLGGLNSAGYLRQQLPFIHLTAAYPQLISSIQPTGSIEICCLF

SEQ ID NO: 30753 - DNA, 651 bp, Zea mays
  misc_feature: Ceres CLONE 1406561-F
  misc_feature: Encodes the peptide sequence at SEQ ID NO. 30754
  misc_feature (437)..(437): n is a, c, t, g, unknown, or other
aaagctggagctccccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggccccggccacatccaagccgccgcctccggccccgggcacacccaagccgccgcctccggccccggccacacccaagccgccgccagcnggggaggagaaggccggtgacgcggagggggagctcacgggcgtcccgcggagggttaacgtggagggagcgacggttgcggacgaaacggggcaacggaagggggtcgcgatgcaccgtgcgccagggggggggcaaagctcaagggtgttctactccccacggtaacgccgcccaacctcggccagaaggtacgaacctcctccgccaagtg

SEQ ID NO: 30754 - protein, 124 aa, Zea mays
  misc_feature: Ceres CLONE 1406561-F
MGAVTSTVAARFAFFPPSPPSYGFEQPAPLPAPATPEPPAPATSKPPPPAPGTPKPPPPAPATPKPPPAGEEKAGDAEGELTGVPRRVNVEGATVADETGQRKGVAMHRAPGGGQSSRVFYSPR

SEQ ID NO: 30755 - DNA, 640 bp, Zea mays
  misc_feature: Ceres CLONE 1406564-F
  misc_feature: Encodes the peptide sequence at SEQ ID NO. 30756
  misc_feature (509)..(509): n is a, c, t, g, unknown, or other
aaagctggagctccccgcggtggcggccgctctataactagtggatcccccgggctgcaggaattcgcacgagaccattacctagaacatcctaatcgaaaactagctcaccgctcactcacaagcacgctgcgaaacacagacgcagagacccgcgcacagatcgaagcggaggatgaaggtggaggtggtggagacgacgctggtgccgccgagcgaggcgacgccgcggcacgcgctgtggctgtccaacctggacctggcggtgcccaagacccacaccccgctcgtctactactacccgaggcccgccggcgccggcgccggggaggagggaaagggagaggaaaaagggtcgttcttctacccggcgcgcctgggggaggcgctgtccaggtcgctggtgcccttctaccccctggggaagtgtttggcggccgtcccggccggtcggttctagatccactgcaccgacaaagggagagctgttattgcgtagagacttcgcngaatttccccggacgcccctgttgttacgtgctcccttcaggcccctcccccccaaagggcccgaaccgcctgttttcgggggccactttctctggagcccccctcaaaccccacgacctgggggggcact

SEQ ID NO: 30756 - protein, 94 aa, Zea mays
  misc_feature: Ceres CLONE 1406564-F
  misc_feature: SWISSPROT Homolog: EC 2.3.1.144 Anthranilate N-benzoyltransferase
MKVEVVETTLVPPSEATPRHALWLSNLDLAVPKTHTPLVYYYPRPAGAGAGEEGKGEEKGSFFYPARLGEALSRSLVPFYPLGKCLAAVPAGRF

SEQ ID NO: 30757 - DNA, 695 bp, Zea mays
  misc_feature: Ceres CLONE 1406566-F
  misc_feature: Encodes the peptide sequence at SEQ ID NO. 30758
  misc_feature (411)..(411): n is a, c, t, g, unknown, or other
  misc_feature (424)..(424): n is a, c, t, g, unknown, or other
  misc_feature (460)..(460): n is a, c, t, g, unknown, or other
  misc_feature (645)..(645): n is a, c, t, g, unknown, or other
  misc_feature (646)..(646): n is a, c, t, g, unknown, or other
  misc_feature (657)..(657): n is a, c, t, g, unknown, or other
aaagctggagctccccgcggtggcggccgctctagaactagtggatcccccgggctgcaggaattcgcacgagaccattacctagaacatcctaatcgaaaactttttctatatcgcgttacgtccctccctacccagcgatctaggccgccgcctctcctactgcatctccctcgctctcgtcgcctcgttcgcttcgcctcctccccgccccaccccgagccgagcagagcgcagccctatccggagctgggatggcggacgcgaagcagcagcagcagcagccacagcaggcggcagcggcagccaccggcgtgtggaagacggtcaagcccttcgttaacggcggggcctctgggatgctcgcgacctgcgtcatccagcctatcgacatgggtcaaggtgaggatnccaattgggtganggctcccgctggtcaggtcacaaggaacatgctgcnaaatggaaggggtgtccgtctttctaacacaggggtttgcctggccggattgctgaggcaagcgacgtacacgactggctcgtctgaattccctttagggttctactttaacaaagcagttgaaaaagaatgaagggaagccattgcctctaattcaaaaaggcttttatttggtctgactgtgnnagcaaatgggngggttgggttttggaaagcccgggctgatctgcaactc

SEQ ID NO: 30758 - protein, 112 aa, Zea mays
  misc_feature: Ceres CLONE 1406566-F
  misc_feature (53)..(53): Xaa is any aa, unknown, or other
  misc_feature (57)..(57): Xaa is any aa, unknown, or other
  misc_feature (69)..(69): Xaa is any aa, unknown, or other
MADAKQQQQQPQQAAAAATGVWKTVKPFVNGGASGMLATCVIQPIDMGQGEDXNWVXAPAGQVTRNMLXNGRGVRLSNTGVCLAGLLRQATYTTGSSEFPLGFYFNKAVEKE

SEQ ID NO: 30759 - DNA, 658 bp, Zea mays
  misc_feature: Ceres CLONE 1406568-F
  misc_feature (373)..(373): n is a, c, t, g, unknown, or other
  misc_feature (447)..(447): n is a, c, t, g, unknown, or other
  misc_feature (449)..(449): n is a, c, t, g, unknown, or other
  misc_feature (450)..(450): n is a, c, t, g, unknown, or other
  misc_feature (456)..(456): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
tggagctccccgcggtggcggccgctctagaactagtggatcccccgggctgcaggaattcgcacgagaccattacctagaacatcctaatcgaaaagtggattgtactgttctcagtggattaatagaattggacgctggagatagacccgccggagaagatggcctgcccactgctcacagtagtctagtccctgcccaccaagtacggatctcatctcaccagctgcctgtgcagcagtccaattcctcttgctggagcataccagaagcagaatcgggtgagaggaaatgggatcaacaagaacgtctcatccatctttcccggtcctcctgctcttcctcctcgctaccggccgccgccgccggaagnaacaggcctgagggaggtggacgacctccagtaccttattgacaactccgaagactccaccagacccctgaggngnncccccnaaggggggnnnnnnnnnnnnnnnaaaaaaaaaaaaaaacctttctttccaaaatagggacaggacctcccagattacagccggaaatcgacaagccccacgttcggggtccttaccgccgccaatttttccttcttcttggcggcacccggcatggtcatgggttgagttctaccccccctggtgggggcactggccgggag

SEQ ID NO: 30760 - DNA, 671 bp, Zea mays
  misc_feature: Ceres CLONE 1406570-F
  misc_feature (236)..(236): n is a, c, t, g, unknown, or other
  misc_feature (239)..(239): n is a, c, t, g, unknown, or other
  misc_feature (316)..(316): n is a, c, t, g, unknown, or other
  misc_feature (329)..(329): n is a, c, t, g, unknown, or other
  misc_feature (333)..(333): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (372)..(372): n is a, c, t, g, unknown, or other
  misc_feature (373)..(373): n is a, c, t, g, unknown, or other
  misc_feature (519)..(519): n is a, c, t, g, unknown, or other
  misc_feature (569)..(569): n is a, c, t, g, unknown, or other
gctctagaactagtggatcccccgggctgcaggaattcgcacgagaccattacctagaacatcctaatcgaaaacttttggtacccgtgcgcggcgtgcgcgtgcgaaggcgagcgatagcggaagaaacaagaggctgctgctgcttcttccgttgcaacttgcatgtgaggcgaggccgcgagagaagcgcgagccatgtcgatcgcactgcagagcgggcgcggggtgggcgncgncgcccctaggttcggccacgtcgcccgctgcggctacgcggcctcgccgccgccggcggcgcgccgcgcccgccgcnggccccccccccngggnggccccccccccggggcggggggggggccnnnccccccnngcccccccccccggccggcccccgcccgccgcccccccccccccccccccccccgcccccccgcccccgccccccccccccgccccccgccccccccgggggcggcccccgccccccccccccccccccgcgcccccccccccccncgccgccccccccgcccccccccccccccgcccccgcgcgcccccgccgngcccgcccccccccccccccgcgccggcgccccccccccgccccccccccccccccgcccccccccccgccgcgcccccgccgcgccgccgccccgcccccg

SEQ ID NO: 30761 - DNA, 522 bp, Zea mays
  misc_feature: Ceres CLONE 1406579-F
  misc_feature (179)..(179): n is a, c, t, g, unknown, or other
aagctggagctccccgcggtggcggccgctctagaactagtggatcccccgggctgcaggaattcgcacgagaccattacctaagaacatcctaatcgaaaacttcgcttcactctgccctgcgccgccgccaacgctgcagccgcagttgccgcaggcgggaacttggacgtgctacntcgcgactgctctcatctgttcccgcgattcgttcacaatggcccgtgtgtatgtcggcaaacttggatgcacgcgtgacttcccggtaactcgaagatgagttcccgtgtgttttggagttctgcgaaagggtttggggcccccacccaaaccaccgggtttggctttattggttttcacaccgggggatgccaagaggcttttccgggcccaaagggaaaaaaggggggaaatttaatttttcccagaacccaaggggcggggaaacccggatacgcgggggggctctttgacaaaaggttttaatggtgggagaaactgggccctttttcccggggaggg

SEQ ID NO: 30762 - DNA, 615 bp, Zea mays
  misc_feature: Ceres CLONE 1406580-F
  misc_feature: Encodes the peptide sequence at SEQ ID NO. 30763
  misc_feature (205)..(205): n is a, c, t, g, unknown, or other
  misc_feature (339)..(339): n is a, c, t, g, unknown, or other
  misc_feature (340)..(340): n is a, c, t, g, unknown, or other
  misc_feature (363)..(363): n is a, c, t, g, unknown, or other
  misc_feature (422)..(422): n is a, c, t, g, unknown, or other
aaagctggagctccccgcggtggcggccgctctagaactagtggatcccccgggctgcaggaattcgcacgagaccattacctagaacatcctaatcgaaaaaatctgaagcaaaatgtaccgggaatgttgaagagcgggactcttaagcagtagtgagatgcggcggtggtggtcgccggcgttggcggctgtggagccgcgntccgtgcagctcctgctcctgggcgtcgctctcgtcgcagcttctttctacgccgggagcctcttcgggtcctccgcgtgccctgcgctcgtactgcccccttcgcggccccgatcggcccgattccttcaggnncaagatattccagtgtttacgancagagtttctcgtacgtaccggggcaaatcagtgacagttccagatcacggagtggatnggtggcctttggaatacaatgagtaggtcccctggcatgagggagcctatataagcaggctggagaggctggatacatctagggggtgaggatctggaaaggattttgtcctcccaggggaggagggggttgtttttgtttggggcccccctcccagagggctaccggatacccataaagaggggcccacgag

SEQ ID NO: 30763 - protein, 95 aa, Zea mays
  misc_feature: Ceres CLONE 1406580-F
  misc_feature (60)..(60): Xaa is any aa, unknown, or other
  misc_feature (68)..(68): Xaa is any aa, unknown, or other
  misc_feature (88)..(88): Xaa is any aa, unknown, or other
MRRWWSPALAAVEPRSVQLLLLGVALVAASFYAGSLFGSSACPALVLPPSRPRSARFLQXQDIPVFTXRVSRTYRGKSVTVPDHGVDXWPLEYNE

SEQ ID NO: 30764 - DNA, 657 bp, Zea mays
  misc_feature: Ceres CLONE 1406584-F
  misc_feature: Encodes the peptide sequence at SEQ ID NO. 30765
  misc_feature (525)..(525): n is a, c, t, g, unknown, or other
  misc_feature (602)..(602): n is a, c, t, g, unknown, or other
  misc_feature (634)..(634): n is a, c, t, g, unknown, or other
  misc_feature (647)..(647): n is a, c, t, g, unknown, or other
aaactggagctccccgcggtggcggccgctctagaactagtggatcccccgggctgcaggaattcgcacgagaccattacctagaacatcctaatcgaaaaatctatagccaatgatctcctcaccattcgtattgacctgaatactgaatctactagcacgaggggcactgtaccgcaactacctgctcgccattactgcaaactgcgacccatgaaagcttaatatagctccctcatacatctgatccagttatccagctcgccagcactatgcaaggccgagcaaacaatcacgagagagataacagagtggctaactagctcagctcgagcgactaacaatggccgaaatatgcagcaaatggagtcaccactcctgacgctcaacctcatcatgtacatcatcgacatccgctacccgagctggcaccttgaccacttcatcaacggccacaccaactaccacgcctaggtctccaactccgcgacgttctactgtctggtgctcgccatgctcgccacnatggtcagcccggcgaccaacctgactgcatgacacgacgtgcgcgcctgggactgcgacagcctgtgcaccaacancacgtcgtcgctaatcagcatgggcatcactncgctcagcattgngatgcctgca

SEQ ID NO: 30765 - protein, 39 aa, Zea mays
  misc_feature: Ceres CLONE 1406584-F
MQQMESPLLTLNLIMYIIDIRYPSWHLDHFINGHTNYHA

SEQ ID NO: 30766 - DNA, 639 bp, Zea mays
  misc_feature: Ceres CLONE 1406585-F
  misc_feature: Encodes the peptide sequence at SEQ ID NO. 30767
  misc_feature (67)..(67): n is a, c, t, g, unknown, or other
  misc_feature (222)..(222): n is a, c, t, g, unknown, or other
  misc_feature (264)..(264): n is a, c, t, g, unknown, or other
  misc_feature (310)..(310): n is a, c, t, g, unknown, or other
  misc_feature (334)..(334): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (352)..(352): n is a, c, t, g, unknown, or other
  misc_feature (363)..(363): n is a, c, t, g, unknown, or other
  misc_feature (379)..(379): n is a, c, t, g, unknown, or other
  misc_feature (385)..(385): n is a, c, t, g, unknown, or other
  misc_feature (392)..(392): n is a, c, t, g, unknown, or other
ggcggccgctctagaactagtggatcccccgggctgcaggaattcgcacgagaccattacctagaancatcctaatcgaaaaagagcgctcgtccgtctaaactgtggtctctgtacttccgctcacttcttcagcggcggcgtgacaacgagagcaagaaagtatcaaaacccgagagcaatggaggcggtggggaagagcgtgtgcgtgaccggcgcggncggcttcatcgcgtcatgtctggtgaagctcctcctctgccngggccaatacaaggtccgcggcaccgtgcgcgaccctggtgctagncagatggctcatctcaggtgctgnaaggggctgnnngaaggntgcagcttgtncagggctgatttgtgnactacngcagtgntggatccgcaattgccgggttggggaggtggccttccttggagctagccctggccccttccgggcggtccctccaccccgggggggggaggggctaggggccctggtggaaacggggacaaacacatggggttaaagggtttgtattgaaggacaaaacggggggcgagttggggggggcctcttcccgggggcgccgcggtgtgtgaccccccaacttctcgcagggggagaagcgcttttgcgcc

SEQ ID NO: 30767 - protein, 85 aa, Zea mays
  misc_feature: Ceres CLONE 1406585-F
  misc_feature: SWISSPROT Homolog: EC 1.1.1.219 Dihydrokaempferol 4-reductase
  misc_feature (14)..(14): Xaa is any aa, unknown, or other
  misc_feature (28)..(28): Xaa is any aa, unknown, or other
  misc_feature (43)..(43): Xaa is any aa, unknown, or other
  misc_feature (51)..(51): Xaa is any aa, unknown, or other
  misc_feature (55)..(55): Xaa is any aa, unknown, or other
  misc_feature (61)..(61): Xaa is any aa, unknown, or other
  misc_feature (66)..(66): Xaa is any aa, unknown, or other
  misc_feature (71)..(71): Xaa is any aa, unknown, or other
MEAVGKSVCVTGAXGFIASCLVKLLLCXGQYKVRGTVRDPGAXQMAHLRCXKGLXEGCSLXRADLXTTAVXDPQLPGWGGGLPWS

SEQ ID NO: 30768 - DNA, 772 bp, Zea mays
  misc_feature: Ceres CLONE 1406601-F
  misc_feature (66)..(66): n is a, c, t, g, unknown, or other
  misc_feature (67)..(67): n is a, c, t, g, unknown, or other
ttttttttgtttttccctgttgttcgggtcccccccggctgcccccccaggagggtagaccctggnnccgctcccccccctaagtggcgctccccggcgtggcggccgctctttaatagcgcatcccccgggctgtaggaattcgcacgagaccattgcctagaacatcctaatcgaaaacgaaaaattcgaaagatccctccaggaaagatttttcttccctcctccgacgccccagcccaccaacacactctataaagcagccctcagtcacacacagaacgcacaagcgcaagccggacaagaaaactccgtaccccagtctgcgagttggatggccttcttcttggccctcgtgtgcatcctcatcttgctagtcatcgcctcctacgtccaagacactccctcccaaaaggccaaaggctgcttcccccggccactgaaaggtccgccccccttgggaggtggccccctggctccccatgggctggcccttacccttggccgaccacccctcccagttttttacctcccaagggaccccccggccttccttccttcccgttcccacccccccacaagcgacccgcgcagatactttccacgacgccccctttatggtattgccccgctgccgcgcatgcctgtctcagattgccggagagggaggccccggcgttttgcgcccgaaagaccccaagctcgcacccgggccccacgccccaacaaaccccgccccaaccaacggacccgccatgcccccgcgcccctc

SEQ ID NO: 30769 - DNA, 713 bp, Zea mays
  misc_feature: Ceres CLONE 1406602-F
  misc_feature: Encodes the peptide sequence at SEQ ID NO. 30770
  misc_feature (423)..(423): n is a, c, t, g, unknown, or other
  misc_feature (556)..(556): n is a, c, t, g, unknown, or other
  misc_feature (557)..(557): n is a, c, t, g, unknown, or other
  misc_feature (572)..(572): n is a, c, t, g, unknown, or other
  misc_feature (663)..(663): n is a, c, t, g, unknown, or other
aaagctggagctccccgcggtggcggccgctctagaactagtggatcccccgggctgcaggaattcgcacgagaccattacctagaacatcctaatcgaaaaaccaccaccactggacgtcagcctagcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccagntgcgtcgagttcctgaggcaccagtgcagcccgggcggcgacgccctacggctcgccacagtgccaggcgctgcagcagcagtgctgccaccagatccaggcagggtggagccgctgcaccggtacagcgacnnaataggggggggggnccgtgcagtcccttcctgcagcagcagcccgcagggcgagttcccgcgcgggctgatgggcggcccagttagcgcacagtttgtaaggggnttaaggtggcggtcctgcaactgcaagcagccaggtcccctgcccttggg

SEQ ID NO: 30770 - protein, 28 aa, Zea mays
  misc_feature: Ceres CLONE 1406602-F
MGGPVSAQFVRGLRWRSCNCKQPGPLPL

SEQ ID NO: 30771 - DNA, 658 bp, Zea mays
  misc_feature: Ceres CLONE 1406604-F
  misc_feature: Encodes the peptide sequence at SEQ ID NO. 30772
  misc_feature (361)..(361): n is a, c, t, g, unknown, or other
  misc_feature (415)..(415): n is a, c, t, g, unknown, or other
  misc_feature (503)..(503): n is a, c, t, g, unknown, or other
  misc_feature (516)..(516): n is a, c, t, g, unknown, or other
  misc_feature (538)..(538): n is a, c, t, g, unknown, or other
aaagctggagctccccgcggtggcggccgctctagaactagtggatcccccgggctgcaggaattcgcacgagaccattacctagaacatcctaatcgaaaaaaaccctagactacacccccatcccgcagcagccaaaacctacctagccgccgccgcaggcggccccccatcgccgccaagatgcagatctttgtgaagactctgacggggaagaccatcactttggaggtggagtcctcggacaccattgacaatgtgaaggccaagatccaggacaaggagggcatccccccggaccagcagcggctcatcttcgccggcaagcagctcgaggacggtcgcaccctcgccgactacnacattcagaaggagtccaccctccacctggtgctccgcctccgcggtggcgccnagaagcgtaagaagaagacgtacaccaagcccaagaagatcaagcacaagcacaagaaggtgaagctctccggtgctgcagttctatnaggtggacgacgncccaggcaaggtgacccgcctnccgcaaggagtgccccaacacaaggggggggggggggcggtctttagtgggcaaaccacttttaaacggcccataatggggggggagggggggggccccccccttttttaaacaccgaag

SEQ ID NO: 30772 - protein, 133 aa, Zea mays
  misc_feature: Ceres CLONE 1406604-F
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature (60)..(60): Xaa is any aa, unknown, or other
  misc_feature (78)..(78): Xaa is any aa, unknown, or other
  misc_feature (107)..(107): Xaa is any aa, unknown, or other
  misc_feature (119)..(119): Xaa is any aa, unknown, or other
MQIFVKTLTGKTITLEVESSDTIDNVKAKIQDKEGIPPDQQRLIFAGKQLEDGRTLADYXIQKESTLHLVLRLRGGAXKRKKKTYTKPKKIKHKHKKVKLSGAAVLXGGRRPRQGDPPXARSAPTQGGGGGGL

SEQ ID NO: 30773 - DNA, 689 bp, Zea mays
  misc_feature: Ceres CLONE 1406610-F
  misc_feature: Encodes the peptide sequence at SEQ ID NO. 30774
  misc_feature (336)..(336): n is a, c, t, g, unknown, or other
  misc_feature (366)..(366): n is a, c, t, g, unknown, or other
  misc_feature (409)..(409): n is a, c, t, g, unknown, or other
  misc_feature (468)..(468): n is a, c, t, g, unknown, or other
  misc_feature (596)..(596): n is a, c, t, g, unknown, or other
  misc_feature (598)..(598): n is a, c, t, g, unknown, or other
  misc_feature (619)..(619): n is a, c, t, g, unknown, or other
  misc_feature (662)..(662): n is a, c, t, g, unknown, or other
  misc_feature (663)..(663): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (688)..(688): n is a, c, t, g, unknown, or other
aaagctggagctccccgcggtggcggccgctctagaactagtggatcccccgggctgcaggaattcgcacgagaccattacctagaacatcctaatcgaaaattaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaaggaggcgggcgcccgatgggtgaggcaggtgaagggcatgctccacgacaaggggncgcgcggcgtcgcagggcgctgacgggggncgacgctggttcccgctggggcgggctggctgctggttgctgnccggggcctggcgctgacggcctcccggggtggggggttggccctggcccccccccggngtttcttgggccttccgccccggggcggggccccggcgcccttgttcctcggtgccggctcctgggggggggccctcccccccggcgccctttgggttctggtttcgccgccggcccggggggggctncngcgcggcgttggctcccgggnccccccgcgcctccccggtgtgtgtgcgccgggttgcgccgcnncgtccccggcctccnnngnnncccnt

SEQ ID NO: 30774 - protein, 31 aa, Zea mays
  misc_feature: Ceres CLONE 1406610-F
MADRDRSGIYGGAHATYGQQQQQGRRRAPDG

SEQ ID NO: 30775 - DNA, 633 bp, Zea mays
  misc_feature: Ceres CLONE 1406611-F
  misc_feature: Encodes the peptide sequence at SEQ ID NO. 30776
  misc_feature (547)..(547): n is a, c, t, g, unknown, or other
  misc_feature (557)..(557): n is a, c, t, g, unknown, or other
  misc_feature (583)..(583): n is a, c, t, g, unknown, or other
tggagctccccgcggtggcggccgctctagaactagtggatcccccgggctgcaggaattcgcacgagaccattacctagaacatcctaatcgaaaaacaaaccctcgtctcgtgccactttctcagtcccctctagccgccgcctaccgctcgcgctctcctcgcgttcgggaaggtcgtttcgccatggcctcggagacggagacgttcgccttccaggcggagatcaaccagctgctctcgctcatcatcaacaccttctactccaacaaggagatcttcctcagggagctcatctccaactcctccgatgccttggacaagatcaggtttgagagtttgacggacaagaccaagctggatgcacagccagagctgttcatccacattgtccccgacaaggccaacaacacgctgacaatcatcgacagcggcattggtatgaccaagtcagaccttgtgaacaaccttggtaccattgcgcggtcaggcacgaaggaattcatggaggcacttgctgctgggtgctgatgtgtcatgattggncagtttttgntgtcggtttctactctgcctacctgntggaaaaaggagggttgtcgtgaccactaagcacaatgatgatgagcagt

SEQ ID NO: 30776 - protein, 114 aa, Zea mays
  misc_feature: Ceres CLONE 1406611-F
MASETETFAFQAEINQLLSLIINTFYSNKEIFLRELISNSSDALDKIRFESLTDKTKLDAQPELFIHIVPDKANNTLTIIDSGIGMTKSDLVNNLGTIARSGTKEFMEALAAGC

SEQ ID NO: 30777 - DNA, 696 bp, Zea mays
  misc_feature: Ceres CLONE 1406618-F
  misc_feature: Encodes the peptide sequence at SEQ ID NO. 30778
  misc_feature (442)..(442): n is a, c, t, g, unknown, or other
  misc_feature (522)..(522): n is a, c, t, g, unknown, or other
tggagctccccgcggtggcggccgctctagaactagtggatcccccgggctgcaggaattcgcacgagaccattacctagaacatcctaatcgaaaaaaacaagaagcttgcattgttcgtttgctcgatcgttgcagataatggagaaccctgctccgagtatcgtagtgccccccattgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaacccacgttcgggaactccaaccagttcttcaccgtcgccttcgaaggccgncagggctcaagggctccacgtccttacccgaaaggagtggtgacggaatggatccagatgaatgggcaatctacggcggnaaccgggagagtttgctatggcgaagaggtgtcgtccaaaggaaggtaccttgccgaatagggaatggcgcccggaaacactgacgagcttcaccatgcaggtttttctggcccggggtttgggctccttcaagcaaccaaacaagcaagcatctctgtcaccaagattggggt

SEQ ID NO: 30778 - protein, 154 aa, Zea mays
  misc_feature: Ceres CLONE 1406618-F
  misc_feature (101)..(101): Xaa is any aa, unknown, or other
MENPAPSIVVPPIAAPVSANFSRLAFRNLYIRRTGPDSREMVTVEGRRGSSDQTGDMRYVSDFPVYDGRGSDAVLVARVQGVTTHVRELQPVLHRRLRRPXGLKGSTSLPERSGDGMDPDEWAIYGGNRESLLWRRGVVQRKVPCRIGNGARKH

SEQ ID NO: 30779 - DNA, 616 bp, Zea mays
  misc_feature: Ceres CLONE 1406622-F
  misc_feature: Encodes the peptide sequence at SEQ ID NO. 30780
  misc_feature (354)..(354): n is a, c, t, g, unknown, or other
  misc_feature (363)..(363): n is a, c, t, g, unknown, or other
aagctggagctccccgcggtggcggccgctctagaactagtggatcccccgggctgcaggaattcgcacgagaccattacctagaacatcctaatcgaaaaaactcgaaccgaagggacgaccgagcggagtctagactcgagagcaacctcgacctcccggatctctctcccacccacgcctcgtcggcgccgtcgtctgctgcagcgatggcctcccccgacctgctcttcaatctgcggaacctcttctacctgggcgcctaccaggcagccatcaacaacagcgacgtcccgggcctcgacgccgacgccgccgctgagcgcgacgccatcgtcttccgctcctacatcngccctcggntcctaccagctggtgatcagggagatcgactcgtcagccgctacctcgctgcaggccgtgaagctgctcgcgctgtacctcactggagacaaaggaagggctatctccagcctccaaggaaagggttgagggattcggaatttggaaccatcctggttccggggggtgagtggctaatctcctctccccaaactaacccttcgccggggcccgggggatgtggccaaaaaaaacccgatcgccccgggcaggg

SEQ ID NO: 30780 - protein, 135 aa, Zea mays
  misc_feature: Ceres CLONE 1406622-F
  misc_feature (49)..(49): Xaa is any aa, unknown, or other
  misc_feature (52)..(52): Xaa is any aa, unknown, or other
MASPDLLFNLRNLFYLGAYQAAINNSDVPGLDADAAAERDAIVFRSYIXPRXLPAGDQGDRLVSRYLAAGREAARAVPHWRQRKGYLQPPRKGLRDSEFGTILVPGGEWLISSPQTNPSPGPGGCGQKKPDRPGQ

SEQ ID NO: 30781 - DNA, 641 bp, Zea mays
  misc_feature: Ceres CLONE 1406630-F
  misc_feature: Translation starting site: 227
  misc_feature: SWISSPROT Homolog: EC 2.4.1.207 Xyloglucan:xyloglucosyl transferase
  misc_feature (469)..(469): n is a, c, t, g, unknown, or other
  misc_feature (641)..(641): n is a, c, t, g, unknown, or other
aaagctggagctccccgcggtggcggccgctctagaactagtggatcccccgggctgcaggaattcgcacgagaccattacctagaacatcctaatcgaaaaaagttccatatccaacacacacagcaacgctcgctcgacactggcactagctagttgctctactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggccgcggcaaggtagtggacggcgggcgcgggctggacctgacgctggaccgcacgtccggctccgggttccagtccaagagcgagtacctggttcggcagatcgacatgcagattcagctggtgcaggcnactccgtggcacggccacactttcttactgtcgtcccaggggaccggaacgacgagatcgacttcgagttccggggaaacgggagcggggaggcctaccggtggcaacccacgggttcccgccggaaagggccagggggaagaacattcccccccctgggtccaccctaccn

SEQ ID NO: 30782 - DNA, 676 bp, Zea mays
  misc_feature: Ceres CLONE 1406633-F
  misc_feature (367)..(367): n is a, c, t, g, unknown, or other
  misc_feature (378)..(378): n is a, c, t, g, unknown, or other
aaagctggagctccccgcggtggcggccgctctagaactagtggatcccccgggctgcaggaattcgcacgagaccattacctagaacatcctaatcgaaaaagaaattcgtaactagagaaccgtaactccggtttgatccattcgaattgcgttggattcataataatatcgtctgtacagtatgacactaacatatatcacaccccatacttttattattagaaatttgtctagcctatgtttaatagattaacccctctaattgaagttaacctctccataattatagtttgattaaaatatgatttctagttaagttataattaagatttaaaggtgaatttaattattaatggaatattcntctcatatggntggatactaatcaatttataataataggttaaatcccataaattcttccataaaatcataactcccttacccatgactccgatctttactagttctcgaaccccacgatctcgtagcggacgaagtagatcattattaatgcatttggtcttaaggtgtggggggggggggggaaataatcctataccccggggttggtgtggattgggtattaacaaaaaaagggggggccccaaaaaactaaaagaatccttcttgaacccgggaaaatccaggccccccaaaaaaggatttgccc

SEQ ID NO: 30783 - DNA, 686 bp, Zea mays
  misc_feature: Ceres CLONE 1406634-F
  misc_feature: Translation starting site: 201
  misc_feature (539)..(539): n is a, c, t, g, unknown, or other
  misc_feature (540)..(540): n is a, c, t, g, unknown, or other
  misc_feature (628)..(628): n is a, c, t, g, unknown, or other
  misc_feature (634)..(634): n is a, c, t, g, unknown, or other
aaagctggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaaccccggcgggcctggatcgcggcggcggtggcgcacgcgttcgcgctgtttcgtggcgggtgtctggtgggcgcgaacatctccggcgggcacgtgaaaccctgccgtgaccttcggcgggcttcggtgggcggcaacatcaccctgttccgggggctcctggtactgggtggcgaannctgctgggtcccaccgtggcgtgcttcctgctcggcttctcgacggggcgggcaggcacggcaccttccgcctgaggggcgggggccngggggnaagcccctggtgttgaaaatcgtgatgacctttcggctggggaaccgggggc

SEQ ID NO: 30784 - DNA, 637 bp, Zea mays
  misc_feature: Ceres CLONE 1406636-F
  misc_feature: Encodes the peptide sequence at SEQ ID NO. 30785
  misc_feature (544)..(544): n is a, c, t, g, unknown, or other
  misc_feature (555)..(555): n is a, c, t, g, unknown, or other
  misc_feature (580)..(580): n is a, c, t, g, unknown, or other
  misc_feature (581)..(581): n is a, c, t, g, unknown, or other
  misc_feature (587)..(587): n is a, c, t, g, unknown, or other
  misc_feature (590)..(590): n is a, c, t, g, unknown, or other
  misc_feature (591)..(591): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (611)..(611): n is a, c, t, g, unknown, or other
  misc_feature (616)..(616): n is a, c, t, g, unknown, or other
  misc_feature (622)..(622): n is a, c, t, g, unknown, or other
  misc_feature (637)..(637): n is a, c, t, g, unknown, or other
tggagctccccgcggtggcggccgctctagaactagtggatcccccgggctgcaggaattcgcacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttaaacggccaaaccagcccaaaccccaaacccacagtagtaacaggggcacactagctaagctaaacctcgccacggcacagcaatggcgccgctccccgcttccctcacgccctgcctctggctcttcctctgcctcctcgctgcgccgtgccccgcggcgcgggcggcgcggttcgcgtgcaacgccacggcgccgcgagcgtccacgtgccaggcgctcgtctcctacgcgccgcccaacgggacggccacgcccacgctgggccgcgtgcgggngctcttccagntccgctccccacgcgcgctgctggnncgcaanggnnctccgnnntctcacgcgccnacggngcccgngccccgtgcgctgcn

SEQ ID NO: 30785 - protein, 95 aa, Zea mays
  misc_feature: Ceres CLONE 1406636-F
  misc_feature (65)..(65): Xaa is any aa, unknown, or other
  misc_feature (69)..(69): Xaa is any aa, unknown, or other
  misc_feature (77)..(77): Xaa is any aa, unknown, or other
  misc_feature (79)..(79): Xaa is any aa, unknown, or other
  misc_feature (81)..(81): Xaa is any aa, unknown, or other
  misc_feature (83)..(83): Xaa is any aa, unknown, or other
  misc_feature (89)..(89): Xaa is any aa, unknown, or other
  misc_feature (91)..(91): Xaa is any aa, unknown, or other
MAPLPASLTPCLWLFLCLLAAPCPAARAARFACNATAPRASTCQALVSYAPPNGTATPTLGRVRXLFQXRSPRALLXRXGXPXSHAPTXPXPRAL

SEQ ID NO: 30786 - DNA, 615 bp, Zea mays
  misc_feature: Ceres CLONE 1406648-F
  misc_feature: Encodes the peptide sequence at SEQ ID NO. 30787
  misc_feature (428)..(428): n is a, c, t, g, unknown, or other
  misc_feature (525)..(525): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (543)..(543): n is a, c, t, g, unknown, or other
  misc_feature (561)..(561): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
aagctggagctccccgcggtggcggccgctctacaactagtggatcccccgggctgcaggaattcgcacgagaccattacctagaacatcctaatcgaaaaattccactccatcagtgggcagcgctctgctctcctccactcactcactccccttgcccccatccatccgctagccactagctccagcaggctcgccgccgacactccactagtgctctgctctctccgctccactcacaaactcccctcgctccccccccccccccccaatcggcgatggatctgctgctgcggcggcggctgctggccgtggtggccacggcggcggtgctggccgtgtgcgccttcacggcggcggaggggttcgacatcctgcagatcctggggaaagcacgaacaaattccccccagatttttgcgaaaggnggggttaaaaaaaaaaaccaccggggggggggggaaaatataaagggggggagcgccgaaaaaaaccccccggggggggggggcggggggggggagnagnnnnacacaacaccangaacatcgtttgggtgcntccccccccccnnnnnnnnnncgccggggggagaaaaaaataaatcgcatgcgc

SEQ ID NO: 30787 - protein, 112 aa, Zea mays
  misc_feature: Ceres CLONE 1406648-F
  misc_feature (83)..(83): Xaa is any aa, unknown, or other
  misc_feature (84)..(84): Xaa is any aa, unknown, or other
  misc_feature (85)..(85): Xaa is any aa, unknown, or other
  misc_feature (89)..(89): Xaa is any aa, unknown, or other
  misc_feature (95)..(95): Xaa is any aa, unknown, or other
  misc_feature (99)..(99): Xaa is any aa, unknown, or other
  misc_feature (100)..(100): Xaa is any aa, unknown, or other
  misc_feature (101)..(101): Xaa is any aa, unknown, or other
  misc_feature (102)..(102): Xaa is any aa, unknown, or other
MDLLLRRRLLAVVATAAVLAVCAFTAAEGFDILQILGKARTNSPQIFAKGGVKKKNHRGGGENIKGGSAEKNPPGGGGGGGEXXXTTPXTSFGCXPPPXXXXPGGEKNKSHA

SEQ ID NO: 30788 - DNA, 681 bp, Zea mays
  misc_feature: Ceres CLONE 1406649-F
  misc_feature: Encodes the peptide sequence at SEQ ID NO. 30789
  misc_feature (478)..(478): n is a, c, t, g, unknown, or other
  misc_feature (524)..(524): n is a, c, t, g, unknown, or other
  misc_feature (545)..(545): n is a, c, t, g, unknown, or other
aaagctggagctccccgcggtggcggccgctctagaactagtggatcccccgggctgcaggaattcgcacgagaccattacctagaacatcctaatcaaaatcaagctagctagttaactgtgcaattagttgagtcagtagataagctgttccgtcttagcttatctaccgatcgagctcgcggcaatggcgatgatggcatgcaataacactcgaccccgcaagctgtcgctgccatgccgcacccgtactttccaagccttaatactaagcacagcagtcttcctggctgcttccacggccgtcgtcgtcggcaaggagccacaaccaccgtcctcctccggcggcggctgtcactaccgcttcgagctcacccacgtagatgccaacctcaaccttaccagcgacgagttgatgcgtcgtgcctatgacaggagccgcctccgcgcggcgagcttggccgcctactcggacggncgacacgaagggcgcgttagcattcctgacgcctcgtacatcatcnacgttttacttgggcaacagncggcccgaggaaccatcttcccgcccgtcgtggacaccggcagcgaacatattttggacgaccggagaaggaggtgtagccggtccaagacaagggtccatgcctgccttgcttgcagccccagtgcgagcagcgg

SEQ ID NO: 30789 - protein, 164 aa, Zea mays
  misc_feature: Ceres CLONE 1406649-F
  misc_feature (113)..(113): Xaa is any aa, unknown, or other
  misc_feature (120)..(120): Xaa is any aa, unknown, or other
MAMMACNNTRPRKLSLPCRTRTFQALILSTAVFLAASTAVVVGKEPQPPSSSGGGCHYRFELTHVDANLNLTSDELMRRAYDRSRLRAASLAAYSDGRHEGRVSIPDASYIIXVLLGQQXARGTIFPPVVDTGSEHILDDRRRRCSRSKTRVHACLACSPSASS

SEQ ID NO: 30790 - DNA, 675 bp, Zea mays
  misc_feature: Ceres CLONE 1406650-F
  misc_feature (599)..(599): n is a, c, t, g, unknown, or other
aaagctggagctccccgcggtggcggccgctctagaactagtggatcccccgggctgcaggaattcgcacgagaccattacctagaacatcctaatcgaaaaaccgtccctctcccaaccttttcagatctgcctgagagcccccgacacgcacccccatgcccatgcagacatgcccatgaccccccaacgcgaggccactactgccaatggctccctgccgagaccgagcccatggaggacctcgccccgtaggacctcgcactcttcgccgccgacgactgacttcctagactactcctctcctgctgccaccggggccgatatgacaccgccggatcccgattccacacccggaagtccctgctccgactgcagcagcgacgctcgccacgaacttcgaggtcttcgagcgacctcacctccacgctcaagctcgaggacctcgtatcacccggctccgcctccggctccgtcagctcgctcaccgacaccagaacgagcgcctgtcatggaccgactgcgcgctcgactgtgtgtctatgctgagcagtcgcatccgtgtgacggcgacacactcgactaggcatgcatctccncgagtggaattcaatccgtatgtccatctaactaatgaaattggctctctgtgtaccgcccagttgactttttagt

SEQ ID NO: 30791 - DNA, 760 bp, Zea mays
  misc_feature: Ceres CLONE 1406653-F
  misc_feature: Translation starting site: 265
  misc_feature: SWISSPROT Homolog: EC 5.5.1.4 Inositol-3-phosphate synthase
  misc_feature (16)..(16): n is a, c, t, g, unknown, or other
  misc_feature (25)..(25): n is a, c, t, g, unknown, or other
  misc_feature (52)..(52): n is a, c, t, g, unknown, or other
tggtccccccccccanactacatanttttttttgataccggtctcccccttncaaagctggagctccccgcggtggcggccgctctagaactagtggatcccccgggctgcaggaattcgcacgagaccattacctagaacatcctaatcgaaaaacacaacccaaagcagccacagcagcctccttcctcctctcactctcgctcgcgctgcgctcgctacctcgcttcgcattccattcgaaaagaggggaggaaaggcaagatgttcatcgagagcttccgcgtcgagagcccccacgtgcggtacggcccgatggagatcgagtcggagtaccggtacgacacgacggagctggtacacgagggcaaggacggcgcctcacgctgggtcgtccgccccaagtccgtcaaggacaacttccggaccagaaccgccgtccccaagctcggggtgatgctttggtggggtggggaggcaacaacgggtccacgctggacggctggggtccttgccaacaagggaggggatctcatgggcgaacaaggacaaggtgcagcaggccaactactaacggctccctcacccagggcctcccaccatcagaggcggcagctaccagggggggaaggagaatctatgcggccgtccagagaggctaccgttcgcagaagggaaacccagaaaagaaactgtgggacacccgacgccattcggacacataagcgaagatgggacacccgggaacgaagtacccagg

SEQ ID NO: 30792 - DNA, 650 bp, Zea mays
  misc_feature: Ceres CLONE 1406656-F
  misc_feature: Encodes the peptide sequence at SEQ ID NO. 30793
  misc_feature (430)..(430): n is a, c, t, g, unknown, or other
  misc_feature (460)..(460): n is a, c, t, g, unknown, or other
  misc_feature (511)..(511): n is a, c, t, g, unknown, or other
gctggagctccccgcggtggcggccgctctagaactagtggatcccccgggctgcaggaattcgcacgagaccattacctagaacatcctaatcgaaaagtgctgccgccagatctaaccaaaccccgcgccctcctcaccgtccggcgagctacggactcagcagatcaccgtcgctcgagttgtacctgaaggcgcgcccgtggaaccggccgcgagataacggcggcgggaaggcgggcgacgatgccggtggcagcgtcggccatctacttcctcaaccttcgcggggacgtcctcatcaaccgcctctaccgtgatgatgttgggggaaatatggttgatgcgttcagaatgcatatcatgcaaacaaaagaacttgggacatgccctgttcgtcaaataggaggctgctccttcctttatatgnagatcagtaatgtttacattgtgatcgtangtagcagcaatgctaatgttgcatgtgcttttcaattttgtgtcgaggcgntggctctctttcagtcctacttcggtggagcttttgatgaagacgctatcaggaaatactttgttttgatatatgaacttcttgatgagatcaatggattttggttatcctcaaaacctttcactggaaatttttgagt

SEQ ID NO: 30793 - protein, 133 aa, Zea mays
  misc_feature: Ceres CLONE 1406656-F
  misc_feature (62)..(62): Xaa is any aa, unknown, or other
  misc_feature (72)..(72): Xaa is any aa, unknown, or other
  misc_feature (89)..(89): Xaa is any aa, unknown, or other
MPVAASAIYFLNLRGDVLINRLYRDDVGGNMVDAFRMHIMQTKELGTCPVRQIGGCSFLYMXISNVYIVIVXSSNANVACAFQFCVEAXALFQSYFGGAFDEDAIRKYFVLIYELLDEINGFWLSSKPFTGNF

SEQ ID NO: 30794 - DNA, 682 bp, Zea mays
  misc_feature: Ceres CLONE 1406661-F
  misc_feature: Encodes the peptide sequence at SEQ ID NO. 30795
  misc_feature (386)..(386): n is a, c, t, g, unknown, or other
aagctggagctccccgcggtggcggccgctctagaactagtggatcccccgggctgcaggaattcgcacgagaccattacctagaacatcctaatcgaaaagacgacgcttcccgagctctctccttcccgcgaccctctcctctgccccgctccgctagggttttgccgcagacctctcgctcgcttccggttccgcgaggcaaccgtccgaccggtcggaatggtggatgtggaggagaccgggaacaagttgcaatcgcagatgcgcctccacgcggagccggaggacgacgccgccgacctccccctcccggccctctatcgaaggggcgtcgcggctccacgccctggcctccagctccgccctcgatcagtatgggatgncagcacgggggttgtcctgctgctgcgctgcaatgacttgctcaggatgctcgttctcttctccgccaaaggacaaaagagggctggcaccgctgaaacctagtgtaccgactgggcacatattaccttgcatgcaggtacggacagagagcatctgggtgatatgatgccccgcctgcaactaccattcggaccgtcagctggtgcctaccgccagtcagtttcttcctttaaaccaactgagaggattggaattcgacctgcttatttacaacaggccccgactactagcattc

SEQ ID NO: 30795 - protein, 88 aa, Zea mays
  misc_feature: Ceres CLONE 1406661-F
  misc_feature (55)..(55): Xaa is any aa, unknown, or other
MVDVEETGNKLQSQMRLHAEPEDDAADLPLPALYRRGVAAPRPGLQLRPRSVWDXSTGVVLLLRCNDLLRMLVLFSAKGQKRAGTAET

SEQ ID NO: 30796 - DNA, 669 bp, Zea mays
  misc_feature: Ceres CLONE 1406662-F
  misc_feature: Encodes the peptide sequence at SEQ ID NO. 30797
  misc_feature (596)..(596): n is a, c, t, g, unknown, or other
  misc_feature (603)..(603): n is a, c, t, g, unknown, or other
  misc_feature (654)..(654): n is a, c, t, g, unknown, or other
aaagctggagctccccgcggtggcggccgctctagaactagtggatcccccgggctgcaggaattcgcacgagaccattacctagaacatcctaatcaaaaaatcccaaatagttactccactcccctcacccctcccgactcccgtgctctctctctctctctctctcggatccgaattgccagcgcaccagtcgagctcgcgggaactcgccggcaccggcgatggcctccgccctactggccggacagggcggggcgcgccaccacggctggggggagacgcgcgccccactcgcgcccatacctcccaaccctaaccccagccagccccacccgcgcgccgacgggtccaagtccaagccgcgggcggcagcctcctcgccggcggccggatacgtgacgttccgcccggcgtccctgggcccgcgcgaggcccgcgcgctccgggacccgcctcgcgggggagctcacccaggtgcgcgccctcctctcccgcatcgacacctggcagcagcagggcccgccgcccgcggggctcccgcggcgaggtgcggaaagcggtgcgggcagatcctcaccaggctgcgcaagacnagcgggnagcgtgtggttcacgggcccccgtcgaaggtggagcgcctcggcctcacgntaccacgccgtcatc

SEQ ID NO: 30797 - protein, 148 aa, Zea mays
  misc_feature: Ceres CLONE 1406662-F
  misc_feature (127)..(127): Xaa is any aa, unknown, or other
  misc_feature (144)..(144): Xaa is any aa, unknown, or other
MASALLAGQGGARHHGWGETRAPLAPIPPNPNPSQPHPRADGSKSKPRAAASSPAAGYVTFRPASLGPREARALRDPPRGGAHPGARPPLPHRHLAAAGPAARGAPAARCGKRCGQILTRLRKTSGXRVVHGPPSKVERLGLTXPRRH

SEQ ID NO: 30798 - DNA, 706 bp, Zea mays
  misc_feature: Ceres CLONE 1406666-F
  misc_feature: Encodes the peptide sequence at SEQ ID NO. 30799
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
gggggggggtggtttgccgggtggggtgggcccccnnnnggggccctgacnnnnnncaaactggtactccacgcggtggcggccgctctagaactagtggatcccccgggctgcaggaattcgcacgagaccattacctagaacatcctaatcgaaaaaaatagaaaaagtctcctgcctccgcggccgtgccgagccggcatcccctcccgtcccccacccccagcagcgatcgcgacgacccgagccggcaagggtgacaggcggctgacgagccccatgggagacaacaagtctccgctgagcctgagcccgatgggcgggcgcgaccgggaccgggagctcctcatcccggtctcgggcggcggctcggcgcccggcgacggggtcgaggacggggacagggcctcctccgcctccgccgcgctatcctcctccggccgcgaggctttccataaggttgtccgcagttgggcttcaaagaagttcatgactggatgtgtaattctcttccccatagcaataacgttctacatcacctggtggttcattcatttttggtgatggattcttctctccaatctatgctcaactgggaaatcaacatatttggtcttgggttttggcacaatctgttacttttcataatttttgatcggaagccttttatggccatcttgggccttgggggcaattctggcacttt

SEQ ID NO: 30799 - protein, 94 aa, Zea mays
  misc_feature: Ceres CLONE 1406666-F
MGDNKSPLSLSPMGGRDRDRELLIPVSGGGSAPGDGVEDGDRASSASAALSSSGREAFHKVVRSWASKKFMTGCVILFPIAITFYITWWFIHFW

SEQ ID NO: 30800 - DNA, 736 bp, Zea mays
  misc_feature: Ceres CLONE 1406672-F
  misc_feature: Translation starting site: 181
  misc_feature: SWISSPROT Homolog: EC 2.7.8.23 Carboxyvinyl-carboxyphosphonate phosphorylmutase
  misc_feature: SWISSPROT Homolog: EC 4.1.3.30 Methylisocitrate lyase
  misc_feature (344)..(344): n is a, c, t, g, unknown, or other
  misc_feature (406)..(406): n is a, c, t, g, unknown, or other
  misc_feature (407)..(407): n is a, c, t, g, unknown, or other
  misc_feature (481)..(481): n is a, c, t, g, unknown, or other
  misc_feature (487)..(487): n is a, c, t, g, unknown, or other
  misc_feature (497)..(497): n is a, c, t, g, unknown, or other
  misc_feature (512)..(512): n is a, c, t, g, unknown, or other
  misc_feature (520)..(520): n is a, c, t, g, unknown, or other
  misc_feature (542)..(542): n is a, c, t, g, unknown, or other
  misc_feature (550)..(550): n is a, c, t, g, unknown, or other
  misc_feature (609)..(609): n is a, c, t, g, unknown, or other
  misc_feature (631)..(631): n is a, c, t, g, unknown, or other
aagctggagctccccgcggtggcggccgctctagaactagtggatcccccgggctgcaggaattcgcacgagaccattacctagaacatcctaatcgaaaatcgcctttccgatcccatccctctccagccaccttcctccgctcgccgtgcttctgcttcctccgccaccaccgccggcatggctgcgcgctgcccctacttcgccgtcgaggagtcctcccgcggcatccgctcgggggagtccccggccgcggcgctccgccggatcctcgcgacgcctggtgcgcaccaggcgccctgctgctacgacgcgctcggcgcgcgcctcgtcgagcgcgcggngtttccgatcgggttcatgggcggtttctgtgtttctgccgcgcgacttggcttgcctgatnngtgcctcatttcctatggagaaatggtagatcaggggcgtctcatcaatgaagctgtttcaatccagtgatggntgatgnagacaatggnttacggaactctatngatatcangagaaccataaaaggatatatncatgctgnttttgctggaattttatgctgagatcaggtggcacctaaagcatgtgaacatactgaangaaagaaagtcatatcaagggnagaaggctggcatggacataaaaactgcttgaaatgctaagaaagaaaagggcctctgactttgtaatggaacaaaggacagatttctcgccagctaattcctcg

SEQ ID NO: 30801 - DNA, 640 bp, Zea mays
  misc_feature: Ceres CLONE 1406677-F
  misc_feature: Encodes the peptide sequence at SEQ ID NO. 30802
aagctggagctccccgcggtggcggccgctctagaactagtggatcccccgggctgcaggaattcgcacgagaccattacctagaacatcctaatcgaaaattctcttgatcgctttgtcacttgaatccgtgcctgctctaacagagagcggatcagcggagacacgacgacgacgacgaagccaggctcaggctctgcaatggagcaggagccgcaccggcccatggagctgcccccgggcttccgcttccacccgaccgacgaggagctcatcacgcactacctggcccgcaaggccgccgacgcccgctttgccgcgctcgccgtcgccgaggccgacctcaacaagtgcgagccctgggacctgccatcgctggcgaggatgggggagaaggagtggtacttcttctgcctcaaggaccgcaagtacccgacggggctgaggaccaaccgggccacggaggccgggtactggaaggccacgggcaaggacagggacgtcttcaggggcaaggcgctcgtcggctccaagaagacgctcgtcttctacacggggagggcgcctaggggcgagaagtccggatgggtcatgcacgagtaccgcctccacgccaagctccatggccacggccacggca

SEQ ID NO: 30802 - protein, 146 aa, Zea mays
  misc_feature: Ceres CLONE 1406677-F
  misc_feature (11)..(137): Pfam Name: NAM Pfam Description: No apical meristem (NAM) protein
MEQEPHRPMELPPGFRFHPTDEELITHYLARKAADARFAALAVAEADLNKCEPWDLPSLARMGEKEWYFFCLKDRKYPTGLRTNRATEAGYWKATGKDRDVFRGKALVGSKKTLVFYTGRAPRGEKSGWVMHEYRLHAKLHGHGHG

SEQ ID NO: 30803 - DNA, 657 bp, Zea mays
  misc_feature: Ceres CLONE 1406680-F
  misc_feature: Encodes the peptide sequence at SEQ ID NO. 30804
  misc_feature (412)..(412): n is a, c, t, g, unknown, or other
  misc_feature (413)..(413): n is a, c, t, g, unknown, or other
  misc_feature (464)..(464): n is a, c, t, g, unknown, or other
  misc_feature (485)..(485): n is a, c, t, g, unknown, or other
  misc_feature (491)..(491): n is a, c, t, g, unknown, or other
  misc_feature (523)..(523): n is a, c, t, g, unknown, or other
  misc_feature (627)..(627): n is a, c, t, g, unknown, or other
aaagctggagctccccgcggtggcggccgctctagaactagtggatcccccgggctgcaggaattcgcacgagaccattacctagaacatcctaatcgaaaagctggtgcttctacggggcctggcgatttgaattcgagtggtgcgtgtatagagcgtgagagagagaaaagagagtggctcttgcgctctgcagtccagttcttgaatccagagctgcgattcgtgctcgcctgacgccgatgggccggagcctgagcccgctgctacggcaggagctggacaacctggacaaggacgctgacagccgccgcgccgccatgaaggcgctcaagtcgtacgccagacacctggactccaagtccatcccgcacttccctcgccgaggtctccgacacccacgcgggccggnngcccggcgccggcagcggcatgcccaccggggcggcgagttcaccttctgncctctaacgaggtggcttggncgcggntgcacggcccgcaacattcgtgcccgcagatncggcaacatcatggcccaccatcatgtgcacgtctccccttccagcggggggctgccttcccgctccacaggctggggttttcaaggggtggtgcccgccatcngcgcggcacgggatcgaccctccgcggccg

SEQ ID NO: 30804 - protein, 138 aa, Zea mays
  misc_feature: Ceres CLONE 1406680-F
  misc_feature (57)..(57): Xaa is any aa, unknown, or other
  misc_feature (74)..(74): Xaa is any aa, unknown, or other
  misc_feature (94)..(94): Xaa is any aa, unknown, or other
  misc_feature (129)..(129): Xaa is any aa, unknown, or other
MGRSLSPLLRQELDNLDKDADSRRAAMKALKSYARHLDSKSIPHFPRRGLRHPRGPXARRRQRHAHRGGEFTFXPLTRWLGRGCTARNIRARRXGNIMAHHHVHVSPSSGGLPSRSTGWGFQGVVPAIXAARDRPSAA

SEQ ID NO: 30805 - DNA, 634 bp, Zea mays
  misc_feature: Ceres CLONE 1406681-F
  misc_feature: Encodes the peptide sequence at SEQ ID NO. 30806
  misc_feature (440)..(440): n is a, c, t, g, unknown, or other
  misc_feature (483)..(483): n is a, c, t, g, unknown, or other
  misc_feature (634)..(634): n is a, c, t, g, unknown, or other
aagctggagctccccgcggtggcggccgctctagaactagtggatcccccgggctgcaggaattcgcacgagaccattacctagaacatcctaatcgaaaacactcgctttccggcgggcgactggcctaaaatcgcctcttgtttgtttgcttccgtcgtcccctctccacgtagagcacgcccccggaccaccttttataagcaccaaccatctggccttgccgcgccgattcgccacgaagccgcactgtgagagagggacgcggcctgttgtcccggcttttagacgcaacttccatcgctgcgaagctatccattcgtgttcgtcatggccgccagcgtcaccgtggaaaacctcaaccccaaggtcttaaaatgtgagtatgcagtccgtggggagattgtcatccatgctcagcgcctgcagcaacaactacnaacacaaccagggtctcttccttttgatgagatcctctattgncacattgggaatccccaatctcttggtcagcaacctgtgacattcttcagggagggtcttgctctttgtgatcatccgtgcctcttggaaaaagaggaacccaatcattggtcagtgctgatgcatttctcgagcaagcagattctgcacn

SEQ ID NO: 30806 - protein, 101 aa, Zea mays
  misc_feature: Ceres CLONE 1406681-F
  misc_feature: SWISSPROT Homolog: EC 2.6.1.2 Alanine transaminase
  misc_feature (37)..(37): Xaa is any aa, unknown, or other
  misc_feature (51)..(51): Xaa is any aa, unknown, or other
MAASVTVENLNPKVLKCEYAVRGEIVIHAQRLQQQLXTQPGSLPFDEILYXHIGNPQSLGQQPVTFFREGLALCDHPCLLEKEEPNHWSVLMHFSSKQILH

SEQ ID NO: 30807 - DNA, 710 bp, Zea mays
  misc_feature: Ceres CLONE 1406684-F
  misc_feature: Encodes the peptide sequence at SEQ ID NO. 30808
  misc_feature (659)..(659): n is a, c, t, g, unknown, or other
ggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgcgccgccacgagggccagccgtgggagacccaggagtgcatgaggcggtgccgccgccgcggactggccgtcgacatggagcaagagtacggtcgcggcagcgagagcgcgggcagtgccgggagaggtgcgagcgcaccaccgcggngactggtgggagagcagcgctgctgtgatgaaaaaaaacccggcggaaggg

SEQ ID NO: 30808 - protein, 167 aa, Zea mays
  misc_feature: Ceres CLONE 1406684-F
  misc_feature (151)..(151): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRRHEGQPWETQECMRRCRRRGLAVDMEQEYGRGSESAGSAGRGASAPPRXLVGEQRCCDEKKPGGR

SEQ ID NO: 30809 - DNA, 699 bp, Zea mays
  misc_feature: Ceres CLONE 1406687-F
  misc_feature (637)..(637): n is a, c, t, g, unknown, or other
  misc_feature (699)..(699): n is a, c, t, g, unknown, or other
ccccgcggtggcggccgctctataactagtggatcccccgggctgcaggaattcgcacgagaccattacctagaacatcctaatcaaaaatccctgcgctcaacgccgcaccgaacctgactcaggcactcaccgctataggcggcgaccatggcggtgggcacgccggcggtgacttccgccagaaggtatggagcatgacgggcggaccctactgccgcccggtccactggcgccgtaacaccgccatcgccatgttcggcgtcttcctcatctgcattcccatagccatgaagtccgccgagctcgagcaacgcccgcatcacccagtccggccaatcccatctcaactgtggtgccaaaaactttggcaaggaatactgaaaggaccttccaagtagcatgaagccgcggaccaccttgctttttgcccttcttttgaattccctttcccccttttggggccaaaccagggttatatgggaaaaataaaaaataaaaatatggggcctgcaaaaataaaaaaaccccggggagtttaaaaaaaacccccccagaaggaaataaaattatcggtcggcccccaaaaaaaaatttgtgggggggagaaaaaacttctccccgccccccggggggnagagtgttttttttttcttttcttctcgtcgcccacaaacaaaaaaaaaaaaactccttttn

SEQ ID NO: 30810 - DNA, 710 bp, Zea mays
  misc_feature: Ceres CLONE 1406690-F
  misc_feature: Encodes the peptide sequence at SEQ ID NO. 30811
  misc_feature (61)..(61): n is a, c, t, g, unknown, or other
tcatttgtgaccttattaacggcggccgctctagttcagtggatcccccgggctgcagganatcccacgagaccattacctagaacatcctaatccaaaaacggtaaaggcacaactaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggttgtgtggtgtccaagctacacacgggatgctactaactagctgcaggcaagggcgaggaatggcaagcctttcatgtgctcgggcgtattgtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagagcccgcgccgtcgccatcctcagctcgtcgggctccaccagcagccgcgacagcgcggccttgtagctgtccagcgccgcgtcccactcggggtccgcgggtcctagtcgggccgcccttgagcgacgccgcgtccagccgtcaaagcttccgttggcaacaagtggaaatcccaacagcgccggggaaac

SEQ ID NO: 30811 - protein, 108 aa, Zea mays
  misc_feature: Ceres CLONE 1406690-F
MLLTSCRQGRGMASLSCARAYCVVRSGALPAKLLLCASCCFPTAAPVADGEVQVLACRQHLHRLPRRQDLRRQSPRRRHPQLVGLHQQPRQRGLVAVQRRVPLGVRGS

SEQ ID NO: 30812 - DNA, 635 bp, Zea mays
  misc_feature: Ceres CLONE 1406694-F
  misc_feature: Encodes the peptide sequence at SEQ ID NO. 30813
  misc_feature (487)..(487): n is a, c, t, g, unknown, or other
  misc_feature (550)..(550): n is a, c, t, g, unknown, or other
  misc_feature (553)..(553): n is a, c, t, g, unknown, or other
  misc_feature (602)..(602): n is a, c, t, g, unknown, or other
aaagctggagctccccgcggtggcggccgctctagaactagtggatcccccgggctgcaggaattcgcacgagaccattacctagaacatcctaatcgaaaaccccgtccctccactcctcccgtcgagcacttggcactgccaatggcggcagccgcccacaccccttcgatgcgtgcaagccgcctcctttcctcctgagatcgacgcacctcctcctctcgtactccattcccgctccaagtttgtttcttcggcaccgagccatcgcacggccgcccccgcatctcgtcctgctctcaggtccttggcctccgccgttcttcgacaggggcgcgacccggtgcccactccgcgaaatccgagtccctcgtgcagctccggagggtggaagagatccatcaggcggtgagcggtaggaggcgcccgtacaactgagggggcggccaatggcggccgtggcaggcccactctgcacgtggctcgntgccgcgtgcttgtctgcggcttgcgacgcaaaagagtacaagcataagcattgctgccccgncgnaagcgccgctgggggcggcgtcatgctcggccagcgcccgcgcctcggngcggcgggtcgcggcttggcgcgctctggaatg

SEQ ID NO: 30813 - protein, 62 aa, Zea mays
  misc_feature: Ceres CLONE 1406694-F
  misc_feature (13)..(13): Xaa is any aa, unknown, or other
  misc_feature (34)..(34): Xaa is any aa, unknown, or other
  misc_feature (35)..(35): Xaa is any aa, unknown, or other
MAAVAGPLCTWLXAACLSAACDAKEYKHKHCCPXXSAAGGGVMLGQRPRLGAAGRGLARSGM

SEQ ID NO: 30814 - DNA, 721 bp, Zea mays
  misc_feature: Ceres CLONE 1406704-F
  misc_feature: Encodes the peptide sequence at SEQ ID NO. 30815
  misc_feature (486)..(486): n is a, c, t, g, unknown, or other
  misc_feature (498)..(498): n is a, c, t, g, unknown, or other
aagctggagctccccgcggtggcggccgctctagaactagtggatcccccgggctgcaggaattcgcacgagaccattacctagaacatcctaatcgaaaaaaaacggtcaagggcctagctatttgttaactctggcccctcacctgctccccttctgtccagcccacgggagggcgactagggttaggggcgaccggaggtccccgcgcctgcccaatccacccatcccttccgttcaagccgccggagctcccaggccgctggtgtcgaagccgtcgccccttccttccaggcccgcctcctctctgtccgttctgtcttggtcgccgaagctcaagaccacagtgggcaggaagttctccaatcttccagccaaacacaattcatcagtcagatacactttggaccgaggaattattcagaatcactcccacgagaggatcagctttcgaagctagagaagcagagctctaccaaacagggncaggacgtctcntcagatccccagttcagtaactggcctaactgtaggagaaggagagagagatggagcacgccggcgcttaaaggcgacgttccccgacgatggcgaacgagcattgccctggaacaacagtctggagaagcaggcagagcagaatgcctgcgctgggtgccccaaccagcagatttgcgccaccgcccccaaggggcctgaatcccgaggtggttgctaatgg

SEQ ID NO: 30815 - protein, 44 aa, Zea mays
  misc_feature: Ceres CLONE 1406704-F
MANEHCPGTTVWRSRQSRMPALGAPTSRFAPPPPRGLNPEVVAN

SEQ ID NO: 30816 - DNA, 727 bp, Zea mays
  misc_feature: Ceres CLONE 1406705-F
  misc_feature: Encodes the peptide sequence at SEQ ID NO. 30817
  misc_feature (569)..(569): n is a, c, t, g, unknown, or other
  misc_feature (621)..(621): n is a, c, t, g, unknown, or other
  misc_feature (709)..(709): n is a, c, t, g, unknown, or other
aagctggagctccccgcggtggcggccgctctagaactagtggatcccccgggctgcaggaattcgcacgagaccattacctagaacatcctaatcgaaaactctatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagcttgagcgtgccgctgcccgcagcagcagcctgtacgagccagctctgatgcagcagcagcagcagctgctggncagcccaaggtctcaccccatgggccatatgatggcgcaaaacatgccgggncatggggggactctaccagtaccagttgcccagttaccgaccaacccctgggggggttcccgttgccattccgcccaaaaacggattnagggaattggggaaatcc

SEQ ID NO: 30817 - protein, 186 aa, Zea mays
  misc_feature: Ceres CLONE 1406705-F
  misc_feature (134)..(134): Xaa is any aa, unknown, or other
  misc_feature (181)..(181): Xaa is any aa, unknown, or other
MKMVIVLVVCLALSAASASAMQMPCPCAGLQGLYGAGAGLTTMMGAGGLYPYAEYLRQPQCSPLAAAPYYAGCGQPSAMFQPLRQQCCQQQMRMMDVQSVAQQLQMMMQLERAAARSSSLYEPALMQQQQQLLXSPRSHPMGHMMAQNMPGHGGTLPVPVAQLPTNPWGGSRCHSAQKRIXGIGEI

SEQ ID NO: 30818 - DNA, 636 bp, Zea mays
  misc_feature: Ceres CLONE 1406707-F
  misc_feature: Encodes the peptide sequence at SEQ ID NO. 30819
  misc_feature (473)..(473): n is a, c, t, g, unknown, or other
  misc_feature (480)..(480): n is a, c, t, g, unknown, or other
  misc_feature (488)..(488): n is a, c, t, g, unknown, or other
  misc_feature (551)..(551): n is a, c, t, g, unknown, or other
  misc_feature (587)..(587): n is a, c, t, g, unknown, or other
  misc_feature (619)..(619): n is a, c, t, g, unknown, or other
  misc_feature (622)..(622): n is a, c, t, g, unknown, or other
  misc_feature (624)..(624): n is a, c, t, g, unknown, or other
  misc_feature (628)..(628): n is a, c, t, g, unknown, or other
cgctctagaactagtggatcccccgggctgcaggaattcgcacgagaccattacctagaacatcctaatcgaaaagcgtttgttctcctgttcatcacccgtgcgtgctctctctctctctctctctctctctcgtgcggcaactgcgaggccgccgacgcccgacggcagggtgcccaggccttcttcggtcccatcgcgaggccatagttgcatcattcgcctgagacgactgcccagcaccaggactgatctcctcactaggggcgtagaggtgaagagaagaacttgacaatgagcagcataggcacaggttacgatctgtctgtcaccaccttctccccagatggtcgcgtcttccaggtcgaatatgctaccaaggccgtcgacaacagcgggactgttgttgggatcaagtgcaaagatggcattgtcctgggtgttgagaagctggtaacctcaaagatgatgcntggaggntcaaaccnggagatccattcagtgcaccggcactctgacttggctggtgctggtttagcagcagatggcangcaaattgtttcaggacgaagtcagaagctgccagntatgaaaaagtctatggagaacccattcctgntangnattnggctgatc

SEQ ID NO: 30819 - protein, 114 aa, Zea mays
  misc_feature: Ceres CLONE 1406707-F
  misc_feature: SWISSPROT Homolog: EC 3.4.25.1 Proteasome endopeptidase complex
  misc_feature (60)..(60): Xaa is any aa, unknown, or other
  misc_feature (65)..(65): Xaa is any aa, unknown, or other
  misc_feature (86)..(86): Xaa is any aa, unknown, or other
  misc_feature (98)..(98): Xaa is any aa, unknown, or other
  misc_feature (109)..(109): Xaa is any aa, unknown, or other
  misc_feature (110)..(110): Xaa is any aa, unknown, or other
  misc_feature (112)..(112): Xaa is any aa, unknown, or other
MSSIGTGYDLSVTTFSPDGRVFQVEYATKAVDNSGTVVGIKCKDGIVLGVEKLVTSKMMXGGSNXEIHSVHRHSDLAGAGLAADGXQIVSGRSQKLPXMKKSMENPFLXXIXLI

SEQ ID NO: 30820 - DNA, 620 bp, Zea mays
  misc_feature: Ceres CLONE 1406708-F
  misc_feature: Translation starting site: 185
  misc_feature: SWISSPROT Homolog: EC 3.5.4.6 AMP deaminase
  misc_feature (311)..(311): n is a, c, t, g, unknown, or other
  misc_feature (360)..(360): n is a, c, t, g, unknown, or other
tggagctccccgcggtggcggccgctctagaactagtggatcccccgggctgcaggaattcgcacgagaccattacctagaacatcctaatcaaaaattttttctgcattcgacgccgccgcaggcccgcagccagctcgagcccaaaggagagaacccaggttggcggcggcgctccgcggcgatggactccccctacgctctccacctcgccatcgccgcgctcgtcggcgcctccttcgccgccgcctccgcctactacatgcatcgcaagaccctcgaccagcttctccgtttcgcccgcgaccagnagcgccggcgcaaccgcctccctcccgaagcgacgaactggaggacggngaagagccccctccggcggagtgggatcatgatcgccgcaccctgcccatcccggcggggctcccgccgctccacaccggccgagagggtaggccagttgttttctccaggtcgactaagagagttggacctattgttagaacgactacacccaaatcctctgtccccactatcagtgattttgataaaatggagattcagatgacgaggaagattctgtcccagatgccaagatgatactgctacttgaccccaatggg

SEQ ID NO: 30821 - DNA, 712 bp, Zea mays
  misc_feature: Ceres CLONE 1406713-F
  misc_feature: Encodes the peptide sequence at SEQ ID NO. 30822
  misc_feature (707)..(707): n is a, c, t, g, unknown, or other
  misc_feature (712)..(712): n is a, c, t, g, unknown, or other
ggagctccccgcggtggcggccgctctagaactagtggatcccccgggctgcaggaattcgcacgagaccattacctagaacatcctaatcgaaaatatttcctgaggctatggctgatgcatcagaagacaatgaaatagcgattgaacttgacacctctgtggaaattgacgctaaaggcagttcagctggacataacttgaactttgaacccagaaaagatacaagtcatcatgagtctgccagcaacatctgtgctgatgatcagataaaaacagaacgtcagccgcaatgttttgcacgagaaaatacagcatctaccaaggttactactcattcagtgaattcagatagtgaacacaacagctacgagcaagtcatggatactgatcctggtacaagccatagcacagggttgatgtttgaggtgggcgctgcagaagaagaacttgacatgctcctcgattcatttggcgtaactcacctttccagctccaacttggacgaaccatttgagcccgtttcaactttgtgagagatcagtaggtccaatgagaaggttggacctagcttgtcttccggaccacctttgcttgcacctctcgacgatgctctagatgacttgcttttagagacttctcatactgctgcacagaacgaatgctttgctacgcaatgtataacttactcaaccgacggctgattntgggn

SEQ ID NO: 30822 - protein, 141 aa, Zea mays
  misc_feature: Ceres CLONE 1406713-F
MADASEDNEIAIELDTSVEIDAKGSSAGHNLNFEPRKDTSHHESASNICADDQIKTERQPQCFARENTASTKVTTHSVNSDSEHNSYEQVMDTDPGTSHSTGLMFEVGAAEEELDMLLDSFGVTHLSSSNLDEPFEPVSTL

SEQ ID NO: 30823 - DNA, 735 bp, Zea mays
  misc_feature: Ceres CLONE 1406723-F
  misc_feature: Encodes the peptide sequence at SEQ ID NO. 30824
  misc_feature (674)..(674): n is a, c, t, g, unknown, or other
ggagctccccgcggtggcggccgctctagaactagtggatcccccgggctgcaggaattcgcacgagaccattacctagaacatcctaatcgaaaaatcttcttcctcgtgcgcgtgcagccgccttgcttgcggccctgcctctctcctctcctgctctcccaccggccaccgtcgccggccgccaccgtcgccgccatgcctttccgattccagttcccatggctcaagaacccaactacaaacggcggcacctccaacatagacactaaccctagcccccgcttccccaaccccttcctccctatccaagcccatgtcacctccttcttctcctccttcccccgggcgctcccgccgccgccgccctgggcgcgcatcacctcgccagcctccacctccggggccctacctacctctgagatcgaggagcggctcgccggggtgcccgtgtacgcgctcgccaacgccgcccaggagttcgtgcttgtgtcgtccacacgcgtgggagggcaagggggcgagagcgtgagtccaacgccggcgctcgggctgctctgcttccggaggaagatgctgacgcgctgctggagcagatggatggcgatatgcgcgccggctctggtgtcgttcctgtcgcgctgaacaaggttatcccaatgaaatcggatggntgtggcgtttagattcctcccctgatcatctcaggtggctaatgcaaataagttgatgcaa

SEQ ID NO: 30824 - protein, 148 aa, Zea mays
  misc_feature: Ceres CLONE 1406723-F
MPFRFQFPWLKNPTTNGGTSNIDTNPSPRFPNPFLPIQAHVTSFFSSFPRALPPPPPWARITSPASTSGALPTSEIEERLAGVPVYALANAAQEFVLVSSTRVGGQGGESVSPTPALGLLCFRRKMLTRCWSRWMAICAPALVSFLSR

SEQ ID NO: 30825 - DNA, 634 bp, Zea mays
  misc_feature: Ceres CLONE 1406724-F
  misc_feature: Encodes the peptide sequence at SEQ ID NO. 30826
  misc_feature (409)..(409): n is a, c, t, g, unknown, or other
  misc_feature (435)..(435): n is a, c, t, g, unknown, or other
  misc_feature (483)..(483): n is a, c, t, g, unknown, or other
  misc_feature (485)..(485): n is a, c, t, g, unknown, or other
  misc_feature (486)..(486): n is a, c, t, g, unknown, or other
  misc_feature (490)..(490): n is a, c, t, g, unknown, or other
  misc_feature (536)..(536): n is a, c, t, g, unknown, or other
tggagctccccgcggtggcggccgctctagaactagtggatcccccgggctgcaggaattcgcacgagaccattacctagaacatcctaatcgaaaaacacgttcgacgaaatgccgccgcgagacctcttcatcgtcaactgagattcgcctcgcatcttctcggattccttccccaactttcgtccccatcagcggacctactcgagatcgacgagacacgtcggagcccggttcctaggcgtcccagcgcccgactggatctcctggctcgggccgccttgatggtccctggggtcggtccggggtggagttcgaggcgatgagcaggcttgcgtcggggctccagcgcttgcggaggtcgtcgtcgcagtgggaggtgctttggtcggcgctcgcgtcatgcggnctagtgcttttctcgcagctcgccgntggcgatggttccccgtctcttccctttcctctccctcctcgcatgtncnncatnggggggggttggtgttcatcgcggctatcgtgctcggcggcttggntgaaggagtttcatcgggggtgggcggcgtcggccccgctcttcgtgctcttcacatccttctaatggtggggcggttacgtattcgtaatcgggagg

SEQ ID NO: 30826 - protein, 92 aa, Zea mays
  misc_feature: Ceres CLONE 1406724-F
  misc_feature (38)..(38): Xaa is any aa, unknown, or other
  misc_feature (54)..(54): Xaa is any aa, unknown, or other
  misc_feature (55)..(55): Xaa is any aa, unknown, or other
  misc_feature (56)..(56): Xaa is any aa, unknown, or other
  misc_feature (72)..(72): Xaa is any aa, unknown, or other
MSRLASGLQRLRRSSSQWEVLWSALASCGLVLFSQLAXGDGSPSLPFPLPPRMXXXGGGWCSSRLSCSAAWXKEFHRGWAASAPLFVLFTSF

SEQ ID NO: 30827 - DNA, 622 bp, Zea mays
  misc_feature: Ceres CLONE 1406726-F
  misc_feature (585)..(585): n is a, c, t, g, unknown, or other
  misc_feature (587)..(587): n is a, c, t, g, unknown, or other
  misc_feature (592)..(592): n is a, c, t, g, unknown, or other
tccccgcggtggcggccgctctatacctagtggatcccccgggctgcaggaattcgcacgagaccattacctagaacatcctaatcgaaaaatcgcttcagctcggcgtcttcacaaacgccggcgcaaactctcgcccgagcccgacagatctctaattccccataccgtccaccggtcgaccttcacgccagtctcggtctcttccgaaggcgtcgcgcgcggttgtttgagaggagaggaggaagatgagggagtgcattctccgtcacatcggcaggccgcatccaagtcgcacgctgctgggactttatgctcgagacgcatcagctgatggcagtgctggaataaaccgggaactacgatgatgctcagacttcttaacaaatggggtgggaaaccgtccccgggaatctctctgattaaaaccccgggatcaataggggggactgggaaaaaccgcccgtttttcccccggggggttcttcaatgggaaaagggagagacccccaaaaaatttttccccgggggggccacaaaaaaattttgtggaaagaaaatatttttttttttgggggggttttncnccccnccacccccccggggtttgtttttttgaaaa

SEQ ID NO: 30828 - DNA, 630 bp, Zea mays
  misc_feature: Ceres CLONE 1406730-F
  misc_feature: Encodes the peptide sequence at SEQ ID NO. 30829
  misc_feature (394)..(394): n is a, c, t, g, unknown, or other
  misc_feature (400)..(400): n is a, c, t, g, unknown, or other
  misc_feature (401)..(401): n is a, c, t, g, unknown, or other
  misc_feature (435)..(435): n is a, c, t, g, unknown, or other
  misc_feature (436)..(436): n is a, c, t, g, unknown, or other
  misc_feature (443)..(443): n is a, c, t, g, unknown, or other
  misc_feature (448)..(448): n is a, c, t, g, unknown, or other
  misc_feature (456)..(456): n is a, c, t, g, unknown, or other
  misc_feature (459)..(459): n is a, c, t, g, unknown, or other
aagctggagctccccgcggtggcggccgctctagaactagtggatcccccggctgcaggaattcgcacgagaccattacctagaacatcctaatcgaaaactctcattccagaggactccgcgtcgtcaggcccgcttcgcgtgcgacgccggcatatagggtttcgccggcgccggcgatggacccaccccccgtgagccccgatcgctgggggcccagtcagggctctggcgtcgggccctccggcctccgccgatatggcctcaatttctccgcctccagcctcctccaggcccccatcgcggccctccttgagtactccggcgtagtccagtccggccctgccctggcggcgcaccacccgtccgcggggcccctcgtcgccgttgtcgncgtcgnnaggtcgatggtcttctctccgctgcgccgctggnnaacgggnaaagntttccatncgnattcaggggcggcccagcggacacgaggccacgggcgggccgggatgccgggactcgttcggaggatttgatcgaggggaccgcccgtctctgaggttgaccaggctccttggggggaaagggtgggaggccctacggatgggaagcaaaagggggggggggcccgcacct

SEQ ID NO: 30829 - protein, 116 aa, Zea mays
  misc_feature: Ceres CLONE 1406730-F
  misc_feature (72)..(72): Xaa is any aa, unknown, or other
  misc_feature (74)..(74): Xaa is any aa, unknown, or other
  misc_feature (86)..(86): Xaa is any aa, unknown, or other
  misc_feature (90)..(90): Xaa is any aa, unknown, or other
  misc_feature (93)..(93): Xaa is any aa, unknown, or other
  misc_feature (94)..(94): Xaa is any aa, unknown, or other
MDPPPVSPDRWGPSQGSGVGPSGLRRYGLNFSASSLLQAPIAALLEYSGVVQSGPALAAHHPSAGPLVAVVXVXRSMVFSPLRRWXTGKXFHXXSGAAQRTRGHGRAGMPGLVRRI

SEQ ID NO: 30830 - DNA, 631 bp, Zea mays
  misc_feature: Ceres CLONE 1406731-F
  misc_feature (552)..(552): n is a, c, t, g, unknown, or other
aagctggagctccccgcggtggcggccgctctagaactagtggatcccccgggctgcaggaattcgcacgagaccattacctagaacatcctaatcgaaaagccgcaacccctctctcattttcttcctcgtctacacctccttctctcctcctcgatacattcgagcacgcccggacgcggtcagaagggagaaagcagcaagcggcgccgggttccccctcccttcgtcgcccccgatcgacgccgatcggggccgactgctcgtgggggacgccgaccgaagcccgggcggcgctgcttcaatatacggaagcagtttctagttttcttcagttcgccgctgcagtttctagtttccagcggttcccaccagttgtctaataacttattgttgttgtacgtgaggttgcttttgtcgtatttgccaggttgcttttgttgtatttgccagttgacacaacttggtgttgtaatcattgctatttttgggtcatgacttggttttattggaatcaatgggctgccaaggttcactaaatctttgatgcancataataggatcaccatgctgtcttcttcagagcttggccagtttggttctagttctagcaaccctgtcatgaatcagg

SEQ ID NO: 30831 - DNA, 739 bp, Zea mays
  misc_feature: Ceres CLONE 1406737-F
  misc_feature: Encodes the peptide sequence at SEQ ID NO. 30832
  misc_feature (330)..(330): n is a, c, t, g, unknown, or other
  misc_feature (348)..(348): n is a, c, t, g, unknown, or other
  misc_feature (400)..(400): n is a, c, t, g, unknown, or other
  misc_feature (406)..(406): n is a, c, t, g, unknown, or other
  misc_feature (407)..(407): n is a, c, t, g, unknown, or other
  misc_feature (486)..(486): n is a, c, t, g, unknown, or other
aaagctggagctccccgcggtggcggccgctctagaactagtggatcccccgggctgcaggaattcgcacgagaccattacctagaacatcctaatcgaaaaacaaaaccctaccacatcccagcgctggcatctcacggggaggactagtagtatgctcgccgccgcctggaggctgtcgcagcgagccgtcacgtctcctctcctaggcatcgggcgatcccaaatccgaaaccctttctccaccatggcgtctctctcgccggcagccgcctcgccgaagaggctgagggtctactcgtctgccgcggccgacggtgacggcgcggngagcggcaagcgcgtggngacccacaaacggagcttccactgcgatgaggcgctcggttgcttcctcatnccgctnncactccagtttcgccgggccgacgtcgtccgcacccgcgattcccagatccttgatacattggatgctggtcttgatgntgggggtgtctatgatcccagtcggcatcgctatgatcatcaccagaagggctccagggaggtttttgggacatgaattcaccccaaaactaacagggcttggacttgggtacaaccactccggaaaggaaaaattgctaaggactttggggttaaggggggccttggaaatgtctcctgttggatttccggaaatttaaaagtttttgggggggcctttgggggttttgcaggggatcttcccttttccccc

SEQ ID NO: 30832 - protein, 104 aa, Zea mays
  misc_feature: Ceres CLONE 1406737-F
  misc_feature (28)..(28): Xaa is any aa, unknown, or other
  misc_feature (34)..(34): Xaa is any aa, unknown, or other
  misc_feature (51)..(51): Xaa is any aa, unknown, or other
  misc_feature (54)..(54): Xaa is any aa, unknown, or other
  misc_feature (80)..(80): Xaa is any aa, unknown, or other
MASLSPAAASPKRLRVYSSAAADGDGAXSGKRVXTHKRSFHCDEALGCFLXPLXLQFRRADVVRTRDSQILDTLDAGLDXGGVYDPSRHRYDHHQKGSREVFGT

SEQ ID NO: 30833 - DNA, 666 bp, Zea mays
  misc_feature: Ceres CLONE 1406739-F
  misc_feature: Encodes the peptide sequence at SEQ ID NO. 30834
  misc_feature (566)..(566): n is a, c, t, g, unknown, or other
gaccttacctagaaatcctaatcgaaaaaactcccccggccgtcctgctcgccggcttctggctggcccctgcatccgcccagggaatcgattcgttcatccaagtgaaggcaaccagactccaggatggagttcaaagccggcgttttcaccgtggcaatgctagccatcgtcgtgctctccacaccagcagccccgcagaagcccaagagccctcccgctccgcgatccccagtcgtcctggcgccggcgccagcgcccgcaccggcggcgccgcaccacgtggacctcgcggacctcctcagcgtggccgggccgttccacacgttcctggactacctgcagaagaccggcgtcatcgagaccttccagagccaggcgaacgacacgaagcggggcggcatcaccgtcttcgtgcccaaggactcggcgttcgcggcgctgaagcagaccacgttcgccaacctcacccaggaccagctcaagtcgctgctgctgtgccacgcgctgcccaagtactactcgctggccgagttcgaccggctgagcgcgctcggcccggtgtncaccctcgccgggtcgcagaacacgctgaacctccactacgacttgggcacggtccgcgtgaagtccatggtggtccgaccccaagatcagcaggagcgg

SEQ ID NO: 30834 - protein, 180 aa, Zea mays
  misc_feature: Ceres CLONE 1406739-F
  misc_feature (64)..(174): Pfam Name: Fasciclin Pfam Description: Fasciclin domain
  misc_feature (147)..(147): Xaa is any aa, unknown, or other
MEFKAGVFTVAMLAIVVLSTPAAPQKPKSPPAPRSPVVLAPAPAPAPAAPHHVDLADLLSVAGPFHTFLDYLQKTGVIETFQSQANDTKRGGITVFVPKDSAFAALKQTTFANLTQDQLKSLLLCHALPKYYSLAEFDRLSALGPVXTLAGSQNTLNLHYDLGTVRVKSMVVRPQDQQER

SEQ ID NO: 30835 - DNA, 676 bp, Zea mays
  misc_feature: Ceres CLONE 1406746-F
  misc_feature: Encodes the peptide sequence at SEQ ID NO. 30836
gctcatatctagtggatcccccgggctgcaggaattcgcacgagaccattacctagaacatcctaatcgaaaaatccgctccccgccttccgcttccctaccccccgcatcacctaccaacgccgacaccatgggggccttcgcgaaggaggagcaccagttcctagccgagctcggcctcgcgcagagcaacccaggcgcgttcgcatgcggtgcgtggggcgcctcaggtccaccgtcacctccacgaggccgatcaacaatcagggtcctcgaagaggtgggggaggcgtccgtgcccgactacaaggaggggatgggcgcctggctttcgatgccgcccccacgtgggggggggggtgccctggttccaaaggggaggaaaggattgttaggcaaaatcggggggatggtacgtgagagccaaggctcccacccccctgtggggggggttgggggtagcttgaggatgggtgcaaaacttcttccccggaccggcccccccgcggggggtccgagcgaaactcctgcggcatggggcggaactattggtggggggccccttacggtcgcgcaacttaaaagcgggactcccttcttgccgcgccggcgaacccccccaacaccccctatggctccatttctaccgttggaggaaaccccccccacgggcgcg

SEQ ID NO: 30836 - protein, 182 aa, Zea mays
  misc_feature: Ceres CLONE 1406746-F
  misc_feature: SWISSPROT Homolog: EC 1.2.1.3 Aldehyde dehydrogenase (NAD(+))
MGAFAKEEHQFLAELGLAQSNPGAFACGAWGASGPPSPPRGRSTIRVLEEVGEASVPDYKEGMGAWLSMPPPRGGGGALVPKGRKGLLGKIGGMVRESQGSHPPVGGVGGSLRMGAKLLPRTGPPAGGPSETPAAWGGTIGGGPLTVAQLKSGTPFLPRRRTPPTPPMAPFLPLEETPPTGA

SEQ ID NO: 30837 - DNA, 645 bp, Zea mays
  misc_feature: Ceres CLONE 1406747-F
  misc_feature (611)..(611): n is a, c, t, g, unknown, or other
aaagctggagctccccgcggtggcggccgctctagaactagtggatcccccgggctgcaggaattcgcacgagaccattacctagaacatcctaatcaaaaatcgagctgagctgagcatcatggggtagtgtgtgtgtgaggcgatagagaagctagtgctcataaccaaccaccactcagtcctcctcctctaccctttcccttccgccgcgttcctacttggtcctagagggagagagatctcgaactccaagggcgcatgctccggttgctagctacgatgccgtgtgcgtagctgcggcagcccttgatcgatcaatcgatcgcttgtgcggaatgagccggatcgagtggagtcagctagctagatactccgtgggcggcgtcgtcgttggacgtacgccagaagagggagctagagaagaataccgtacagctgctatcaacatgggagctgcctcgtctgcccacctgttcggactcggcgacgggcagatgcagatgcagccgcagcagcagcgggcgccgcctcctcctcttgagaaaagccgggcgcgccgacgctcaagaagaagcggaaccaacctggtaacccaaaccctgacgcgnaggtgatcgcgcttcctccgagacgctgatgcga

SEQ ID NO: 30838 - DNA, 620 bp, Zea mays
  misc_feature: Ceres CLONE 1406749-F
  misc_feature: Encodes the peptide sequence at SEQ ID NO. 30839
  misc_feature (198)..(198): n is a, c, t, g, unknown, or other
  misc_feature (284)..(284): n is a, c, t, g, unknown, or other
  misc_feature (402)..(402): n is a, c, t, g, unknown, or other
  misc_feature (405)..(405): n is a, c, t, g, unknown, or other
  misc_feature (600)..(600): n is a, c, t, g, unknown, or other
agagtggagctccccgcggtggcggccgctctagaactagtggatcccccgggctgcaggaattcgcacgagaccattacctagaactcctaatcgaaaaaaatccaagtaaggaaatccccgatgatctcctgcgcgtcgcagcgccagccactcgattagtggagtccaccaaccaagcacgcgtccctccccgtnccagatcccatcccgcgggagccggtcagtccgatccatctccagtacccagcccgtcacccgccttccccgttcgctctcgtcgncgcgcgatggagggtctcatcaaggggttggtccacgtggccatccacgccgtggaggacgccgtgagggaaagggaccacggccgcgccgacgacgacgaggtgcccaggaagaggnccncccaaagctccgatccagatgacgacggggaagaggacgcgacgaccgatcgcggtcgaggtgggccgaggtcttctccgagcaaaagggcaggatccggacgagcgccgggacatcgaagctcggggcgggacatcgccatgagaagagggattaagagggtttgaaaaagggccaatggtcgaaacaacacancaaccagcaggccggagacc

SEQ ID NO: 30839 - protein, 93 aa, Zea mays
  misc_feature: Ceres CLONE 1406749-F
  misc_feature (38)..(38): Xaa is any aa, unknown, or other
  misc_feature (39)..(39): Xaa is any aa, unknown, or other
MEGLIKGLVHVAIHAVEDAVRERDHGRADDDEVPRKRXXQSSDPDDDGEEDATTDRGRGGPRSSPSKRAGSGRAPGHRSSGRDIAMRRGIKRV

SEQ ID NO: 30840 - DNA, 597 bp, Zea mays
  misc_feature: Ceres CLONE 1406750-F
  misc_feature (208)..(208): n is a, c, t, g, unknown, or other
  misc_feature (217)..(217): n is a, c, t, g, unknown, or other
  misc_feature (226)..(226): n is a, c, t, g, unknown, or other
  misc_feature (227)..(227): n is a, c, t, g, unknown, or other
  misc_feature (305)..(305): n is a, c, t, g, unknown, or other
  misc_feature (361)..(361): n is a, c, t, g, unknown, or other
  misc_feature (390)..(390): n is a, c, t, g, unknown, or other
  misc_feature (404)..(404): n is a, c, t, g, unknown, or other
tggagctccccgcggtggcggccgctctagaactagtggatcccccgggctgcaggaattcgcacgagaccattacctagaacatcctaatcgaaaaactctcgctttcttctgtctcgcctcgccctcgcctttgttgatcttttcctttctcgcgttcccctcgccttcctcttcctcccccacacccaccgggtcgccgcccccngtcgccccnggcctcctnncggtccagagacgagggggtccgcgcccgttccgacgccacaccgcaaccgcatcacatcaccgcctgctcccaccgntcatccgcccctcctcgatcgcgctccccggatcgctggtacctcccgcgcgcggntccgaccctcatcttctccatcgactggnatcggcagcggcgncgtgttcccggcaaccttcgaaagggtaatcatcgccagactttttggaagctgtgtttggggggggacccgggtgaagaagccagttactgcaaaggttaaacatttccgttgccgaagggatggccgaaaggaatcaacttcccctgactttatcgggggccgggggggggcccattaaagggtgggcctg

SEQ ID NO: 30841 - DNA, 647 bp, Zea mays
  misc_feature: Ceres CLONE 1406751-F
  misc_feature: Encodes the peptide sequence at SEQ ID NO. 30842
  misc_feature (339)..(339): n is a, c, t, g, unknown, or other
gctcagaactagtggatcccccgggctgcaggaattcgcacgagaccattacctagaacatcctaatcgaaaactctctcgctctctcgtggcttcctggcggcgactgggcgagcgccgccgccctcttcgtcgggcccgcccttcaccggcgacgtgcatccctccggagaagaatattgcgctcacataactgaataactgatattaggatgagtctctgtacaatagcacgacggctatgtctttcaaaaccatcctctggcagtcgtctttcagcaatttgggctcatctatacagcactgaggctgcaaaggacatgggtgctaagaagtacnagtaccccgatgatacgacccctacggcctatgccgccgcctcgagaaagcgggaactagctgatcgatcctgctctccctccgaggagatcaacgaatgctcagccctttcccttaactgaaccaggagccccccaagggggattgggccagttttcggtttcggggcccggccggtttggggaaggttttggaaaggttgaaaaaaaaccccaaaaaacctcttccccccccggtgggaaaaatccccccgtgtgggggaaaaaaaaaattccccgggggtacggggggttttccggattgggggg

SEQ ID NO: 30842 - protein, 82 aa, Zea mays
  misc_feature: Ceres CLONE 1406751-F
  misc_feature (43)..(43): Xaa is any aa, unknown, or other
MSLCTIARRLCLSKPSSGSRLSAIWAHLYSTEAAKDMGAKKYXYPDDTTPTAYAAASRKRELADRSCSPSEEINECSALSLN

SEQ ID NO: 30843 - DNA, 736 bp, Zea mays
  misc_feature: Ceres CLONE 1406752-F
  misc_feature: Translation starting site: 249
  misc_feature (693)..(693): n is a, c, t, g, unknown, or other
  misc_feature (714)..(714): n is a, c, t, g, unknown, or other
tccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctggggagcacggttcccgtgcaatcttcgttgaactagaacccactgtgatcgatggaggtcgccactgggaccgaccgccagctcttccaccctgagcagctctatcagtggcaaagaggatgccgcctaaaaaattccgccgcggcccactaacacattggcaagaggattgtgtgaatctggggcctgaaccgatctcccaagcttgtgtgaaaaactgcaccgggcctccagggttttcttggccttcaatggccgttggtggtgggnactgggcttcggggcttgggntcctctccccccatggaacgcc

SEQ ID NO: 30844 - DNA, 669 bp, Zea mays
  misc_feature: Ceres CLONE 1406753-F
  misc_feature: Translation starting site: 199
  misc_feature (263)..(263): n is a, c, t, g, unknown, or other
  misc_feature (334)..(334): n is a, c, t, g, unknown, or other
  misc_feature (363)..(363): n is a, c, t, g, unknown, or other
  misc_feature (469)..(469): n is a, c, t, g, unknown, or other
  misc_feature (572)..(572): n is a, c, t, g, unknown, or other
aagctggagctccccgcggtggcggccgctctagaactagtggatcccccgggctgcaggaattcgcacgagaccattacctagaacatcctaatcgaaaaatcccctcagtcctcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggncacgcgcaccaccaccccgtcgtccgtggccgtggccaccccgcgcgccggcggcggccccatccgcgcgntcatctcctcctcccccacccgccctaangactgacgtccttcccggtcagccccatcaaggagtccatcgtgtccccgcgaggatgaccccggcgctacatgacgggacttgatcacccacgcccaccccgacntggtgatcgggggcgcccgtccgggggcctggtctggccgaacgaattgccaagggacccacccgggacggtggccttccgggaaaaatccctgtcccccggnggggggccctgggttggggggaaaattttcccccccctggggggggggaaagcccggacccctgttcctgaaaaaattgggggggggccaaaaaagg

SEQ ID NO: 30845 - DNA, 777 bp, Zea mays
  misc_feature: Ceres CLONE 1406754-R
  misc_feature (72)..(72): n is a, c, t, g, unknown, or other
  misc_feature (74)..(74): n is a, c, t, g, unknown, or other
gcttgtatagagtgattgatatattttctgataaggctttacatggtgtgtgtgtcaaaaaaaaaaaaaacnantattggagtgtgtttcaaaccacaagttgttatcaaatgacttggttctttgggaacaatttaatacttgatcctcctgtagagggggtttatacccttaccaggcagccgctagggtacccatgatgaagcgtcccccgaaggagattggtttgtttacaggcttctccacctcctcttcctttggtccaagctggagaagagagtctccagaggctggtttgacaccagtaacagaacatcccatgataagtccgtgcctgataacaccacagttcctcttggggccaatcctctttagctgaacatacttgaaacctgcattcttgtaccaatcaatgtactcctcctacgtggggaaatgcatcctctcatctacttagaatcgtgaaagcctaaagctacggtggacagagtcaatgtgacatgctattccacctatctttagaactctgtacacttcccttatacccctctgcgggtagggcccgtactcaatgcttccagcaaacacgtatctgtcagcttaagcagcatgaaaagggagatcctacgggatctcatccacgatcgtgctgctcgttcaggagctacttcctgcttcaccatttatcagatgatcgcggggaaccgggccagaaagcctcatgggactttaagcctttaccgtttttgacccattacccgcgggtgttgaaaacct

SEQ ID NO: 30846 - DNA, 691 bp, Zea mays
  misc_feature: Ceres CLONE 1406755-F
  misc_feature: Encodes the peptide sequence at SEQ ID NO. 30847
  misc_feature (558)..(558): n is a, c, t, g, unknown, or other
  misc_feature (589)..(589): n is a, c, t, g, unknown, or other
  misc_feature (614)..(614): n is a, c, t, g, unknown, or other
aagctggagctccccgcggtggcggccgctctacaactagtggatcccccgggctgcaggaattcgcacgagaccattacctagaacatcctaatcgaaaagttctgttctgttctgtcctgtccatcacaattcacgcgacgacgacccggcctgcgggcagatctttcttgacctagccagctcgttcttggcgcactagctagccagccagctagtagctatcctcgctcctccccaccgtcctcagtgctagactattcgtccgatgggcggcgtccaactcgacgacctctccgaattggccgtgctccggccgatccagacagcggcagcggctcggccgccgggcgacgacgccgaagacggcccggacgccgccgacacgggctgcgtcacgccaacggcctcgagctcccggctgatgccgatgccgcgcctggacgcggctgcggcgcctggaagtaccgacgcgccgccgacgcctgcgtacgcggcggcggtcacttggctgctgcgggcggcaagggggtgccctcccggccccctggaatccgncaaagaccaaccgagccgccaacccgccaanaaaaagtaaaccgttgttgtttggnccccgaccacttctttacccgggggccggacaaaccccctccccccgggggggactgggcccacacacaatagccca

SEQ ID NO: 30847 - protein, 109 aa, Zea mays
  misc_feature: Ceres CLONE 1406755-F
  misc_feature (97)..(97): Xaa is any aa, unknown, or other
  misc_feature (107)..(107): Xaa is any aa, unknown, or other
MGGVQLDDLSELAVLRPIQTAAAARPPGDDAEDGPDAADTGCVTPTASSSRLMPMPRLDAAAAPGSTDAPPTPAYAAAVTWLLRAARGCPPGPLESXKDQPSRQPAXKK

SEQ ID NO: 30848 - DNA, 609 bp, Zea mays
  misc_feature: Ceres CLONE 1406759-F
  misc_feature: Encodes the peptide sequence at SEQ ID NO. 30849
  misc_feature (395)..(395): n is a, c, t, g, unknown, or other
aaagctggagctccccgcggtggcggccgctctagaactagtggatcccccgggctgcaggaattcgcacgagaccattacctagaacatcctaatcgaaaaattggatcctatgctctcctctccctgctcgcagtcagggcacagggactgcctccggagaccggagcaggccgcaagcgtccaggttcgagacgccagcacgctctcgcagtacagcagcattatcagggagcgtgccgtgggagtgggaggttgcctcaggtgcggagcagtcgccggcggcgaccatcggtgtctgagatgaaggagagaggcggctccagggcggcagtggacgagcgctacgcgcagtggaagtcgctcatccccgttctctacgactgggtttgccnaccacacctcgtttgggcatccctctcctggcggtggggggcacagtttgagaaagctaccctacagaatcggcaacgcctttacctatctgaacagacggatggggagtgtgcctaatactctgggtatcgcaaactggtgaggtgtgaaaaccaagggtggcagctgctgacattatctcggagtttaacgagggagcacgatccccttttg

SEQ ID NO: 30849 - protein, 69 aa, Zea mays
  misc_feature: Ceres CLONE 1406759-F
  misc_feature: SWISSPROT Homolog: EC 2.3.1.48 Histone acetyltransferase
  misc_feature (31)..(31): Xaa is any aa, unknown, or other
MKERGGSRAAVDERYAQWKSLIPVLYDWVCXPHLVWASLSWRWGAQFEKATLQNRQRLYLSEQTDGECA

SEQ ID NO: 30850 - DNA, 645 bp, Zea mays
  misc_feature: Ceres CLONE 1406760-F
  misc_feature (157)..(157): n is a, c, t, g, unknown, or other
  misc_feature (359)..(359): n is a, c, t, g, unknown, or other
  misc_feature (386)..(386): n is a, c, t, g, unknown, or other
  misc_feature (387)..(387): n is a, c, t, g, unknown, or other
  misc_feature (414)..(414): n is a, c, t, g, unknown, or other
  misc_feature (455)..(455): n is a, c, t, g, unknown, or other
  misc_feature (488)..(488): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (553)..(553): n is a, c, t, g, unknown, or other
  misc_feature (554)..(554): n is a, c, t, g, unknown, or other
aaagctggagctccccgcggtggcggccgctctagaactagtggatcccccgggctgcaggaattcgcacgagaccattacctagaacatcctaatcgaaaaactgcgatgtggtcctctcctcctatcacctgacctccacacacacacacagacngactggcacgcgcaagcaaaaattcattcatatatgcacgctcgttcgttgtcgatctcccccatcactgcacggcgcggcgcaacaagagcgagggattggagctcagctagtcgtctaatcagctagtaggtacgtgtagctaggctgcgctgcaccagctgccgtgcatgcagtgcatggcgcaggagggctctgaggnctccgtcgccagctccccgccgcccanngccggcgccgtcgggctccctcctggntggcgcgacatgcagcacccggctgcctaacggcgcgtggnctcgtcccccgcggggcgaggtggccgcccccnggtatcggatgggcgccgccagcgacgcaacagcagcagcagcacggcggcgggnnncgacacgnnccctccgaacgttctctcggcctccaacgccacccgtagcggtcttcaccaaccacttccggggtccggctcagctggactcgcggggggg

SEQ ID NO: 30851 - DNA, 705 bp, Zea mays
  misc_feature: Ceres CLONE 1406761-F
  misc_feature: Encodes the peptide sequence at SEQ ID NO. 30852
  misc_feature (492)..(492): n is a, c, t, g, unknown, or other
  misc_feature (549)..(549): n is a, c, t, g, unknown, or other
  misc_feature (565)..(565): n is a, c, t, g, unknown, or other
  misc_feature (610)..(610): n is a, c, t, g, unknown, or other
  misc_feature (641)..(641): n is a, c, t, g, unknown, or other
aagctggagctccccgcggtggcggccgctctagaactagtggatcccccgggctgcaggaattcgcacgagaccattacctagaacatcctaatcgaaaagaaaaagtctcctcttttcctcttcctctcccgttgccaggcatggggttggcctagttgtgcccgttgagcactagcagcctccttgaaacctccagatctgtgcctccaaggcccccgttcctcggcaacaagccgtccagatggacaccgccgcgcccctgcaactgaaagcctgcgccggcgacgccgcggagaagctgctgctcgccgtcgcagccgagggtcctatctgtggtgtgccagacttcaagatgaggggaaagaagagtgatgagctcgaacctgtcgatgctggcgatgaagatgatgatggtggtgacgatggggacgaggatggtgactttggggaggagggtgaagaggacgtctcagaagggagggatatgancacccaaaggcaatgagaccagaaagcaagaggtgatcctgaggaaaatggtgaggnaagatgagaagaacanaagatcaggagggtgccggcgacgaccatgatgacgaccatgacnatgatgagaacggggatgacaaggacgaccnaccatggggatgaccatgagggaggtggaaatgaaaaagacgttgccccggacgaggtttgggg

SEQ ID NO: 30852 - protein, 87 aa, Zea mays
  misc_feature: Ceres CLONE 1406761-F
  misc_feature (83)..(83): Xaa is any aa, unknown, or other
MDTAAPLQLKACAGDAAEKLLLAVAAEGPICGVPDFKMRGKKSDELEPVDAGDEDDDGGDDGDEDGDFGEEGEEDVSEGRDMXTQRQ

SEQ ID NO: 30853 - DNA, 704 bp, Zea mays
  misc_feature: Ceres CLONE 1406764-F
  misc_feature: Encodes the peptide sequence at SEQ ID NO. 30854
  misc_feature (552)..(552): n is a, c, t, g, unknown, or other
  misc_feature (558)..(558): n is a, c, t, g, unknown, or other
ggagctccccgcggtggcggccgctctagaactagtggatcccccgggctgcaggaattcgcacgagaccattacctagaacatcctaatcgaaaaagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctcccagccccgcattgaggcctggaacagtgacaccctgccaatctacgagcctggtctcgatgatgttgtgaagcagtgcaggggcaggaacctctttctcagcactgatgttgagaagcacgtcgctgaggctgacattatctttgtctcgttgaacacccccaccagacccgttggccttggagctggnaaggcntgccgacctcacctactgggaaagggctgcccgcatggattggggatggctcccagtctgacaaaattggttgttgaaaagtccacttgtcccgggaaaagaccgttgggtttttggaaaaaattttggccccaaaacggaggggg

SEQ ID NO: 30854 - protein, 148 aa, Zea mays
  misc_feature: Ceres CLONE 1406764-F
  misc_feature (2)..(144): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
MVKICCIGAGYVGGPTMAVIALKCPDIEVVVVDISQPRIEAWNSDTLPIYEPGLDDVVKQCRGRNLFLSTDVEKHVAEADIIFVSLNTPTRPVGLGAGKACRPHLLGKGCPHGLGMAPSLTKLVVEKSTCPGKRPLGFWKKFWPQNGG

SEQ ID NO: 30855 - DNA, 630 bp, Zea mays
  misc_feature: Ceres CLONE 1406771-F
  misc_feature: Encodes the peptide sequence at SEQ ID NO. 30856
  misc_feature (311)..(311): n is a, c, t, g, unknown, or other
  misc_feature (343)..(343): n is a, c, t, g, unknown, or other
  misc_feature (349)..(349): n is a, c, t, g, unknown, or other
  misc_feature (362)..(362): n is a, c, t, g, unknown, or other
  misc_feature (385)..(385): n is a, c, t, g, unknown, or other
  misc_feature (425)..(425): n is a, c, t, g, unknown, or other
  misc_feature (615)..(615): n is a, c, t, g, unknown, or other
aagctggagctccccgcggtggcggccgctctagaactagtggatcccccgggctgcaggaattcgcacgagaccattacctagaacatcctaatcgaaaacttcttctgccttcccgactctacctgacttcgcccgctctgagaaattcactctcaccaccaccgcgccgcctccactccccccacacccccggtctgaaacccaagcttccgcttctctcatggccgacgccaccgccgccctctcagctcggagcaaggtgcaggctttcctggaggctgcgcgcgccggcgacctccaatcctcangaaacctcgtcgcggcgctcgacgaggacggnacgggngccgcctccgtcngccgccggccgtgcgtgacgccnacaagcgcaccgccctccacttcgcggcgatcggatgtcncacccgacgtctgtgaattcctcatcggcgagctcggcctccctgtcgacccaagggacgatgatggcgaaactccgctcatccatgcgacacgcccgggccatctggaccctgtccagtatcttctcgaccatggaactgatccctcgctggccaccagcctaggagcacagcgctacaccatgctgcnagcatagggaacacg

SEQ ID NO: 30856 - protein, 132 aa, Zea mays
  misc_feature: Ceres CLONE 1406771-F
  misc_feature (89)..(121): Pfam Name: Ank Pfam Description: Ankyrin repeat
  misc_feature: SWISSPROT Homolog: EC 2.4.2.30 NAD(+) ADP-ribosyltransferase
  misc_feature (30)..(30): Xaa is any aa, unknown, or other
  misc_feature (47)..(47): Xaa is any aa, unknown, or other
  misc_feature (68)..(68): Xaa is any aa, unknown, or other
  misc_feature (131)..(131): Xaa is any aa, unknown, or other
MADATAALSARSKVQAFLEAARAGDLQSSXNLVAALDEDGTGAASVXRRPCVTPTSAPPSTSRRSDVXPDVCEFLIGELGLPVDPRDDDGETPLIHATRPGHLDPVQYLLDHGTDPSLATSLGAQRYTMLXA

SEQ ID NO: 30857 - DNA, 632 bp, Zea mays
  misc_feature: Ceres CLONE 1406772-F
  misc_feature: Encodes the peptide sequence at SEQ ID NO. 30858
  misc_feature (565)..(565): n is a, c, t, g, unknown, or other
  misc_feature (607)..(607): n is a, c, t, g, unknown, or other
aaagctggagctccccgcggtggcggccgctctagaactagtggatcccccgggctgcaggaattcgcacgagaccattacctaagaacatcctaatcgaaaaatacttactggtcctcactcccacaccaaccaaccaacctcctcttgcctgccgctttctcctgctgcgggcggtcacggctgcaagtactagaggaggacatccgcttccattactgcgcctgcggaggatcggaggaaccagtagcggaggcttcgattttcggcgggcgcaataatttccgcattggctcggagggccgcgtcctcgctcgtctcccgctgctccctggcgagggcccctgccggcgcgccgcccgctgccccctctgcgctgcgcaggacagtgcctgcagatgggatgcacaggctgttgccaggtgtcccttcagaggttcagcactgcagcagcagtagaggagcccatcacgccgtcagtccatgtgaactacacaaagctcctcattaatggcaacttttgttgattccgcatcgggcaagaccttccaactctggacctcgnaacaggggaggtgattgctcatgtggctgaggggtgacgcanaagacattaaccgtgcagtagctgc

SEQ ID NO: 30858 - protein, 42 aa, Zea mays
  misc_feature: Ceres CLONE 1406772-F
  misc_feature: SWISSPROT Homolog: EC 1.2.1.3 Aldehyde dehydrogenase (NAD(+))
MGCTGCCQVSLQRFSTAAAVEEPITPSVHVNYTKLLINGNFC

SEQ ID NO: 30859 - DNA, 653 bp, Zea mays
  misc_feature: Ceres CLONE 1406776-F
  misc_feature: Encodes the peptide sequence at SEQ ID NO. 30860
aaagctggagctccccgcggtggcggccgctctagaactagtggatcccccgggctgcaggaattcgcacgagaccattacctagaacatcctaaaaaaaaaccccaaacccacagcagtaacaggggcacactagctaagctaaacctcgccacggcacagcaatggcgccgctccccgcttccctcctgccctgcctctggctcttcctctgcctcctcgccgcgccgtgccccacagcgcgggcggagcggttcgcgtgcaacgccacggcgccgcgagcgtccacgtgccaggcgctcgtctcctacgcgccgcccaacgggacggccacgcccacgctggccgccgtgcgcgcgctcttccagctccgctcccaccgcggcggtgctggccgccaacggcctcccgctctccacgccgcccacggcgcccgcgcccgtgccgttgcgggtccacctgccctgcctctgctcggggggcgccggagccacgttccagcaaccaagtaccggggcccgcgcggggacacgctcgacgccgacgagaggggccgtcttcgggggcctcaacccctaccaggacatcgccggccgcaaaaacgtaccccgaccccaaagggggtcgccggtggcccccagccccaggatgcg

SEQ ID NO: 30860 - protein, 163 aa, Zea mays
  misc_feature: Ceres CLONE 1406776-F
MAPLPASLLPCLWLFLCLLAAPCPTARAERFACNATAPRASTCQALVSYAPPNGTATPTLAAVRALFQLRSHRGGAGRQRPPALHAAHGARARAVAGPPALPLLGGRRSHVPATKYRGPRGDTLDADERGRLRGPQPLPGHRRPQKRTPTPKGVAGGPQPQDA

SEQ ID NO: 30861 - DNA, 627 bp, Zea mays
  misc_feature: Ceres CLONE 1406784-F
  misc_feature: Encodes the peptide sequence at SEQ ID NO. 30862
  misc_feature (627)..(627): n is a, c, t, g, unknown, or other
tggagctccccgcggtggcggccgctctagatactagtggatcccccgggctgcaggaattcgcacgagaccattacctagaacatcctaatcaaaaaggaattctgccttcttctctcatcttcctggtcccatcagtagcaactttagctgtagcagggccaccggccaccgctacgctatgctcaccacgatgcacaagtccctgggggagatctgcggtgaccacctcgccgcggcggctgctggctcgaacgccaccgcgctccacgcagcgctccggagtgcgctcgactcgcacggacccaccgaattgcgccgcgagctctgcaggtccgtgctctgtccgtctgtccccttcgccgtccactggatgctctacgacagctgctatcgcagattcccgtctaccacgacgccacctggacgatcgagcacaaggaggctgccttgatcaccgatcacctccgcctcgaggagcatggtagagacttcatcgatgacgggtacaaagatcccatcaccaacttttcagacctccactagttctccaagataaccaatagggcaactggaaaaggggaatttaaggatatgcttttaccatttggggcagagacatccggn

SEQ ID NO: 30862 - protein, 90 aa, Zea mays
  misc_feature: Ceres CLONE 1406784-F
MLTTMHKSLGEICGDHLAAAAAGSNATALHAALRSALDSHGPTELRRELCRSVLCPSVPFAVHWMLYDSCYRRFPSTTTPPGRSSTRRLP

SEQ ID NO: 30863 - DNA, 675 bp, Zea mays
  misc_feature: Ceres CLONE 1406787-F
  misc_feature: Encodes the peptide sequence at SEQ ID NO. 30864
  misc_feature (364)..(364): n is a, c, t, g, unknown, or other
  misc_feature (398)..(398): n is a, c, t, g, unknown, or other
  misc_feature (399)..(399): n is a, c, t, g, unknown, or other
  misc_feature (416)..(416): n is a, c, t, g, unknown, or other
  misc_feature (417)..(417): n is a, c, t, g, unknown, or other
  misc_feature (434)..(434): n is a, c, t, g, unknown, or other
  misc_feature (441)..(441): n is a, c, t, g, unknown, or other
  misc_feature (493)..(493): n is a, c, t, g, unknown, or other
  misc_feature (510)..(510): n is a, c, t, g, unknown, or other
aaagctggagctccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggccctcccgagcgggctgctcccgctgcgggacatcatcgagtgcggctacgtgggaggagacggggcttcgtggtggctccggcagcgnccgcaaggtggaccactacttcgccaaggccggnncgccacgtgtccacggnngggcgagggtggtccgncgggtgnccggacaaggggccgggctcaaggagaatcacggggcgtcaaggcccaggangaaggctggttgggggntccaccctccacggagatctggggtcgacgaccccgccccaggggttaagcttccactgggaggggccatcgggggggcctggccccgcagctttcccccgtcgagggcctttcgaagggccggagaagccgggggccggccgggagccgggggggtggtcgttc

SEQ ID NO: 30864 - protein, 167 aa, Zea mays
  misc_feature: Ceres CLONE 1406787-F
  misc_feature (64)..(64): Xaa is any aa, unknown, or other
  misc_feature (75)..(75): Xaa is any aa, unknown, or other
  misc_feature (81)..(81): Xaa is any aa, unknown, or other
  misc_feature (87)..(87): Xaa is any aa, unknown, or other
  misc_feature (89)..(89): Xaa is any aa, unknown, or other
  misc_feature (107)..(107): Xaa is any aa, unknown, or other
MTLTIPDEVRAKAEVYVGDAAGQEKTRLLLQETGPPERAAPAAGHHRVRLRGRRRGFVVAPAAXARWTTTSPRPXRHVSTXGRGWSXGXPDKGPGSRRITGRQGPGXRLVGGSTLHGDLGSTTPPQGLSFHWEGPSGGPGPAAFPRRGPFEGPEKPGAGREPGGWSF

SEQ ID NO: 30865 - DNA, 649 bp, Zea mays
  misc_feature: Ceres CLONE 1406789-F
  misc_feature: Encodes the peptide sequence at SEQ ID NO. 30866
  misc_feature (237)..(237): n is a, c, t, g, unknown, or other
  misc_feature (257)..(257): n is a, c, t, g, unknown, or other
  misc_feature (258)..(258): n is a, c, t, g, unknown, or other
  misc_feature (312)..(312): n is a, c, t, g, unknown, or other
aaagctggagctccccgcggtggcggccgctctagaactagtggatcccccgggcttgcaggaattcgcacgagaccatttacctaagaacattcctaatcgaaaaactttccaccgccaccgccgagcgcggtggcaccgacacgacacacgtagttgcagacctgcagtgccagcacggctgccaatccctgctggcgctgttcccggctccgagatcatttggactcggcactncggaggggatgggggatggnngacggaatggccgccgacgcctgcgcagaaaggaaagcggtggtgagcgccggntcggcgctgaagctggtactgttcgggattctcgcgggcctcgcactgcggctggctggtggggcccccagcctacctcctgccgcccaccgccgcgcccagagggggccgctcgtcttttcgcggtgccggagagggaaagaaccgcccggcggcggcggcggcggaataccttccgtcgaaaggaatggagcggttttttaacttggacgattcaaaacctcttacagcttttaggcaggaaggaaggttccacaaaaccaaaaagaaagttgtgatcttttccatgggggagggggtttccaatttcatccaggacccagcttatactaaatgg

SEQ ID NO: 30866 - protein, 83 aa, Zea mays
  misc_feature: Ceres CLONE 1406789-F
MAADACAERKAVVSAGSALKLVLFGILAGLALRLAGGAPSLPPAAHRRAQRGPLVFSRCRRGKEPPGGGGGGIPSVERNGAVF

SEQ ID NO: 30867 - DNA, 656 bp, Zea mays
  misc_feature: Ceres CLONE 1406790-F
  misc_feature (20)..(20): n is a, c, t, g, unknown, or other
  misc_feature (47)..(47): n is a, c, t, g, unknown, or other
  misc_feature (213)..(213): n is a, c, t, g, unknown, or other
  misc_feature (226)..(226): n is a, c, t, g, unknown, or other
  misc_feature (537)..(537): n is a, c, t, g, unknown, or other
caagctggagctcaccgcgntggcggccgctctagaactagtggatnccccgggctgcaggaattcgcacgagaccattacctagaacatcctaatcgaaaacttggatagtccgtagccgcttgccctgttcgcatcttcgcgcgtggcgcacaccgctccagctctccttcgacgggcacggccgagccgccttcgtcttggccgcagcgncgcgcgctctccntgccgtcctaattagcctagccgcaacgccgcgcccgtgcctgcgaagtacggccgcaagctttccacccccccccccccctggccgacacccctccccccccacccgcctcatcccccccccttaaccaacttctctgctagtgtcccaccccgcgaggcgcccctccctttgcttggctttttcggccactcccacggcacccccccccacccactccctaacacttctcacccacgaatcccctacacacccccccaccccccaacttttccccccccccccctctttccccctcttctttcccctcncccccccccccccccccccccctcccccccccccctccccccatacccccacccctcacaccccctgcctccccctcccccgcgcacgcaccccccctccgcgcctccccccaccctgg

SEQ ID NO: 30868 - DNA, 649 bp, Zea mays
  misc_feature: Ceres CLONE 1406794-F
  misc_feature: Encodes the peptide sequence at SEQ ID NO. 30869
  misc_feature (492)..(492): n is a, c, t, g, unknown, or other
aaagctggagctcaccgcggtggcggccgctctagaactagtggatcccccgggctgcaggaattcgcacgagaccattacctagaacatcctaatcgaaaaaacctaaacctcgtctcgcctcgcctccgccagtcagccccctcaaccccggcggccaaaagtcgacgcaccgaagcggcggccatggcggagctaaagcggctgtcagagagccgggacctgacgcggatcgagcgcatcggcgcgcactcccacatccgggggctagggctggactcctccatggaggcgcgcgacgcctcggagggcatggtcgggcagctgcccgcgcgccgcgcccgcgggttcatactcaagttcatctcccaggggaagatcgccggccgcgccgttctcttccgggccccgcccgcggcccggcaagagcgccgcccgccatgtggattgacaaactcggtcgggtgggcagacccccttccccctccgggnaagagctggaaggtgcttccgcgccgaccccggccagagaggaaggcggtcctcgcgagggctttctccgacggccattcccctgcgccctcggatggatgggcagtgaaacccgtcgaggacgccggttcctggtatatttatcgcgcgaacggct

SEQ ID NO: 30869 - protein, 154 aa, Zea mays
  misc_feature: Ceres CLONE 1406794-F
MAELKRLSESRDLTRIERIGAHSHIRGLGLDSSMEARDASEGMVGQLPARRARGFILKFISQGKIAGRAVLFRAPPAARQERRPPCGLTNSVGWADPLPPPGKSWKVLPRRPRPERKAVLARAFSDGHSPAPSDGWAVKPVEDAGSWYIYRANG

SEQ ID NO: 30870 - DNA, 632 bp, Zea mays
  misc_feature: Ceres CLONE 1406799-F
  misc_feature: Encodes the peptide sequence at SEQ ID NO. 30871
  misc_feature (285)..(285): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (407)..(407): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcggncgcccgatgggtgagcaggtgaagggcatgctccacgacaaggggccgacggcgtcgcaggcgctgacggtggtgacgctgctcccgctgggcgggctgctgctggtgctgccnnncctggngctcaccccccccggggcgccccggcccggggcctccccgcgctccctttttttcgcgcccgggcccccccccgccggcctcgtctcggctccccgtgttttggtcccccccccccccgcccctcccgcgccctgggcgcccccccctcccgtcggttccccccccccgccggggcgctccttccgcccccccccccctccctcgttcggccccccccctcctcg

SEQ ID NO: 30871 - protein, 142 aa, Zea mays
  misc_feature: Ceres CLONE 1406799-F
  misc_feature (66)..(66): Xaa is any aa, unknown, or other
  misc_feature (68)..(68): Xaa is any aa, unknown, or other
MADRDRSGIYGGAHATYGQQQQQGGGGRPMGEQVKGMLHDKGPTASQALTVVTLLPLGGLLLVLPXLXLTPPGAPRPGASPRSLFFAPGPPPAGLVSAPRVLVPPPPAPPAPWAPPPPVGSPPPPGRSFRPPPPPSFGPPPP

SEQ ID NO: 30872 - DNA, 629 bp, Zea mays
  misc_feature: Ceres CLONE 1406807-F
  misc_feature: Encodes the peptide sequence at SEQ ID NO. 30873
  misc_feature (363)..(363): n is a, c, t, g, unknown, or other
  misc_feature (406)..(406): n is a, c, t, g, unknown, or other
  misc_feature (407)..(407): n is a, c, t, g, unknown, or other
  misc_feature (441)..(441): n is a, c, t, g, unknown, or other
aagctggagctccccgcggtggcggccgctctagaactagtggatcccccgggctgcaggaattcgcacgagaccattacctagaacatcctaatcgaaaaaaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagcaaatggtttctggtgcgggtcatggtgggtacggcggcggcgacgacgggcaggccgtcgacttccggggcaacccggcggacaagtcgaggaccggaggctggctgggcgccggnctgatcctgggcacggagctgccggagcgcgtgtgcgtgatgnncatctccatgaacctggtgacgtacctcgtcggngagctgcacctctccactccaagtcccgcaccgtggtgaccaacttcatgggcacgctcaacctgctcgccctcgtccggcggtttcctcgcccgacgcaagctcgggcgctacttcaccatcgcactcttcgccacaatcgccggcacgggcgtgagctttgctgagggggcacaccacggtgccaa

SEQ ID NO: 30873 - protein, 76 aa, Zea mays
  misc_feature: Ceres CLONE 1406807-F
  misc_feature (53)..(53): Xaa is any aa, unknown, or other
MVSGAGHGGYGGGDDGQAVDFRGNPADKSRTGGWLGAGLILGTELPERVCVMXISMNLVTYLVGELHLSTPSPAPW

SEQ ID NO: 30874 - DNA, 633 bp, Zea mays
  misc_feature: Ceres CLONE 1406809-F
  misc_feature (234)..(234): n is a, c, t, g, unknown, or other
  misc_feature (404)..(404): n is a, c, t, g, unknown, or other
  misc_feature (463)..(463): n is a, c, t, g, unknown, or other
tggagctccccgcggtggcggccgctctagaactagtggatcccccgggctgcaggaattcgcacgagaccattacctagaacatcctaatcgaaaagagtaatttctcgtcttgtttcggctagggagcggggtggcttctccggccaaggctttcacagttttgtgtttgttgatgtgtttgcatggagattgaagaacacacagattcactttcaatagaggacccatcancaggctcccaccagatattattgaggggatacttctcaggcttccggtaactctctaatgaggctgcgtcaagtctgcaagcaatggtggaacatggtcagcgtgccccgctttatcaaagaacatgcctatcatgcacccaagcacctcctcctttacttgcctaagtngaatatatctgcatcgctccatccaaagactgcaaaccatgtcttggcacatcattaantgaaaagtggtctccattgacatggggctcatcgcaatgggaccctgatgatcacctctttgcatcaagggaaagggtttggctttgcttcctacagacatacccccctaaagatatctaacccctgcaacagggcaatgccctgcatttctgggaaactgacggggatt

SEQ ID NO: 30875 - DNA, 640 bp, Zea mays
  misc_feature: Ceres CLONE 1406814-F
  misc_feature: Encodes the peptide sequence at SEQ ID NO. 30876
  misc_feature (368)..(368): n is a, c, t, g, unknown, or other
  misc_feature (536)..(536): n is a, c, t, g, unknown, or other
tggagctccccgcggtggcggccgctctagaactagtggatcccccgggctgcaggaattcgcacgagaccattacctagaacatcctaatcgaaaaagtagtccgatagccaggaagaccgtgcacgtcgaccgtacgtacgacaccatgccggggctcaccataggcgacaccgtccccaacctgtagctggactccacccacggcaagatccgcatccacgactacgttggcgacggctacgctatcatcttctctcacccagccgacttcacgcccgtgtgcacgacggagatgtcggcgatgacgccctacgccaaggagttcgagaagcgtggcgtgaagctgctgggcatctcgtgcgacnacttggagtcgcacaggcagtggaccaaggacgtggaggcgtacggcgggaagcagcagcagcagcagcatacgacgacgaaggtgacgttcccgatcctggcggacccggagcgggacgccatccgccagctgaacatggtggaccccctacaagaaagacgcggcnggggaggagcatgccgtcccgcgcgatacacgtcgtcgggcccgacaaaggcgtgaagctgaacttcctgtacccgggcacacggggcggaacatgaaccaggg

SEQ ID NO: 30876 - protein, 98 aa, Zea mays
  misc_feature: Ceres CLONE 1406814-F
  misc_feature: SWISSPROT Homolog: EC 1.11.1.15 Peroxiredoxin
  misc_feature (25)..(25): Xaa is any aa, unknown, or other
  misc_feature (81)..(81): Xaa is any aa, unknown, or other
MSAMTPYAKEFEKRGVKLLGISCDXLESHRQWTKDVEAYGGKQQQQQHTTTKVTFPILADPERDAIRQLNMVDPLQERRGXGGACRPARYTSSGPTKA

SEQ ID NO: 30877 - DNA, 628 bp, Zea mays
  misc_feature: Ceres CLONE 1406815-F
  misc_feature: Encodes the peptide sequence at SEQ ID NO. 30878
tggagctccccgcggtggcggccgctctagaactagtggatcccccgggctgcaggaattcgcacgagaccattacctagaacattctaatcgaaaactctcgtctcgtctcgtctgcagtagcagtctccgcatccgctgcctccgcctcctccgtcgatttggattcgcagcggcggcggcggccaatcaaagcaatcatcacccagtcgcccagcccaacagacgctccagtccccagccctcccacccgcctcgatcgatgcgaggcacaatgccggccaccgactcctcctcctcctcctcctcctcgccggcggcggcgccgctgtcctccatcggccgctccatccgctcgctccgccgtgaccagaaccagatccactccttcccgccgccgccagacgccacagacgccttccagcgccgcgccgcccaactcctggccgacctcccggcagccgacgacgtcctctccctcgcctggacgcgccgcctcctcgaatccttcctcctctgcctcgaggagttccgcgccctgctcttcggctccggggactcgcccgctgctcggcccccgctcgaccgcctcgtcgccgacttctccgaccgcgccgtcaaggcgctc

SEQ ID NO: 30878 - protein, 118 aa, Zea mays
  misc_feature: Ceres CLONE 1406815-F
MPATDSSSSSSSSPAAAPLSSIGRSIRSLRRDQNQIHSFPPPPDATDAFQRRAAQLLADLPAADDVLSLAWTRRLLESFLLCLEEFRALLFGSGDSPAARPPLDRLVADFSDRAVKAL

SEQ ID NO: 30879 - DNA, 663 bp, Zea mays
  misc_feature: Ceres CLONE 1406818-F
  misc_feature: Encodes the peptide sequence at SEQ ID NO. 30880
  misc_feature (371)..(371): n is a, c, t, g, unknown, or other
  misc_feature (374)..(374): n is a, c, t, g, unknown, or other
  misc_feature (377)..(377): n is a, c, t, g, unknown, or other
  misc_feature (407)..(407): n is a, c, t, g, unknown, or other
  misc_feature (408)..(408): n is a, c, t, g, unknown, or other
  misc_feature (569)..(569): n is a, c, t, g, unknown, or other
aagctggagctccccgcggtggcggccgctctagaactagtggatcccccgggctgcaggaattcgcacgagaccattacctagaacatcctaatcgaaaaagcagtccgatagccaggaagcccgtgcacgtcgaccgacgtacgccaccatgccggggctcaccataggcgacaccgtccccaacctggagctggactccacccacggcaagatccgcatccacgactacgttggcgacggctacgctatcatcttctctcacccagccgacttcacgcccgtgtgcacgacggagatggcggcgatggcggggtacgccaaaggagtcgagaagcgtggcgtgaagctgctgagcatctcgtgcgacnacntgnagtcgcacaggcagtggaccaaggacgtgnnagcgtacggcgggaagcagcagcagcagcagcatacgacgacgaaggtgacgttcccgatcctggcggacccgggcggggacgccatccggcagttgaacatggtgaaccccaacaaaaagaccccgcggggggaaaaatgcctcccgggggttccacgtngttgggcccaaaaaggcccgaaaaattaattttcctgaacccgggccccacggggcgggaaattgaaaaagtggcttcccccccccccaacccc

SEQ ID NO: 30880 - protein, 148 aa, Zea mays
  misc_feature: Ceres CLONE 1406818-F
  misc_feature (6)..(139): Pfam Name: AhpC-TSA Pfam Description: AhpC/TSA family
  misc_feature: SWISSPROT Homolog: EC 1.11.1.15 Peroxiredoxin
  misc_feature (74)..(74): Xaa is any aa, unknown, or other
  misc_feature (75)..(75): Xaa is any aa, unknown, or other
  misc_feature (76)..(76): Xaa is any aa, unknown, or other
  misc_feature (86)..(86): Xaa is any aa, unknown, or other
  misc_feature (140)..(140): Xaa is any aa, unknown, or other
MPGLTIGDTVPNLELDSTHGKIRIHDYVGDGYAIIFSHPADFTPVCTTEMAAMAGYAKGVEKRGVKLLSISCDXXXSHRQWTKDVXAYGGKQQQQQHTTTKVTFPILADPGGDAIRQLNMVNPNKKTPRGEKCLPGVPRXWAQKGPKN

SEQ ID NO: 30881 - DNA, 597 bp, Zea mays
  misc_feature: Ceres CLONE 1406819-F
  misc_feature: Encodes the peptide sequence at SEQ ID NO. 30882
  misc_feature (259)..(259): n is a, c, t, g, unknown, or other
ggagctccccgcggtggcggccgctctagaactagtggatcccccgggctgcaggaattcgcacgagaccattacctagaacatcctaatcgaaaaagcagtccgatagccaggaagcccgtgcacgtcgaccgacgtacgccaccatgccggggctcaccataggcgacaccgtccccaacctggagctggactccacccacggcaagatccgcatccacgactacgttggcgacggctacgctatcatcttctctcnaccagccgacttcacgcccgtgtgcacgacggaaatgccggcgatgcccgggtacgccaagggagtccagaagcgtgcgggaacctgctgggcatttctgcggacacctggagccgcaaagcaggggaccaaggaacgggagggtaccggggaaacaccccccccccccttaccaccacaagggtgagttcccaaacctgggggacccgggggggaacccttccgcgaattgaaatgggggacccccaaaaaaaggaacggcgggggggaaaatggcctccccgggttccccatttttggggcccaaaaagggggggaaataaactttttttcccccc

SEQ ID NO: 30882 - protein, 99 aa, Zea mays
  misc_feature: Ceres CLONE 1406819-F
  misc_feature: SWISSPROT Homolog: EC 1.11.1.15 Peroxiredoxin
  misc_feature (38)..(38): Xaa is any aa, unknown, or other
MPGLTIGDTVPNLELDSTHGKIRIHDYVGDGYAIIFSXPADFTPVCTTEMPAMPGYAKGVQKRAGTCWAFLRTPGAAKQGTKEREGTGETPPPPLPPQG

SEQ ID NO: 30883 - DNA, 557 bp, Zea mays
  misc_feature: Ceres CLONE 1406820-F
tggagctccccgcggtggcggccgctctagaactagtggatcccccgggctgcaggaattcgcacgagaccattacctagaacatcctaatcaaaaaatctgccatcttcgtctatccctttcatctcagttttgcagtttctactgctgtcttcgctccgaaatccaaccgaaatctcagaggaaagtaggaaacctcgttcgggaacctgctttgagtgagactccaatccttgggcgccattgccgcctgttttttgtgctcgggaaggcgctgtctgattcctggtatattattttgggaatgctttcagctgcacaaaactaacatggatgcactagctttgactgacgagcacgagggtcaattggcctcttttctaccaaatttttaaggagggggatgatccccaaaaaaagggggtttggtttcccctggaaattcggttccggggaaacaaaggggggtcccggggggaaaataatttttggggccactttaaattgggggggggggccccaaaaaaaggggccccttggggttcccaaaggacccg

SEQ ID NO: 30884 - DNA, 643 bp, Zea mays
  misc_feature: Ceres CLONE 1406826-F
  misc_feature: Translation starting site: 193
  misc_feature (447)..(447): n is a, c, t, g, unknown, or other
aaagctggagctccccgcggtggcggccgctctagtactagtggatcccccgggctgcaggaattcgcacgagaccattacctagaacatcctaatcgaaaaaactaatcgagacgtcccaatcgagctaatctcactccgacagtgacagtgccagcgggagctgataatccgcggcgtgatccagcagcgatggtactggagtctgagagcgacaggataaagggcccctggagccccgaggaggacgaggcgctgcggcgtctcgtggagcgccacggcgcgcggaactggacggcgatcgggcgcggcatcccggggcggtcggagaagtcgtgccggctgcggtggtgcaaccagctgtcgccgcaggtggagcgccgccccttcacgcccgaggaggacgccgcgatcctgaccgcgcacgcccggctgcgcaaccggttntggcgccatcgcgcgccttctcctcgggcgcaccgaccacgccgctaagaaccactgggactcgtcgctcaagcgaaggtcgccaccgccacggagacctccaccggcagtgatgctggacgggcgtgctagcgcgcaagccctggcccgggaagcccacggggtcggaccgcagcgaccttcgccaccgctgcgg

SEQ ID NO: 30885 - DNA, 635 bp, Zea mays
  misc_feature: Ceres CLONE 1406830-F
tggagctccccgcggtggcggccgctctagaactagtggatcccccgggctgcaggaattcgcacgagaccattacctagaacatcctaatcgaaaattttctttagaaattgtttatgtcccaatgaaacgagttagttaataatcttgtgcttgatatgatctgaagacggaattcatggtggacatgaaatgtgagggatgtgtaacagctgtgaaaaacaagctgcaaactcttgaaggaataaaaaacattgaggtggacttgtctaaccaagtcgttagagttttggggtctcttccagtgaagacaatgttagatgcccttcatcaaacaggtcgagatgcacgactgattggacaaggcaacccaaatggtttgtgttaattgtatgttaatcagcatttgttagcaaaactcattcagattagcttggatatttgcagtcatttgttatcaaaattcattatggtaggcttacagatcatcactgagtgaagtgcgatgttggatatttcttatgacatggtgacatttgtagcattagggattaattgtcgcttgtgtatgtgttcttttcatattgagagatccgtcgaatattgtgaaaatctttaagatggtacactatagg

SEQ ID NO: 30886 - DNA, 658 bp, Zea mays
  misc_feature: Ceres CLONE 1406834-F
  misc_feature: Encodes the peptide sequence at SEQ ID NO. 30887
aaagctggagctccccgcggtggcggccgctctagatctagtggatcccccgggctgcaggaattcgcacgagaccattacctagaacatcctaatcgaaaaaaccatattattgagaccaacaagcaacatagaaagtggaatccagtagcaacaatagagcaacaatggcgaccaagatattttccctccttatgctccttgctctttctgcatgcgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcggcaatcgccagccctatctttggtgcagccattggagacaaccatcagggcacagtagctgcagcaactcgtgctacctgtgatcgaacaaggagctctggcaaacctttctccctactctcagcaacgacaatttctttcattccaacaacctggccacattgaaaccgtgctgcttaatttgcggcaaccaactattaccctttcagccaggttagctactggcctactcctcaggcaacaagaaccttcctcccatttaacccaatt

SEQ ID NO: 30887 - protein, 92 aa, Zea mays
  misc_feature: Ceres CLONE 1406834-F
MATKIFSLLMLLALSACVANATIFPQCSQAPIASLLPPYLPSMIASVCENPALQPYRLQQAIAASNIPLSPLFRQSPALSLVQPLETTIRAQ

SEQ ID NO: 30888 - DNA, 633 bp, Zea mays
  misc_feature: Ceres CLONE 1406838-F
  misc_feature: Encodes the peptide sequence at SEQ ID NO. 30889
aaagctggagctccccgcggtggcggccgctctagtcctagaggatcccccgggctgcaggaattcccacgagaccattacctagaacatcctaatcgaaaaaagaaccacaatatgtatcttatcgccttcgatggctgttggcttacgagtaacatctactgacgatctctgaaggaagggtgtagatcaacggctcgggccgcctcaccgtaaccggaagagtgacggtgcctcaaagatccggacttggcgactgagctcaacagagcgaggtgcagccagagactactcaaagacttgtgatcgcgctcgagattgctgctttagacggtgtctcgtatgatcagcctgtgcttgccgatgctgtaccgataaagatggggggtgggccacctccctctggtggtcttcctgccacgtatcactcacaccacgcaagagatctgagacttgcgttgaaggaaaggatttatttaccgtcattgccaccagactgcatatgtgggtagactcatagaatcttccaagcacattgtgaatggcaaatcagtgatcgaccataaaagttggccatatgtatcagaaccatcctcgggctcagggcttctatatcttgcgttatcaccgtag

SEQ ID NO: 30889 - protein, 43 aa, Zea mays
  misc_feature: Ceres CLONE 1406838-F
MGGGPPPSGGLPATYHSHHARDLRLALKERIYLPSLPPDCICG

SEQ ID NO: 30890 - DNA, 631 bp, Zea mays
  misc_feature: Ceres CLONE 1406841-F
  misc_feature: Encodes the peptide sequence at SEQ ID NO. 30891
aaagctggagctccccgcggtggcggccgctctagaactagtggatcccccgggctgcaggaattcgcacgagaccattacctagaacatcctaatcgaaaaatttttcgaccgccgccgcccccagtccccgatccgaagctgtgcctcgtaccatttcgatccaatggcggcgacgtcgaagctgtccacgggcatcaagcgcgcttcgggttcgcacacgtaccatcgccgtgggctgtgggccatcaaggccaagaacggcggcgccttccccaaggccgacgagggcgccgccgccgcggaacccaagttctaccctgccgacgacgtcaagccccgcgttcccagcacccgcaagcctaagcctaccaagctcaggtcgagcatcacgcctgggacggtgctgatcctcctcgacaggcgcttcatggggaagagagtggtgtttctcaagcagctcaggtctggtctgctccttatctctggggctttcaagatcaatggagtaccgatccgccgtgtgaaccagacctatgtcattgctacatcaaccaaagttgacatctctggtgttgatgtcaccaagtttgatgacaagtactttgccagagagaagaagcagaaggtg

SEQ ID NO: 30891 - protein, 155 aa, Zea mays
  misc_feature: Ceres CLONE 1406841-F
  misc_feature (112)..(155): Pfam Name: Ribosomal_L6e Pfam Description: Ribosomal protein L6e
  misc_feature (1)..(49): Pfam Name: Ribosomal_L6e_N Pfam Description: Ribosomal protein L6, N-terminal domain
MAATSKLSTGIKRASGSHTYHRRGLWAIKAKNGGAFPKADEGAAAAEPKFYPADDVKPRVPSTRKPKPTKLRSSITPGTVLILLDRRFMGKRVVFLKQLRSGLLLISGAFKINGVPIRRVNQTYVIATSTKVDISGVDVTKFDDKYFAREKKQKV

SEQ ID NO: 30892 - DNA, 634 bp, Zea mays
  misc_feature: Ceres CLONE 1406847-F
  misc_feature: Pfam Name: COX5B Pfam Description: Cytochrome c oxidase subunit Vb
tggagctccccgcggtggcggccgctctagaactagtggatcccccgggctgcaggaattcgcacgagaccattacctagaacatcctaatcgaaaattcaagattaggaaaggaagcaccggagcaggcgatacggagccaacgacaatgctcataacaagggcttacccagcgatgctcttgctgctcaccgtcgaggtcagatagctcttccgactacccgaatacccctccactctcatcctcgtcatcgtcgcggaactatagcatccaacgccaagcagtgtcgccagtccgagctgctgatgcgatcgacgaagaaaatccagcaggatgtaatagctctggaacctggcgctcacaaccgacaccttcaactccaacgtcgacgtcacgaggctgcttgacattgacttcgccgaacgtcctttagaaactaacgaagatcctggtatagcaaagtcctactatgacaagagaattgtgacatgccctggagcggaaggtcatcagaacacgacggtgagaggttctggctgcagaaaggaaagtcttttgaatggccgcgttgacaccggactttgagctaaaaatggctgcgccaggtgaacctcctgatggaacagcgatgaa

SEQ ID NO: 30893 - DNA, 621 bp, Zea mays
  misc_feature: Ceres CLONE 1406853-F
  misc_feature: Encodes the peptide sequence at SEQ ID NO. 30894
  misc_feature (359)..(359): n is a, c, t, g, unknown, or other
  misc_feature (383)..(383): n is a, c, t, g, unknown, or other
  misc_feature (385)..(385): n is a, c, t, g, unknown, or other
tccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcantacggaaaggacaccccgcggaananggaatgctagagcgagtgccccgaagcgcaccagcaagctgacgcgggcgaggacggcgacagcggcgtggacctctacgtctcccgtttccggaggggcgagtgccggccccagtgcctgccccccccccaggggccgccggggaaaacccagaatggatgaggcgggggccccccccccggaatggccctccaaattggaaaaaaaaaccgtcccggaaaagaaaaagccggaa

SEQ ID NO: 30894 - protein, 63 aa, Zea mays
  misc_feature: Ceres CLONE 1406853-F
  misc_feature (52)..(52): Xaa is any aa, unknown, or other
  misc_feature (60)..(60): Xaa is any aa, unknown, or other
  misc_feature (61)..(61): Xaa is any aa, unknown, or other
MGKGSVGASWWAFLLLAGVLLVVAATAGAEDGVVERDRKEDLRWCKQACEWXYGKDTPRXXEC

SEQ ID NO: 30895 - DNA, 584 bp, Zea mays
  misc_feature: Ceres CLONE 1406865-F
aagctggagctccccgcggtggcggccgctctagaactagtggatcccccgggctgcaggaattcgcacgagaccattacctagaacatcctaatcgaaaaatccatcgcccccctccctctcgctcctttccccccgccttcccctcccggatccccttgggcagccggatccggcgaggcagaaggcgcggctcccacagatccgaggcgcctccgctggggactcgtccggtttcggtgggctcgaccttacaggcggggggcgtaattctgacaggacgacggagccgggtggtgcatgagcgctgagaggccccgccgccgctctgcgtaggagcacggtgcgccgccgtgaggcgccatggatcgagcagtttcgttaatttcggtcatcccggccggccccggtcagaatataatccagatcagtatctatgggagaaagagtttatcccttgctggacggtaaatacaaacgactagacttgaaacttaccaaatggaagagggttatatcttaaaaaggcagccccctatggtcccgggcttttaaccccaaaaaaaaaacggccccccccccgg

SEQ ID NO: 30896 - DNA, 586 bp, Zea mays
  misc_feature: Ceres CLONE 1406872-F
  misc_feature (203)..(203): n is a, c, t, g, unknown, or other
  misc_feature (232)..(232): n is a, c, t, g, unknown, or other
tccccgcggtggcggccgctctagaactagtggatcccccgggctgcaggaattcgcacgagaccattacctagaacatcctaatcgaaaagcgccgtccttccccttctccttgcgcaggttcaggcctgaccgcctgagaaactggaaggtggcggcgacctccggggttgatcggcgacttgggtcggattagtttccgnaagagcactggagggagaagcctgtttgnagcaatttcgatggcaccggcgagaccgcgtggatcgtcccaaggacctctcggccccgcgacatggatttgcaggggaggagcacgtccccaggcgcggaagcgtacccatccccaaccacggaaaatgtgacgaggacaaccccgggggtccctgaggccctgtaatttccggttcccccctgggccccaataaaaagaaaatttgggcccaaattggccggggaaatcccgggccccccccaaaaaattttctccacagggtttcccaaaaactcccccgagggggaaaaccccttgtgggggcccccgcccggggaaataaaaacccccccccccgcccccccccaaaaa

SEQ ID NO: 30897 - DNA, 716 bp, Zea mays
  misc_feature: Ceres CLONE 1406874-F
  misc_feature: Encodes the peptide sequence at SEQ ID NO. 30898
cgctcttaactagtggatcccccgggctgcaggaattcgcacgagaccattacctagaacatcctaatcaaaaacagcccgtccgacgccgcgttagctacttgcctacttcagctatatgaaacggcaaaagtcttcccctcgttccccaatctcctctccatcgaaaccctagcacgacgcaattcccgtcttcccacgccgtgtcgccgttgctatgggcaagaagcggaagctcgagcccaaatcggcggcagggttcacgccggttaaggcctccccgaccaccaggtctgccaccgctaaggccgctggtctatccgaggtcctcgcccccgtcgaggctacgatggagaagctgccgcagggggcaggcggcgaggatgtagaggaaatcgaggaggtggaggtcgaggaggaagtggaagtggaagaggaagaagaaggcgagagcgaccaggcttcgatccaggcgctgctggattcgttccccaaggaccagctcgtcgagctgttacgcgacgctgccatcgctcacggcgacgtgctaaccaccatccggcgcgtggccgacgccgacccggctcagcggaagatcttcgtacacggcctcggctgggacaccacaaccgacaccctcaccgaggccttcggccccatacgtgagatagaggatctcaaggtcgtcaccgaccgcaacacgggcaagtgcaagg

SEQ ID NO: 30898 - protein, 166 aa, Zea mays
  misc_feature: Ceres CLONE 1406874-F
MGKKRKLEPKSAAGFTPVKASPTTRSATAKAAGLSEVLAPVEATMEKLPQGAGGEDVEEIEEVEVEEEVEVEEEEEGESDQASIQALLDSFPKDQLVELLRDAAIAHGDVLTTIRRVADADPAQRKIFVHGLGWDTTTDTLTEAFGPIREIEDLKVVTDRNTGKCK

SEQ ID NO: 30899 - DNA, 659 bp, Zea mays
  misc_feature: Ceres CLONE 1406880-F
  misc_feature: Encodes the peptide sequence at SEQ ID NO. 30900
gctctttcctaaaggatcccccgggctgcaggaattcccacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttacacggccaaaccagcccaaaccccaaagccacagtagtaacaggggcacactagctaacctaaacctcgccacggcacagcaatgacgccgctccccgcttccctcacgccctgcctctggctcttcctctgcctcctcgctgcgccgtgccccgcggcgcgggcggcgcgattcgcgtgcaacgccacggcgccgcgagcgtccacgtgccacgggttcgcctcctacgcgccgcccaacgggacggacacgcccacgctggccgacgtgccggcgctctatcagctccgctcacaccgtgcgctgctgggcggcaaggtccccccgctttcaaggcgcccacggcgccccggccagtgccaatgggggaccgcctggcctggcctctgttagggggcagccggggccaccatc

SEQ ID NO: 30900 - protein, 103 aa, Zea mays
  misc_feature: Ceres CLONE 1406880-F
MTPLPASLTPCLWLFLCLLAAPCPAARAARFACNATAPRASTCHGFASYAPPNGTDTPTLADVPALYQLRSHRALLGGKVPPLSRRPRRPGQCQWGTAWPGLC

SEQ ID NO: 30901 - DNA, 762 bp, Zea mays
  misc_feature: Ceres CLONE 1406882-F
  misc_feature: Encodes the peptide sequence at SEQ ID NO. 30902
aaagctggagctccccgcggtggcggccgctctagaactagtggatcccccgggctgcaggaattcgcacgagaccattacctagaacatcctaatcgaaaaaacccaacccaaccgcgctttttgtcacctctcacctggaaagggaagacaagtcgagattcgagaaggcaaatcgaattcgacatgggcatggctgctccgcgcgcgccgctgcctctcccccaactgctgctcctcctcgttgctgcgctcctcgccgccgctcccctccctagggcggccggggcggacgagttcgacgtccgccgacacctctccaccgtcaccaggtatgatgtggccagtgaggccagtagtgtcatctccatgccgtcaatcccagacgggtgccgtgtcattcacctcaatctatgggcaagacatgggactcgtgctcctaccaagaagcgcatcacggagctggatagattggcagttcgactggaagcccttctgaaagaggcaaatcaagttcttgatagtgattctctgaagaatattccatcctggattagaggctgagaatcacgctggaagggtaggactacaggtggtgagctgattactgaaggacaacaggagctgtacaatttagctaccagaatgagggagaggtttcaagatctatctgatgacgaatatcaccctgatgtatattcaataagagcaacccaggtgtctcgagcatcagctactgcagaggcatctgagttgagacaa

SEQ ID NO: 30902 - protein, 125 aa, Zea mays
  misc_feature: Ceres CLONE 1406882-F
MGMAAPRAPLPLPQLLLLLVAALLAAAPLPRAAGADEFDVRRHLSTVTRYDVASEASSVISMPSIPDGCRVIHLNLWARHGTRAPTKKRITELDRLAVRLEALLKEANQVLDSDSLKNIPSWIRG

SEQ ID NO: 30903 - DNA, 657 bp, Zea mays
  misc_feature: Ceres CLONE 1406887-F
  misc_feature: Encodes the peptide sequence at SEQ ID NO. 30904
  misc_feature (480)..(480): n is a, c, t, g, unknown, or other
  misc_feature (563)..(563): n is a, c, t, g, unknown, or other
  misc_feature (597)..(597): n is a, c, t, g, unknown, or other
  misc_feature (637)..(637): n is a, c, t, g, unknown, or other
aaagctggagctccccgcggtggcggccgctctagaactagtggatcccccgggctgcaggaattcgcacgagaccattacctagaacatcctaatcgaaaaagatcgggtcctaggctacagcagccgccgcatccgtcaccttcacaccgcgtgcgtgctctctctccccctccccctctccgtgcgacgactgggtgggctaccgccgccctacgcaaggtgccgagaacttcgccgatatctgcgccggagaagagcgcccaccagatcaggcgcttagaaggcgcgctggccggtggatgacgatggcgggtggcgggggactgaaccggtcttcatcgagggggcagctgccgccgcaagagctgcttgacgatctctgcagccggttccttctgaatgtgcccaaggaggagctggagtcgttcgagcggatcctgttcctgctggagcaggcgcactggttctatgaggacnactccgttgagcacaaccccaaccctcagtccctctcctttcaggacttcacttccctcatggtccagagctgcactgctctncggccctacatcgcgcacctggatgatatctacnaggactttcacactaccagtttcgtgtggctgggtccggngcatcatcctaaacgacctt

SEQ ID NO: 30904 - protein, 116 aa, Zea mays
  misc_feature: Ceres CLONE 1406887-F
  misc_feature (19)..(103): Pfam Name: DCP2 Pfam Description: Dcp2, box A domain
  misc_feature (58)..(58): Xaa is any aa, unknown, or other
  misc_feature (97)..(97): Xaa is any aa, unknown, or other
  misc_feature (110)..(110): Xaa is any aa, unknown, or other
MAGGGGLNRSSSRGQLPPQELLDDLCSRFLLNVPKEELESFERILFLLEQAHWFYEDXSVEHNPNPQSLSFQDFTSLMVQSCTALRPYIAHLDDIYXDFHTTSFVWLGPXHHPKRP

SEQ ID NO: 30905 - DNA, 659 bp, Zea mays
  misc_feature: Ceres CLONE 1406905-F
  misc_feature: Translation starting site: 428
  misc_feature: Pfam Name: Patatin Pfam Description: Patatin-like phospholipase
  misc_feature (659)..(659): n is a, c, t, g, unknown, or other
cgcggtggcggccgctctagaactagtggatcccccgggctgcaggaattcgcacgagaccattacctagaacatcctaatcaaaaaacaatctttgtattatatataaatagcttgccagagccagcgaatgcagagcacaagatccaagaaacacaactgcaaaagcgaggatcggagcactccgatccttaattccttcttggattctcttctactctagagctctgctagaccgatctccagttaagtttcagacacatggagagcaacgcctcgtccaactgcgccaccgtgccgcagccgccgccgtcgacagggaagctgatcacgattctgagcatcgatggtggcggcatccgcggcctcatcccagccaccatcatcgcgcacctcgaggccaagctgcaggagctggacggcccagatgctcggatcgccgactaacttcgacgtgatcgccgggacgagcaccggcgcccttctcacgtcgatgctggcggcgccggaccagaacaaccggccgctgttcttcgcaaaggacctcaacacgttctacctcgagaacgggcccaagatctccctcagaaaaaaaggccggttccttggacgccggtgcgaacctgctgggctctgggggtgagggtccagagaccacn

SEQ ID NO: 30906 - DNA, 688 bp, Zea mays
  misc_feature: Ceres CLONE 1406908-F
  misc_feature: Encodes the peptide sequence at SEQ ID NO. 30907
  misc_feature (586)..(586): n is a, c, t, g, unknown, or other
aagctggagctccccgcggtggcggccgctctagaactagtggatcccccgggctgcaggaattcgcacgagaccattacctagaacatcctaatcaaaaaactatcctaccaggcaccactcgcatcgtgtgctcagtcagatccccgtcccgcatttcctaaggccaggttagttggcattgaagacgatgactgcttctgcagctgctggtgtgcagatggtggctgcacgcccttgcatttcggcctcgccaggaattcttaccgcacgggtttctaggactgattgcatgctcagtaccactgctacattccccaaaatcagctgctcctggcctctaaggtttaagcgcaatgatgttgttgtaagagcaatatcggaagagtgtggcccgcaggggcttcccattgatctcagaggtaaaagggcattcattgctggagttgctgatgataatggctatggatgggcaattgcgaaggcacttgctgcggctggtgctgaaattcttgtgggtacatgggtgccggcacttaacatatttgagacaagtctgaggcgtggaaagtttgatgaatcacgnaagctgccagatggatctcttatggatatttgttaagtctatccacttgatgctgtctacgatcccccctgatgatgtccctgagatgtcaaatcgaacaaa

SEQ ID NO: 30907 - protein, 143 aa, Zea mays
  misc_feature: Ceres CLONE 1406908-F
  misc_feature: SWISSPROT Homolog: EC 1.3.1.9 Enoyl-[acyl-carrier-protein] reductase (NADH)
MTASAAAGVQMVAARPCISASPGILTARVSRTDCMLSTTATFPKISCSWPLRFKRNDVVVRAISEECGPQGLPIDLRGKRAFIAGVADDNGYGWAIAKALAAAGAEILVGTWVPALNIFETSLRRGKFDESRKLPDGSLMDIC

SEQ ID NO: 30908 - DNA, 676 bp, Zea mays
  misc_feature: Ceres CLONE 1406910-F
  misc_feature: Encodes the peptide sequence at SEQ ID NO. 30909
cgcggtggcggccgctctagaactagtggatcccccgggctgcaggaattcgcacgagaccattacctagaacatcctaatcgaaaagaacgagtattttgagtcaactcacaagggtagttcaaagtccagaattccagactcgcgttcgcacgccgcctttcgcgctgccttagcgccttagcctgctagggctcgtcgattcatcgccggctcgacttctgatctcgcgggcagagcagcgcgccggcgcgatggcttcggatccggatgtgtccggcggcgagcaggcggagccgcccgacgatgtggacgaccccgacgtcgacgaggtcgaccccaccggccgctacttcaggtacaaggaggtcgtgggatcaggggccttcaagacagtctacaaaggtttcgacgtggtcgaaggcatcgaggtggcatgggctaaaggggagataaacggccggaccatgggatcccccaaggagctccagcggtccaagacggagatccagctgctgcggtcgctccatcacaagcacattctcaagctctacaccctcatgggtcgacaacaaggaaagagggcggtcaatataatcactggaggctttttcacgtccggcaactttggagaggagtaccgtacgaagtcaccaagatagtttgacatgaaggg

SEQ ID NO: 30909 - protein, 135 aa, Zea mays
  misc_feature: Ceres CLONE 1406910-F
  misc_feature: SWISSPROT Homolog: EC 2.7.11.1 Non-specific serine/threonine protein kinase
MASDPDVSGGEQAEPPDDVDDPDVDEVDPTGRYFRYKEVVGSGAFKTVYKGFDVVEGIEVAWAKGEINGRTMGSPKELQRSKTEIQLLRSLHHKHILKLYTLMGRQQGKRAVNIITGGFFTSGNFGEEYRTKSPR

SEQ ID NO: 30910 - DNA, 669 bp, Zea mays
  misc_feature: Ceres CLONE 1406914-F
  misc_feature: Encodes the peptide sequence at SEQ ID NO. 30911
aaagctggagctccccgcggtggcggccgctctagaactagtggatcccccgggctgcaggaattcgcacgagaccattacctagaacatcctaatcgaaaagtggcttctcattcattgttgattgattgatcctccccgcctcactcctttgtctcctcgcctcgtgctcgctcgctcccctcgccctggcgaggagggcagcagaaaccctagcggctcaggccggccgggggttagatgctccaagggtcgagagggaagggcaggttagtggtgcgccatcgactatgggctgcgtcttcggccggacggctgcgtcgtcctctgcagcgccgaagaagaaggggctatggggagggcgtgccagacattacaagtctgaaccttctcttcaggcgacagaacaaaatgggattaaagggcacagcatgctggctccattcacagcgggatggcagagcactgatgtacacccattggttatagagagatcagagggttcttatgtctatgacagcaatgggaagaagtatattgatgctcttgcaggactgtggtgcacagctttaggtggtaatgagcctcgactagtcaaagcggcaactgagcaattaaacaaattaccgttctaccattccttttggaaccgtacaaccaaaccctcat

SEQ ID NO: 30911 - protein, 126 aa, Zea mays
  misc_feature: Ceres CLONE 1406914-F
  misc_feature: SWISSPROT Homolog: EC 2.6.1.62 Adenosylmethionine--8-amino-7-oxononanoate transaminase
MGCVFGRTAASSSAAPKKKGLWGGRARHYKSEPSLQATEQNGIKGHSMLAPFTAGWQSTDVHPLVIERSEGSYVYDSNGKKYIDALAGLWCTALGGNEPRLVKAATEQLNKLPFYHSFWNRTTKPS

SEQ ID NO: 30912 - DNA, 621 bp, Zea mays
  misc_feature: Ceres CLONE 1406915-F
  misc_feature (293)..(293): n is a, c, t, g, unknown, or other
  misc_feature (302)..(302): n is a, c, t, g, unknown, or other
  misc_feature (307)..(307): n is a, c, t, g, unknown, or other
  misc_feature (428)..(428): n is a, c, t, g, unknown, or other
  misc_feature (464)..(464): n is a, c, t, g, unknown, or other
  misc_feature (465)..(465): n is a, c, t, g, unknown, or other
  misc_feature (474)..(474): n is a, c, t, g, unknown, or other
ggcggtgggcggccggctctagaactagtggatcccccgggctgcaggaattcgcacgagaccattacctagaacatcctaatcgaaaaacgtaaggacaaacgcgaacggaaccctccccagcagatgagcggagtaggtgggcggggttctcttccactcccgctccagctttctctggcccgatcgatgctacattcccgcggcgagccgctcgccttcctccgcgggccttgggctacccaacccatcgccgagccgcctcgcgcggtccccccctcatctttgccggnctctctcgnctcgnaggacggacagagaaagagaggatgagaagggactcctcgaccccgcgtccgcgctcgggctatggaaccgaaggggtggcggtggattttgagcgcggggtgggactcgtcgctgatgtnattctcgatgcaagagccaggaaaaaacggaaaggnncgcggcggncgccgaatcccgaggggtcccccttaacggccgggcaagggaaacgggagctgtgaacacaaaagccggaaaagggaatacccctgggccttagggaaaagggcaatttgggccccgggaaaaaaaaggggaagggggaaaaaccct

SEQ ID NO: 30913 - DNA, 660 bp, Zea mays
  misc_feature: Ceres CLONE 1406917-F
  misc_feature: Encodes the peptide sequence at SEQ ID NO. 30914
tccccgcggtggcggccgctctagaactagtggatcccccgggctgcaggaattcgcacgagaccattacctagaacatcctaatagaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccgccatcgcgctggcgctcatggcgggcgggttcgtcacctccggcggcctcggcgtcgctgcgctgtccgtgttctccctggatgtacaagtaccctgacgggccaagcacccgccgggcgcccgaccagcttggacccacgccaggccgaggcttggcggtcccaaggctccgcggcatccaagggatgcaggcacaagcacccggcttcgacccagg

SEQ ID NO: 30914 - protein, 117 aa, Zea mays
  misc_feature: Ceres CLONE 1406917-F
  misc_feature (36)..(116): Pfam Name: Oleosin Pfam Description: Oleosin
MADHHRGATGGGGGYGDLQRGGGMHGEAQQQQKQGAMMTALKAATAATFGGSMLVLSGLILAGTVIALTVATPVLVIFSPVLVPAAIALALMAGGFVTSGGLGVAALSVFSLDVQVP

SEQ ID NO: 30915 - DNA, 632 bp, Zea mays
  misc_feature: Ceres CLONE 1406921-F
  misc_feature: Encodes the peptide sequence at SEQ ID NO. 30916
  misc_feature (309)..(309): n is a, c, t, g, unknown, or other
  misc_feature (336)..(336): n is a, c, t, g, unknown, or other
  misc_feature (359)..(359): n is a, c, t, g, unknown, or other
ggagctccccgcggtggcggccgctctagaactagtggatcccccgggctgcaggaattcgcacgagaccattacctagaacatcctaatcaaaaccagatccctcttccctctccgctcccccacgtcatctagtcgccgcccccgctcaccgattgtcctctgctgtggagcgagcaagcagcggcgaagcgatggaggaggagatcagaaaggagttccagagtaacggcttctccatcggaggagccggccccgaggacgccgcccagatcctctccacgctgctgacctactgcatcaactacnagatgagccccgcggatctcgtctcanactgggaggtctactacctcaantaggcatttggatggcttaaagctcgaaagctcgtatctggatggttttctgtcacaccttcaaaatgaagttaaagacgggataataaaagaggagcttaccctcacatttactccggaaacgatgttaacatggtcttaggcattccctgggaaatgaaacagcattccttgaccccccgggttttaaaagggaaaaggcccctgaaggccccctttttttaaggtaatcccccggggaaggggaaaaacccttcccccccaagggggcca

SEQ ID NO: 30916 - protein, 54 aa, Zea mays
  misc_feature: Ceres CLONE 1406921-F
  misc_feature (39)..(39): Xaa is any aa, unknown, or other
  misc_feature (48)..(48): Xaa is any aa, unknown, or other
MEEEIRKEFQSNGFSIGGAGPEDAAQILSTLLTYCINYXMSPADLVSXWEVYYL

SEQ ID NO: 30917 - DNA, 628 bp, Zea mays
  misc_feature: Ceres CLONE 1406924-F
  misc_feature: Encodes the peptide sequence at SEQ ID NO. 30918
  misc_feature (343)..(343): n is a, c, t, g, unknown, or other
ggagctccccgcggtggcggccgctctagaactagtggatcccccgggctgcaggaattcgcacgagaccattacctagaacatcctaatcgaaaactcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggtgtcgacggcctcccgccggggcctccgggttggccggtggntggggaacctgttccaggtgatcctgcagcgactggcccttcattgtacgtggtgcgcgacctccgggagaagtacggggccatcttcccccatgggaatggggcacggcaccccccatcgggggcacctccggggggactccttccccaaggggcttggggaaacaaggccccatggttcccgaacccggccccaaggaaagcccccacccgccctcctttttaaagggggggaaaatgggacccggaaaaatttgggggcccctaaggcccccccgtgggggg

SEQ ID NO: 30918 - protein, 115 aa, Zea mays
  misc_feature: Ceres CLONE 1406924-F
  misc_feature (41)..(41): Xaa is any aa, unknown, or other
MDVNDVLLVVLAAALAAMWWRRCSKTGVDGLPPGPPGWPVXGEPVPGDPAATGPSLYVVRDLREKYGAIFPHGNGARHPPSGAPPGGLLPQGAWGNKAPWFPNPAPRKAPTRPPF

SEQ ID NO: 30919 - DNA, 683 bp, Zea mays
  misc_feature: Ceres CLONE 1406925-F
  misc_feature: Encodes the peptide sequence at SEQ ID NO. 30920
  misc_feature (401)..(401): n is a, c, t, g, unknown, or other
  misc_feature (588)..(588): n is a, c, t, g, unknown, or other
  misc_feature (598)..(598): n is a, c, t, g, unknown, or other
cgctctagaactagtggatcccccgggctgcaggaattcgcacgagaccattacctagaacatcctaattgaaaacttccaatttttctcccaaataaaaaccagccgcagcgggaggtggcgcgacgcgaacccacccaccctgcgaacccggccgcaaaattctcctctcggattccgccgccgcgaaccgtcccctcgacgaggctgctgcgatagatttttcttaccattcgaatagttgatgagcgagaatacagagcaagaatcttgatggtgcgtgtggtacaacttggttaaggaaagctgactgcttgaagtgaccatgttggaccatcttgctatcattgcgtctgagttaggggacgacgcatcggattttgaggttgatggcatcgacnacctcagcgagaacgatgtcagcgactaggagatcgatgctgacgagctcgcccgacgaatgtggtacgacaagggtcagctaaaagagatcagggagaggcagcagaagcttgccctgcagcggctggagctggagaaaccaggacaaagaagatttcggaccaggccctccgggatgagatgacnagggcccagnacgggatcctcaagaaatgctcaagttgatgaaggggggcaagcccaagggttcgggacgggatctttcctgaaaaaggaaaccc

SEQ ID NO: 30920 - protein, 34 aa, Zea mays
  misc_feature: Ceres CLONE 1406925-F
  misc_feature (26)..(26): Xaa is any aa, unknown, or other
MLDHLAIIASELGDDASDFEVDGIDXLSENDVSD

SEQ ID NO: 30921 - DNA, 650 bp, Zea mays
  misc_feature: Ceres CLONE 1406929-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (46)..(46): n is a, c, t, g, unknown, or other
  misc_feature (47)..(47): n is a, c, t, g, unknown, or other
  misc_feature (51)..(51): n is a, c, t, g, unknown, or other
  misc_feature (54)..(54): n is a, c, t, g, unknown, or other
  misc_feature (61)..(61): n is a, c, t, g, unknown, or other
  misc_feature (62)..(62): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
nnnnggggnnnnnnnnnnggggggnnngggggnngnnngnnncganngggnggnggggcanncggccgnnnggcggannnnntnnnnnnnnnaaaagctggggctccccgcggtggcggccgctctagaactagtggatcccccgggctgcaggaattcgcacgagaccattacctagaacatcctaatcgaaaaatccgactaaaaagggccagggccagggccttcgcttgcttactactcctgcttacacactctaccttgtctcttcacgtgcacacgacgcctcccccaatggctgcgggtggcggaggaaggaggtgatccgtcgtcgggcgcgggggcaagtccggggcctaaccgggtggccggccgtggccctgtcccctgccccggctggcgggccccttgttcctggaacgcaacaacctggcggggggcccctgggggcgaaaaagggcctataaaacggcctccccctcccccccccccaaaaaaaatgggggggttgtgggaaagggccccaaacccgggggggggagcccccccggtaaccttggcccccgggaaaaaattttttggggggaaccccgggggggggggacccccccgcggcgggtttttttggttttccccccccgcgggctccc

SEQ ID NO: 30922 - DNA, 697 bp, Zea mays
  misc_feature: Ceres CLONE 1406932-F
  misc_feature: Encodes the peptide sequence at SEQ ID NO. 30923
  misc_feature (697)..(697): n is a, c, t, g, unknown, or other
gctctatcccagtggatcccccgggctgcaggatttcgcacgagaccattacctagaacatcctaatcaaaaagacggcacggcggacgcgctctcctctcctctcctcttcttccggctctccctctccgcatgccattccaacgcattacaggtatttttagccgccggaggagacgggtagctgcgtagccacactagcgagagagagagagagagagagggaggggaaaccatagctcctggccgttccgcgttcctcacgggcggcctccgtccgttctgcctgcccatccaccgcggcgccggccggccgtctcccgtccacatccctcctcctctcctgcaaggttcctgtgcggtatggtatgctagctcggctccctgtggtttcccccctcatccggaatgtgatggcgcggtggatggtgttttgatctgtgttcgcttttggcggatctggtcgcgcgcagtagcgcagaggggtcggagtcggagtcggagaagatgatgggcgggttcctctccagggtcctcctgttggcttttggctatgcctatcctgcctacgaatgctacaagactgttgaactaaacaaaccagagattgcgcagctcatattttggtgtcagtattggattttagttgccctgttgacagttttggagagatttggagatttcaccatatcatggn

SEQ ID NO: 30923 - protein, 63 aa, Zea mays
  misc_feature: Ceres CLONE 1406932-F
MMGGFLSRVLLLAFGYAYPAYECYKTVELNKPEIAQLIFWCQYWILVALLTVLERFGDFTISW

SEQ ID NO: 30924 - DNA, 693 bp, Zea mays
  misc_feature: Ceres CLONE 1406935-F
  misc_feature: Encodes the peptide sequence at SEQ ID NO. 30925
aaagctggagctccccgcggtggcggccgctcttcactagtggatcccccgggctgcaggtaattcgcacgagaccattacctagaacatcctaatcgaaaaagttcttctccacctcgtcctcctcctgctcctgcattctcgcccgtcccccaaattcaccttggccaccctccaccacctcgtcgacgcgggcagcagttcgcctcatcgtcctcccacctgacgacgtcgcggttcgcgctctcgcggcgtgccgcgcacccacgtctcccgcgagttccacgccttctgtgccacgcgcggacgcgccacctggagccactgttcgccgcgccctccgcatctccgacctctacatctccatccgcggaagcagaccacctccaatccttctttttcacgcagtcattgcttgcctccttagcccaactgttggtaccagaggttcatgtttcatcataaggaatgaacagtagtcgacaaatggaactccactacataaacactggatttccatacacaatcaccgagagcttcatggatttctttgagggtctcacttttgctcatgctgactttgctctcacggatggctttcaggatcagggtaatccatactgggaaatgatgcatacaaactcgtacaaatatggatactctggtcctgggaactattacagttatgctcag

SEQ ID NO: 30925 - protein, 75 aa, Zea mays
  misc_feature: Ceres CLONE 1406935-F
MNSSRQMELHYINTGFPYTITESFMDFFEGLTFAHADFALTDGFQDQGNPYWEMMHTNSYKYGYSGPGNYYSYAQ

SEQ ID NO: 30926 - DNA, 673 bp, Zea mays
  misc_feature: Ceres CLONE 1406937-F
  misc_feature: Translation starting site: 252
  misc_feature (483)..(483): n is a, c, t, g, unknown, or other
  misc_feature (565)..(565): n is a, c, t, g, unknown, or other
  misc_feature (631)..(631): n is a, c, t, g, unknown, or other
caaagctggagctccccgcggtggcggccgctctagaactagtggatcccccgggctgcaggaattcgcacgagaccattacctgaacatcctaatcgaaaaacgaaatggttttgccttcgcttttgcttatgcgtacgcgcggcgaatcacggcgcccaccttccaaccggacttgagtcacttgactccgccgcgggattccccgccagatctcattctcgccccaaccctaaccgccgacggtggccatgatggccaccgagcccttgtccccggggaatctcgtcgaggacgtcgaaacactacccctggactcctcctccactctcgcggctacgacggacccgctgctccgcccacctcccccctcgtccaccttctctcccaccgccggtgagaaccatggcgcttttctggacgaggaggatgaggacgtggtggatgacttcacgcctccgctggctccccatgccgctacgnccgcgacgaagtcccgcgaggcggtcaccgtgggttcgctgagatcactgtctccgagcctaggaagcacgcggagcccggnaccggaggccgtgggcgtcattcccggctcggccagctacgtctcctacctctcgccactcggtgnccgaccgggaggaagttccgcgtgcgtcggcgattccccggg

SEQ ID NO: 30927 - DNA, 678 bp, Zea mays
  misc_feature: Ceres CLONE 1406940-F
  misc_feature: Encodes the peptide sequence at SEQ ID NO. 30928
  misc_feature (432)..(432): n is a, c, t, g, unknown, or other
tccccgcggtggcggccgctctagaactagtggatcccccgggctgcaggaattcgcacgagaccattacctagaacatactaatcgaaaaattttcggccacaccctccttgcctccacggctccacccctgcttcaggttacctgtgccagcgacgccggtagaagccatggacagctctctcgcgagcgcggcggcgatagccgatcagcgccagaagatcgagcagtaccgccacatcctcgcctccgtcctctcgtcttccccaccggacatctctcaggccaagcgctttctcgaccacatggtttcggacgaagttccgctcgtggtgtcgcgtcaattgctccagacgttcgcgcaggacctagggaagctggagtcggacgcgcataaggaggttgcccactacgcgctcacgcagatccagnccgcgtgtggtctccttcgaggagcaggtggtagtgattagagagaagcttgcagagctatatgagtctgaacaacaatggtcaaaagcagacaaatgctttagtgggattgacttggattcaggaatcaggatgcttgatgacaccaacaatttattccaagtgtgttcaaattgcacgatcctaatttaagaggattgatgaatgcagtgaaatggctgaggcttttataaacagggttttcat

SEQ ID NO: 30928 - protein, 100 aa, Zea mays
  misc_feature: Ceres CLONE 1406940-F
  misc_feature (88)..(88): Xaa is any aa, unknown, or other
MDSSLASAAAIADQRQKIEQYRHILASVLSSSPPDISQAKRFLDHMVSDEVPLVVSRQLLQTFAQDLGKLESDAHKEVAHYALTQIQXACGLLRGAGGSD

SEQ ID NO: 30929 - DNA, 662 bp, Zea mays
  misc_feature: Ceres CLONE 1406942-F
  misc_feature: Encodes the peptide sequence at SEQ ID NO. 30930
  misc_feature (365)..(365): n is a, c, t, g, unknown, or other
  misc_feature (662)..(662): n is a, c, t, g, unknown, or other
tccccgcggtggcggccgctctagaactagtggatcccccgggctgcaggaattcgcacgagaccattacctagaacatcctaatcgaaaagaacgagtattttgagtcaactcacaagggtagttcaaagtccagaattccagactcgcgttcgcacgccgcctttcgcgctgccttagcgccttagcctgctagggctcgtcgattcatcgccggctcgacttctgatctcgcgggcagagcagcgcgccggcgcgatggcttcggatccggatgtgtccggcggcgagcaggcggagccgcccgacgatgtgacggaccccgaccgtcgacgaggtcgaccccaccggccgctacttcaggntacaagggaggtcgtggggatcaggggccttcaagacagtctacaagggttttcgacggtggtcgaagggcatcgaaggtggcatggggctaaaggggaagaataaacggcggaacccatgggatccccccaaggagctccagcgcctccaagacgaagatcaagttggttgcggtcgctccatcacaagcacattctcaagtctaccccctcctgggcgacaaaagaaaaaaggcgggccaaaataaccctggggcttttcacggcggaaacttggaaaaaggacccgtcaaaccn

SEQ ID NO: 30930 - protein, 70 aa, Zea mays
  misc_feature: Ceres CLONE 1406942-F
  misc_feature (36)..(36): Xaa is any aa, unknown, or other
MASDPDVSGGEQAEPPDDVTDPDRRRGRPHRPLLQXTREVVGIRGLQDSLQGFSTVVEGHRRWHGAKGEE

SEQ ID NO: 30931 - DNA, 690 bp, Zea mays
  misc_feature: Ceres CLONE 1406945-F
  misc_feature: Translation starting site: 291
  misc_feature: Pfam Name: DUF569 Pfam Description: Protein of unknown function (DUF569)
  misc_feature (545)..(545): n is a, c, t, g, unknown, or other
  misc_feature (592)..(592): n is a, c, t, g, unknown, or other
  misc_feature (632)..(632): n is a, c, t, g, unknown, or other
  misc_feature (633)..(633): n is a, c, t, g, unknown, or other
  misc_feature (637)..(637): n is a, c, t, g, unknown, or other
  misc_feature (648)..(648): n is a, c, t, g, unknown, or other
  misc_feature (649)..(649): n is a, c, t, g, unknown, or other
aaagctggagctccccgcggtggcggccgctctagaactagtggatcccccgggctgcaggaattcgcacgagaccattacctagaacatcctaatcgaaaaacgcagcagcgacgcgacgcccccgccccgcgtcttctactcttcttcatcttcactgctcaccaacccatccatcccccagtcctcctcactgctcacccgtctcccatccccacaccaccaccaccaccatcttccggtcttcccctccccacacccggcgggatccccaccatccccgccccccgatggagctgttcgcgcgcgccaaggtggtgcggctcaagagccaccacgacaagttcctgtacgcggacgaggacgaggcgcacgtgacgcaggaagcgggacgggtcgtcggcgaacgcgcggtgggcccgtggagccggcgccgcacaacccgggcgccatccgcctgcggagccggtacggccactacctcaccgcctccggggagccgttcctgctgggggatgacggggccggaaggtgacgcagacggngcccgccgcgccccgccccggcaacgcgtccgtggactgggagcccngtgcggggacggctttcagggcgcgccctcgcaccaaggnngggncactttctcgnnggcccaaggggggggttccggccctggaagaactccgtccc

SEQ ID NO: 30932 - DNA, 583 bp, Zea mays
  misc_feature: Ceres CLONE 1406951-F
  misc_feature: Encodes the peptide sequence at SEQ ID NO. 30933
  misc_feature (326)..(326): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (454)..(454): n is a, c, t, g, unknown, or other
  misc_feature (455)..(455): n is a, c, t, g, unknown, or other
tccccgcggtggcggccgctctagaactagtggatcccccgggctgcaggaattcgcacgagaccattacctagaacatcctaatcaaaagtggactgtcctcaggacaatcgccaaaaccccccgagccaacacctactacgccgccgcgccgccgcgtcaaacaacggcgagaggacgcctatggcattcacttcccaatccctaatcttccgggcacccgcctcgccctcttgtgcccgcataaccccgtcatccggtcgcgtcaccctccgggaccgcagcgccgttttcccgctcgtcgcggcggtctccacctcgatggncgtcctcggagaagcggaaaataaagaggggggaaccaccccccccttttggggggggnnnggggtctttccaagggaggggggggggcgcccccaccccaacccccccggggggggggggggggggnnttttttgggggggggggggcttccccccccccggggggggggggggccaaaaaaaaaaaaaaagggggggggggggggggggggggccccccccccccccccctttttttttgggggggagaaaaaaa

SEQ ID NO: 30933 - protein, 87 aa, Zea mays
  misc_feature: Ceres CLONE 1406951-F
  misc_feature (2)..(2): Xaa is any aa, unknown, or other
  misc_feature (22)..(22): Xaa is any aa, unknown, or other
  misc_feature (45)..(45): Xaa is any aa, unknown, or other
MXVLGEAENKEGGTTPPFWGGXGVFPREGGGRPHPNPPGGGGGGXFLGGGGLPPPRGGGGPKKKKKGGGGGGGAPPPPPFFFGGEKK

SEQ ID NO: 30934 - DNA, 679 bp, Zea mays
  misc_feature: Ceres CLONE 1406953-F
  misc_feature: Encodes the peptide sequence at SEQ ID NO. 30935
aagctggagctccccgcggtggcggccgctctagcactagtggatcccccgggctgcaggaattcgcacgagaccattacctagaacatcctaatcgaaaaaccaacaagtgcagtcacccgagccgcaaactgcagctctgcaagctacagaggccaccacgagtccacgacgccacgccctccgagagaaagagaaagagaaaaccaaagcacgataatgcccccgacccccacagccgccgcagccggcgccgccgtggcggcggcatcagcagcggagcaggcggcgttccgcctcgtgggccaccgcaacttcgtccgcttcaacccgcgctccgaccgcttccacacgctcgcgttccaccacgtggagctctggtgcgccgacgcggcctccgccgcgggccgcttctccttcggcctgggcgcgccgctcgccgcacgctccgacctctccacgggcaactccgcgcacgcgtccctgctgctccgctccggctccctctccttcctcttcacggcgccctacgcgcacggcgccgacgctgccaccgccgcgctgccctccttctccgccggcgacgcgcggagcttcacagccgaccagcggactcgcggtgcgcgccgtcacgctccgcgtcgacgaacccgagggacgccttccgagtcagagccga

SEQ ID NO: 30935 - protein, 153 aa, Zea mays
  misc_feature: Ceres CLONE 1406953-F
  misc_feature: SWISSPROT Homolog: EC 1.13.11.27 4-hydroxyphenylpyruvate dioxygenase
MPPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAGDARSFTADQRTRGARRHAPRRRTRGTPSESEP

SEQ ID NO: 30936 - DNA, 612 bp, Zea mays
  misc_feature: Ceres CLONE 1406958-F
  misc_feature: Encodes the peptide sequence at SEQ ID NO. 30937
  misc_feature (237)..(237): n is a, c, t, g, unknown, or other
  misc_feature (257)..(257): n is a, c, t, g, unknown, or other
  misc_feature (258)..(258): n is a, c, t, g, unknown, or other
  misc_feature (296)..(296): n is a, c, t, g, unknown, or other
  misc_feature (301)..(301): n is a, c, t, g, unknown, or other
  misc_feature (302)..(302): n is a, c, t, g, unknown, or other
tggagctccccgcggtggcggccgctctagaactagtggatcccccgggctgcaggaattcgcacgagaccattacctagaacatcctaatcgaaaacgaaaaattcgaaagatccctccaggaaagatttttcttccctcctccgacgccccagcccaccaacacactctataaagcagccctcagtcacacacagaacgcacaagcgcaagccggggcaagaaaactcccgtagncagtctgcgagttggatggnnctcttcctggccctcgtgtgcatcctcatcttggtagncatcnngctctacgtccaggaaactcgctggaaaagggggaaaaggccgttccgggggcatggggaggccgggtccctggaactggctcctggggtcccggggtgggccttaccttgggagaacctcccgcttttaatcccaggaacccaggtttttcttttgctttcaaaaaaaaaaggggcgggggggaatttcaaaaagccaccttttggggttttccccggggggaagatgtggaaaacccgaggaggggggggggttttgggtggtggaagacaaaggcaacccggtgataaaggggaccctaaacccggg

SEQ ID NO: 30937 - protein, 120 aa, Zea mays
  misc_feature: Ceres CLONE 1406958-F
  misc_feature (2)..(2): Xaa is any aa, unknown, or other
  misc_feature (15)..(15): Xaa is any aa, unknown, or other
  misc_feature (17)..(17): Xaa is any aa, unknown, or other
MXLFLALVCILILVXIXLYVQETRWKRGKRPFRGHGEAGSLELAPGVPGWALPWENLPLLIPGTQVFLLLSKKKGAGGNFKKPPFGVFPGGKMWKTRGGGGVLGGGRQRQPGDKGDPKPG

SEQ ID NO: 30938 - DNA, 747 bp, Zea mays
  misc_feature: Ceres CLONE 1406960-F
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
ttttttnnnnnnnnnccttttcccctctccctttatctcttccccgtcatgatggaactccccgcggtggcggccgctctagaactagtggatcccccgggctgcaggaattcgcacgagaccattacctagaacatcctaatcgaaaaaaaaaccgcagccggaggtcgccggtcgccaccaccaatggggccacccgccatggcgttccaagccctcaccctcacgccactccccttctcactccacagctcgagccgccgcgtccgcgtgcttgccgttgcggccgaccagactcctccgcccgcccccccttcggagccggcgaacagccctagccgcctccttcgcgagctcgcgcagcggaagaaggccgtatcccctaagaagaagcatccgccgcgtcgcttcatcctgaagccacctctcgatgacgagcgccttacccggcggttcctcagcagcccgcagctgtcgctcaaggcgctcccgctgctctcttcctgcctcccctccgcgccgctctccaccgccgacaggacctgggatggacgagtacctccccaaggccaagcagggcgctcgggtacccgctcgcgcccctcggagacggctcggcgaaaggcgatgactggccccgcgcgacattttacaatgtggctggtccctacctcgcggtatccaagcaatctggacccccttcctagcgaagcggaacggcggcatagagggaaaccgaacggaaag

SEQ ID NO: 30939 - DNA, 676 bp, Zea mays
  misc_feature: Ceres CLONE 1406969-F
  misc_feature: Encodes the peptide sequence at SEQ ID NO. 30940
  misc_feature (383)..(383): n is a, c, t, g, unknown, or other
  misc_feature (437)..(437): n is a, c, t, g, unknown, or other
  misc_feature (452)..(452): n is a, c, t, g, unknown, or other
  misc_feature (590)..(590): n is a, c, t, g, unknown, or other
  misc_feature (609)..(609): n is a, c, t, g, unknown, or other
  misc_feature (615)..(615): n is a, c, t, g, unknown, or other
  misc_feature (630)..(630): n is a, c, t, g, unknown, or other
tggcggccgctctagaactagtggatcccccgggctgcaggaattcgcacgagaccattacctagaacatcctaatcgaaaagacccaggcaagaggcaacacagcaagcagcagaaaacatctccgggagtccgaaccacccacaggcggcaggccacaccacaggttccgcttccgcacagctgctagctagctagcgttcgcaagtagcagtagcgttccatcgaggtcgaggcaatgacggtgatggccgaagtagtctcgaccaccggcgcggcgctccggagcccggcctcgcagccgctgccggccgcggtgaagaacgcagacgctgagaagctccagttcatcgaggagatgacctccaacgtggacgccggcnaggagcgcgtgcctggggggagatcctcgcccgcaacgccggcaccgagtaccntcgccaagtacggcnctcgccgccgctactacggaccgcgccaccttccgcgccaagggtgccgaatggcgaacgtacgaggaccctgcagccgtaatccgccgaaattggccgacggcgacgtcgcccattcccggcggggggacccggggntctccgagttcctcacagnctccgnaacggtcccgcgggngagcgcaagctcatgccccacccatcgaggacgagctcaaccgccg

SEQ ID NO: 30940 - protein, 146 aa, Zea mays
  misc_feature: Ceres CLONE 1406969-F
  misc_feature (49)..(49): Xaa is any aa, unknown, or other
  misc_feature (67)..(67): Xaa is any aa, unknown, or other
  misc_feature (72)..(72): Xaa is any aa, unknown, or other
  misc_feature (118)..(118): Xaa is any aa, unknown, or other
  misc_feature (124)..(124): Xaa is any aa, unknown, or other
  misc_feature (126)..(126): Xaa is any aa, unknown, or other
  misc_feature (131)..(131): Xaa is any aa, unknown, or other
MTVMAEVVSTTGAALRSPASQPLPAAVKNADAEKLQFIEEMTSNVDAGXERVPGGRSSPATPAPSTXAKYGXRRRYYGPRHLPRQGCRMANVRGPCSRNPPKLADGDVAHSRRGDPGXSEFLTXSXTVPRXSASSCPTHRGRAQPP

SEQ ID NO: 30941 - DNA, 705 bp, Zea mays
  misc_feature: Ceres CLONE 1406975-F
  misc_feature: Encodes the peptide sequence at SEQ ID NO. 30942
  misc_feature (384)..(384): n is a, c, t, g, unknown, or other
gctctagaactagtggatcccccgggctgcaggaattcgcacgagaccattacctagaacatcctaatcgaaaaactactagtgatcagaccagtgagctagcgactgtaccatgcagcagctgtaggagagcctggtggtaggtaggataggagtagcgccagccgccaagtgcgcgtccgggctggctgcttcgacgagcaggagggagccgcaccgccgggctcccgcaatgtcgcctcctccgcccccgccgctgctgcgcaacgagctgtcgcgcaggacggcggtgctgggcctgcgcctgtgggtgctggtgggcatcgccgtcggggccgccttcgtgctgctcctcgtgctcatctccctccacctcgccgcggngcggcggaggcggcccaggaagggcgtcgcgcacgcgcacgcgcccgcgccgggcgggggcccccttcgcctgtccccgtccacattcccgccggttcccccgggcaaaccaggccgtcggccgttcccccgccacctgttctcccctccctacctcccatacactcccacttcttttttctcctacattctactagagcgcatctccgtagtaataatataacaagcacacattgcgcctgtacaacgcacaggcctgatgaaagccccttcatcgcatctcccttctccctctggtccttctctcctcccgtccccccg

SEQ ID NO: 30942 - protein, 124 aa, Zea mays
  misc_feature: Ceres CLONE 1406975-F
  misc_feature (51)..(51): Xaa is any aa, unknown, or other
MSPPPPPPLLRNELSRRTAVLGLRLWVLVGIAVGAAFVLLLVLISLHLAAXRRRRPRKGVAHAHAPAPGGGPLRLSPSTFPPVPPGKPGRRPFPRHLFSPPYLPYTPTSFFSYILLERISVVII

SEQ ID NO: 30943 - DNA, 735 bp, Zea mays
  misc_feature: Ceres CLONE 1406976-F
  misc_feature: Encodes the peptide sequence at SEQ ID NO. 30944
aaagctggagctccccgcggtggcggccgctctataactagtggatcccccgggctgcaggaattcgcacgagaccattacctagaacatcctaatcgaaaaaggctcctctcccccgttgcgcaacgcgctttcccccacttcacccgcctcggcgccatggctaagctcgcgctggcgctcctcctcctgctggccgtggcggcgtccgcgtcggccagcagcgggagccacctggatctcgacctgggcttcctctcctctggggaacgccggagggagtgccgcggcacggtggccgagtgcctcgccgaggagtcggatgaggagggccttgacctggccggatcccaccgccgcgcgctctacggcggcgggtacatcagctacggcgcgctgcggcgggacaacgtgccctgctcccgccgcggcgccagctactacaactgccgcccgggcggccaggccaacccctaccaccgcggctgctcccgcatcacccgctgccgcggctgaggcggctccggatccgcccgactgccgaggaaaggtctggttggtcaaggtcccggtcctttcgccgacaataatttctttcgccttggttggttcaggcgctaccgccaccgccactgctgtttactatagcacagacctacggaattgaatggtggaaagggaatttgtttgggcaaatctttgttctgtcgaaaagaaaaggggggagggattcct

SEQ ID NO: 30944 - protein, 118 aa, Zea mays; identical to SEQ ID NO: 6758
  misc_feature: Ceres CLONE 1406976-F
  misc_feature (53)..(118): Pfam Name: RALF Pfam Description: Rapid ALkalinization Factor (RALF)

SEQ ID NO: 30945 - DNA, 712 bp, Zea mays
  misc_feature: Ceres CLONE 1406978-F
  misc_feature (501)..(501): n is a, c, t, g, unknown, or other
tccccgcggtggcggccgctctagaactagtggatcccccgggctgcaggaattcgcacgagaccattacctagaacatcctaatcgaaaaacacagccgccgctgtttcttcatcttactcgtgctcggcacgcaggcgacggcgacggcggcggcgttcaggctcgggctctcagcgacggtatcagtggtctcccgcctctcgccagtcgcgtcgcgccctcgcctccggtcctctgcacaccgtccggtgaccttgtgttgtaagtttttccagcactgcttgctcacccatttctcaattagaaaacctcaaattctgtccctgagcaccaaatcaagaccataccaatttagtgagtccggacagatggcaatggccgcagttctgggcaatggtgattctcagggtcgtcctcagaggactatcaagttgttggtgctgacactcgtgacatgcgcattgagaacgatgtggtcctgccatgcagcttcctggngatgctcaagtcttgaaggagctaacctactactctgatcctgcaaaaagatgcacgtatatggaaaggaaacctgggagagcattcggttaatccagggcaatgcccgggcggttgatggcaaactactccaccgggaaatttggttttgaaccgtaaaaaaggtgtttctgggacaataaggacctccctaaaacgggaggcccaaccc

SEQ ID NO: 30946 - DNA, 674 bp, Zea mays
  misc_feature: Ceres CLONE 1406982-F
  misc_feature: Encodes the peptide sequence at SEQ ID NO. 30947
  misc_feature (519)..(519): n is a, c, t, g, unknown, or other
  misc_feature (574)..(574): n is a, c, t, g, unknown, or other
tccccgcggtggcggccgctctagaactagtggatcccccgggctgcaggaattcgcacgagaccattacctagaacatcctaatcgaaaagtcaaagcagagtctgcccctccccgcgccgttctttttggttccccagtccccgccgccgccgaaacccgcagatggaggtcgtcgtcgccgcgaagcagaaggcgaagaaacacatacacctcttctactgctcagaatgcgaggagctcgccctcaagatcgccgccagctccgacgccatcgagctccaatccatcaactggcggagcttcgacgacgggttcccgaacctgttcatcaacaaggcgcacgacatccgtgggcagcacgtggcgttcctggcctccttcagctcgccgtcggtcatattcgagcagatctccgtcatcttcgcgctgcccaagctattcatcgcctcattcacgctcgtgctggcattcttcccacgggctcattccagcgcgttgaggaggagggcgatgtcncccacgcgtcaccctcgggcgcattctctcgatgatccccaggtcgggcgggggncttacaaggttcgtatctaggaaatccacggcttccaggagaggttttacttcccggaacgatgtgctgccatgctcccaaaaagggggatcccgttccg

SEQ ID NO: 30947 - protein, 142 aa, Zea mays
  misc_feature: Ceres CLONE 1406982-F
  misc_feature: SWISSPROT Homolog: EC 2.7.6.1 Ribose-phosphate diphosphokinase
  misc_feature (137)..(137): Xaa is any aa, unknown, or other
MEVVVAAKQKAKKHIHLFYCSECEELALKIAASSDAIELQSINWRSFDDGFPNLFINKAHDIRGQHVAFLASFSSPSVIFEQISVIFALPKLFIASFTLVLAFFPRAHSSALRRRAMSPTRHPRAHSLDDPQVGRGXYKVRI

SEQ ID NO: 30948 - DNA, 745 bp, Zea mays
  misc_feature: Ceres CLONE 1406983-F
  misc_feature: Encodes the peptide sequence at SEQ ID NO. 30949
  misc_feature (745)..(745): n is a, c, t, g, unknown, or other
aaagctggagctccccgcggtggcggccgctctagaactagtggatcccccgggctgcaggaattcgcacgagaccattacctagaacatctaatcgaaaactccactccctcccccccgcctccactaccccactcccaggcgccgcacaggtacgtcgccggcggcgatgacgacgcgcttcaagaagaaccgcaagaagcgcggccacgtgtccgccgggcacggccgcatcggcaagcacaggaagcatcccggaggtcgcggtaacgccggtggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccgaaaaggcggcggaagccggcggcgacaaggccccgcagatcgacgtcacgcagttcggctacttcaaggtgctcgggaagggggtgctgccgcccaagcccatcgtcgtcaaggccaagctcatctccaaggtcgccgagaagaagatcaaggccgccggcggcgccgtcgtgctcacgaagcttggggaggcgagcaccccgatccggcgaggtgccgcgagcgaggcagcgatgagagggcgtgcgtcccatctccgcgcgctcctctcgcgagcgctctctccaagccttcctcctcctggtcgcgctctgcctcaggtn

SEQ ID NO: 30949 - protein, 192 aa, Zea mays
  misc_feature: Ceres CLONE 1406983-F
  misc_feature (107)..(139): Pfam Name: L15 Pfam Description: Ribosomal protein L15
MTTRFKKNRKKRGHVSAGHGRIGKHRKHPGGRGNAGGMHHHRILFDKYHPGYFGKVGMRYFHKLRNKFYCPAVNIERLWSMVPAEKAAEAGGDKAPQIDVTQFGYFKVLGKGVLPPKPIVVKAKLISKVAEKKIKAAGGAVVLTKLGEASTPIRRGAASEAAMRGRASHLRALLSRALSPSLPPPGRALPQV

SEQ ID NO: 30950 - DNA, 679 bp, Zea mays
  misc_feature: Ceres CLONE 1406984-F
  misc_feature: Translation starting site: 192
aagctggagctccccgcggtggcggccgctctatcctagtggatcccccgggctgcaggaattcgcacgagaccattacctagaacatcctaatcgaaaaaccgatcacaaaaccaatcgcggagattcaatcacgtacgtatacacacggccacacgggcacgtagctagctagcagtcgtagcgtgacgatgagggttctctctgttgcggtcgctctggtcgtggtggtggccgcggcctgcctcgccgcgccgcggggcgcggacggcgcgggcgagtgcggtgcgacgccgccggacacggtggcgctgaggctggcgccgtgcgcgtcggcggcggaggaccccggatccgcgatcgtccgggtcctgctgcaacgcggtgcacgccatcacagaagcagagccttgggtgcttctgcgccgccatgctgtccaacaccgccagtaccaccactagcgatgtcgaggcttgcatgcactattctcaaacgctgtaacctcttccatcggcccgttggctgaagtgaactcagttgcttatgtgatgagccggctaccattctccaagctagatgttgtctatggccatgaagatcttccattcaaccaactggtcttgttgaaatctgttggttatttacacagaaactcttagcgccattcaaataaataag

SEQ ID NO: 30951 - DNA, 741 bp, Zea mays
  misc_feature: Ceres CLONE 1406985-F
  misc_feature: Encodes the peptide sequence at SEQ ID NO. 30952
tccccgcggtggcggccgctctagaactagtggatcccccgggctgcaggaattcgcacgagaccattacctagaacatcctaatcgaaaaacagggctcaagttgtcgcggccactgccagatttttctccactcaatcgcggcatgagctgcactgcagccatggacgccagcgaacccgggagcaagggcaacaagggggcggctggccgcaaggctgacggccccaagaagaaggcggtgtcgcggacccgcaaggccgagctgcagttccacgcctgccggatcggccgctacctcaacaaggagcggtacgcgcagcgcgcggtcaccggcgcccccgtctatctcgccggcgtgattgagtacctcaccgcccaagtgctggagctgtacggcaacgcgttgaaggacaacaacaagatctgcatcgtcccgcgacacttgctcctgacgattcgcaacgacgttcagctcggtaaggtgctgtctgtcgtcaccatcgcgcacgtaggtgtcctccccaacatctacccagctctcctgcccaagaaggtatcggtataaggcgtccactggcgacagcaatgatagcacatctcctatgtaagacgccaattctccatagaaggactgcaagttcccgaagaaggcttacaaatgagtcacttcactattgctctgctgtagcatgatcgtgtttagatctgcagtacctatgtgttccagcctaagttcct

SEQ ID NO: 30952 - protein, 134 aa, Zea mays
  misc_feature: Ceres CLONE 1406985-F
  misc_feature (29)..(102): Pfam Name: Histone Pfam Description: Core histone H2A/H2B/H3/H4
MDASEPGSKGNKGAAGRKADGPKKKAVSRTRKAELQFHACRIGRYLNKERYAQRAVTGAPVYLAGVIEYLTAQVLELYGNALKDNNKICIVPRHLLLTIRNDVQLGKVLSVVTIAHVGVLPNIYPALLPKKVSV

SEQ ID NO: 30953 - DNA, 683 bp, Zea mays
  misc_feature: Ceres CLONE 1406985-R
  misc_feature: Translation starting site: 293
cgaattgggtaccgggccccccctcgaggtcgacggtatcgataagctttttttttttgttttttgtctaataaacatcctataataattgaatttggtctaagtccccgagatgacgaattgcaaaatcacaaccagggacacaacacgggaaacatgaccctgaacctatcaggaccccccaggcaaaaaggaaaatagggtggaacacataagtcccaccgatgcaaacacgaacatgccacctgggagcgcttgtgaaccgactaaattcaaagcccccctcggggacatggccgccctctttggggacgtgggcgccttcctaggggacttgcactccctgctgccgacggaggaccccttcccccccaccttcttgggcaagataacctggctgatgatggggacgacaccaccgcgcccgatgatgactcccaacaccagcttgcccagctcaacgtcgattccaatcgccaggagcaagtgcccccgaacgatgggatccttcattttgaccttccccccgttcccgggcagctccagcacctcttcggctaggtactaagaccggggaggaagatagacgggtgcgccggtgcccacgcagcttgcgcaaccgacccatccttgaagataaccccccaacactgcgaaaggggaaccgcaatcccggccctaag

SEQ ID NO: 30954 - DNA, 673 bp, Zea mays
  misc_feature: Ceres CLONE 1406987-F
  misc_feature: Encodes the peptide sequence at SEQ ID NO. 30955
aaagctggagctccccgcggtggcggccgctctagaactagtggatcccccgggctgcaggaattcgcacgagaccattacctagaacatcctaatcgaaaaaccagctttccccttctctccggtccgggaatcggaagctcagggcagaagtttagccatggggcagacgcatcttttgttgctcgcttgtttctgggtcctgtcaacatgctccttgctacttgatgcttcctccgatggactgttaagaatcaacctgaacaagaagagactggacaaggaagctttgactgctgcgaaattggcgaagaaggagagccaccttcgaaggtctgtgggtgctgaccagtatctcagtgcctcaactgatgacatagtccctttggacaactacctggacacccagtactttggacagatcagcatcggcacgccaccacagaacttcacagtgatattcgacactggaagctccaacttgtgggttccctcatccaagggttacttttcgaaagcgggctaccttaccccacagataacagtcaacccagtccgaaacttacccaagaaagggggaatcttgtgaccataaccaatgggtctggggaaaaaccggtgggtttttcaggggggaaaaggggggtgtgtgggaaaccttggtggggaaaaa

SEQ ID NO: 30955 - protein, 142 aa, Zea mays
  misc_feature: Ceres CLONE 1406987-F
  misc_feature: SWISSPROT Homolog: EC 3.4.23.40 Phytepsin
MGQTHLLLLACFWVLSTCSLLLDASSDGLLRINLNKKRLDKEALTAAKLAKKESHLRRSVGADQYLSASTDDIVPLDNYLDTQYFGQISIGTPPQNFTVIFDTGSSNLWVPSSKGYFSKAGYLTPQITVNPVRNLPKKGGIL

SEQ ID NO: 30956 - DNA, 676 bp, Zea mays
  misc_feature: Ceres CLONE 1406989-F
  misc_feature: Translation starting site: 304
  misc_feature (314)..(314): n is a, c, t, g, unknown, or other
  misc_feature (623)..(623): n is a, c, t, g, unknown, or other
  misc_feature (658)..(658): n is a, c, t, g, unknown, or other
aaagctggagctccccgcggtggcggccgctctagaactagtggatcccccgggctgcaggaattcgcacgagaccattacctagaacatcctaatcgaaaaagagcttgcaaacaccaccagcgaaaacgtcgtggccagccatcccggtgtcgtcccgcgttctacagccaccgctgtcgtcgccgtcctagactcctagatccgtcagcttaacgagctccattccttcgaggccagccatcccggtgtctcagcagcggcggcggcggcgtcgagctcttgctttctgtgggaggacgcatggcgatgtntgcggggcgtgggctcttggtcctcttcttctctgccgccgtagtggctgagctcgcctctgccgcgaacggtcctttcctgtccgatagcgtcttccagtcgagcgccggtcctacaggggaggagcttgctgcaggccaagaatagttgccctgtgaaactttgagttccaaaactacacaatcatcacaagcaagtgaaaaggaaccgaagtttccagccagccaatgctgtgccgcactcagggggattcgcgtgcccttttaacaattacctcaatgacagaaggcaatgaatgtgcatcgacnatgttcagctacatcaacctctatggcagtacccnacaaggtctgtttttcag

SEQ ID NO: 30957 - DNA, 670 bp, Zea mays
  misc_feature: Ceres CLONE 1406990-F
  misc_feature: Encodes the peptide sequence at SEQ ID NO. 30958
  misc_feature (457)..(457): n is a, c, t, g, unknown, or other
  misc_feature (519)..(519): n is a, c, t, g, unknown, or other
  misc_feature (550)..(550): n is a, c, t, g, unknown, or other
  misc_feature (615)..(615): n is a, c, t, g, unknown, or other
aaagctggagctccccgcggtggcggccgctctaccactagtggatcccccgggctgcaggaattcgcacgagaccattacctagaacatcctaatcaaaatcaagctagctagttaactgtgcaattagttgagtcagtagataagctgttccgtcttagcttatctaccgatcgagctcgcggcaatggcgatgatggcatgcaataacactcgaccccgcaagctgtcgctgccatgccgcacccgtactttccaagccttaatactaagcacagcagtcttcctggctgcttccacggccgtcgtcgtcggcaaggagccacaaccaccgtcctcctccggcggcggctgtcactaccgcttcgagctcacccacgtagatgccaacctcaaccttaccagcgacgagttggatgcgtcgtgcctatgacaggagccgcctccgcggcggcgnagcttggccgccctactcggacggccgacacggaagggcgcgttagcattcctgacgcctcngtacatcatcacgttttacttgggcaaccancggcccgaggacacatcttcccggccgtcgtggacaccggcagcgaacatattttggacgaccgnagaaggaaagtgtagccggtccaagacaaggtccatggctgccttgctgcagccc

SEQ ID NO: 30958 - protein, 81 aa, Zea mays
  misc_feature: Ceres CLONE 1406990-F
MAMMACNNTRPRKLSLPCRTRTFQALILSTAVFLAASTAVVVGKEPQPPSSSGGGCHYRFELTHVDANLNLTSDELDASCL

SEQ ID NO: 30959 - DNA, 664 bp, Zea mays
  misc_feature: Ceres CLONE 1406993-F
  misc_feature: Encodes the peptide sequence at SEQ ID NO. 30960
  misc_feature (542)..(542): n is a, c, t, g, unknown, or other
aaagctggagctccccgcggtggcggccgctctagaactagtggatcccccgggctgcaggaattcgcacgagaccattacctagaacatcctaatcgaaaactaccgagttttccttccccacctccccgccccacccgtcgccgaatcggagtcccgctcgcgtccacccttgccagagctcaagagctacctcctggtccggttggacagatcccttcgggcgctgcgtccaccgggattcaggcaaagtggtgtaacataagatgcaagggggaagaggtgggaggcagggtttgttcggttttggggacccttttgttggtttcggcggctttggacagccagggaacataatgtccggtttctttggtggcgcaaatccctttgatgaccctttcttcacaacccctttggtggcatgatgcaacctagtttctcaacccctttcagcggcatgatgcaacctagcttcatgaacccctttggtagcatgatgcaacctagcttgcttggatcaagtatgtttgcagcccatgggncatctcatggaggcacttttgggaagcagacacatctcattcaagcatgagcaatgccagtgggttcattcagcaggctctggatcgagaaggctaagggcattttttcaaggaggtgcctc

SEQ ID NO: 30960 - protein, 52 aa, Zea mays
  misc_feature: Ceres CLONE 1406993-F
MQGGRGGRQGLFGFGDPFVGFGGFGQPGNIMSGFFGGANPFDDPFFTTPLVA

SEQ ID NO: 30961 - DNA, 682 bp, Zea mays
  misc_feature: Ceres CLONE 1406994-F
  misc_feature: Encodes the peptide sequence at SEQ ID NO. 30962
tccccgcggtggcggccgctctagaactagtggatcccccgggctgcaggaattcgcacgagaccattacctagaacatcctaatcgaaaaatttcctggccgccaagcttccaacgtacgcagcctgctcgtcttccacctccggccatcttcctccctctaccgagcttccctccccacagcagcagaccaccggcgctccctgttcttcttccccgtgggcgcccccccttcatccaggcagcagacgacacacgcacgccaggaacgcccgagctctccatctctaatccagcgcgcagggcatttctcagggtccgagctcgagcaggtccggcagccctccccaaccaagcttctcccatggcgctgctacctccaggatggagctcgacaccccaaaggttggaatccgaccctctctctgttcccctcaatttcaagctcccctgggcgtttctttttgccctgcagaaattccccctggggcgctggaggcgccaagcttcgcgccggtgagcaactcccatggcgtggccatctccctgctgttgccagggccgacgaggtccaagtcttgtctctagccttccttggccgactatggctgcccagcagctcgtccctcccttctctaggcttgggcccccggctgtcatttccccaacgccgagcgtgccc

SEQ ID NO: 30962 - protein, 51 aa, Zea mays
  misc_feature: Ceres CLONE 1406994-F
MALLPPGWSSTPQRLESDPLSVPLNFKLPWAFLFALQKFPLGRWRRQASRR

SEQ ID NO: 30963 - DNA, 576 bp, Zea mays
  misc_feature: Ceres CLONE 1406996-F
  misc_feature (210)..(210): n is a, c, t, g, unknown, or other
ggagctccccgcggtggcggccgctctagaactagtggatcccccgggctgcaggaattcgcacgagaccattacctagaacatcctaatcaaaaagaggaaaagcacgcgagagcttgtcggagggctctctgtctctgtgataaaccgatacgcagaggaagctgcggagaggtgtccctgctctgccggtgagctgcgggcagcggntgaagagaagtggaccgggaccgggggaccgaaggagagagagaagaagaaaagggggcgcgggggccatggctggacacccgccggcaagggacaaaacaccaccggtttcccgtttagtggagccggttgacccgttttctcaggaaaaaaaagggggcctggaaggcctcgggggccttccattgggccccggccccggaattggaaaaagggtttttccgggccgccaacccccaaaaatttttgttcccggcttccaacggggcaaaaggccaccccgggggaacccaaaaaagcctgggccaaccccccgggggaatcccagggggggaaactggggggggagggggcccaacctttccc

SEQ ID NO: 30964 - DNA, 663 bp, Zea mays
  misc_feature: Ceres CLONE 1406998-F
  misc_feature: Translation starting site: 171
  misc_feature (140)..(140): n is a, c, t, g, unknown, or other
  misc_feature (433)..(433): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (544)..(544): n is a, c, t, g, unknown, or other
  misc_feature (550)..(550): n is a, c, t, g, unknown, or other
  misc_feature (553)..(553): n is a, c, t, g, unknown, or other
aaagctggagctccccgcggtggcggccgctctagaactagtggatcccccgggctgcaggaattcgcacgagaccattacctagaacatcctaatcgaaaaatcaaccatattattgagaccaacaagcaacatagaangtggaatccagtagcaacaatagagcaacaatggcgaccaagatattttccctccttatgctccttgctctttctgcatgtgttgctaacgcgacaattttccctcaatgctcacaagctcctatagcttccctttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaanccatcagggnnnnnnnaacagcagctgcagcaactcgtgctacctgtgatcaaccaagtagctctgggaaacttttctcctactctcagaacacaatttcttcattcaccnactgtnacntttgaccggggctgctatttgcagaaccactattacattcaacccgtttgtttgggctaaccttaaaaacaaaaatttttcattttaaccattggccccatgaaaccccc

SEQ ID NO: 30965 - DNA, 686 bp, Zea mays
  misc_feature: Ceres CLONE 1407000-F
  misc_feature: Encodes the peptide sequence at SEQ ID NO. 30966
  misc_feature (499)..(499): n is a, c, t, g, unknown, or other
  misc_feature (609)..(609): n is a, c, t, g, unknown, or other
  misc_feature (648)..(648): n is a, c, t, g, unknown, or other
  misc_feature (649)..(649): n is a, c, t, g, unknown, or other
  misc_feature (654)..(654): n is a, c, t, g, unknown, or other
  misc_feature (655)..(655): n is a, c, t, g, unknown, or other
  misc_feature (663)..(663): n is a, c, t, g, unknown, or other
tccccgcggtggcggccgctctagaactagtggatcccccgggctgcaggaattcgcacgagaccattacctagaacatcctaatcgaaaaaccactagcaagtagcaacaggagcgcaggcagaactagagcggtcttggtatggcttcttccctcgcgcccgcgtcgtgggcactgccgctgcagatggtcggggctggggcggcagcggcggggccttcctgccgcgcgacgctagccgtcgtcacggagccccgctgggccgcgtcgctgcgccgggcaagggttctcgtggcgctggcgccccggtgcgtggcgctcgacgggcccggcgccagcggcgaggaggaggcgcccaagatcgaggacgagaggaagaagagcggtgagacgaagaagcccggcgcgcggccggccggtggtggagccggatcctcttcgcctccaagaagacacgaagtatcatcatcctcaacgccctcacggcatctatgcagngggataattccggttttttgaaagaggtcgaagccctgacagagcctgcggctcaacaatgtgggggggggtctcgttgttgcagccatccccttcgtaccattcgcgcntccgttccttcgggtgaccgcagtgtacgctaacgcggnnatggnnagctgggnagtctggggttagccttagctta

SEQ ID NO: 30966 - protein, 125 aa, Zea mays
  misc_feature: Ceres CLONE 1407000-F
  misc_feature (119)..(119): Xaa is any aa, unknown, or other
MASSLAPASWALPLQMVGAGAAAAGPSCRATLAVVTEPRWAASLRRARVLVALAPRCVALDGPGASGEEEAPKIEDERKKSGETKKPGARPAGGGAGSSSPPRRHEVSSSSTPSRHLCXGIIPVF

SEQ ID NO: 30967 - DNA, 646 bp, Zea mays
  misc_feature: Ceres CLONE 1407002-F
  misc_feature: Encodes the peptide sequence at SEQ ID NO. 30968
  misc_feature (41)..(41): n is a, c, t, g, unknown, or other
  misc_feature (535)..(535): n is a, c, t, g, unknown, or other
  misc_feature (577)..(577): n is a, c, t, g, unknown, or other
tccccgcggtggcggccgctctagaactagtggatcccccngggctgcaggaattcgcacgagaccattacctagaacatcctaatcgaaaagattgatcttttttacatggtcaagttaagatgacattcatgattcatcagcgaattttcccaccgctcagcagttacctcgttcccgttctcctcctcgcatccctctcgtccgccgccgccgcctggctcgcgccgccgacagtttctcggcccagatcgagacacgcccgccgtcctacaccaggtgccgaggccttcgccgatcaaagagatcccagacagcagattcgtccgtgccctgctcctcgaaccatggggacctctgcccaggaatcgcctctctggaagcgtatcgacgatgccgagtactatctagtcagtggatcatttgaccaggcggtgttgactgctttatccgtcgccaatgaaatacacatgggcttctttggagagcgctagcaccaggatgagctcctggagatgcttgaatccggctgggnaatggtgcttgtgcaggcactaaagaaactcaggaggccctncctgagatgttgctcgtttaagaaaggagggggttggggttaaaatgccatcagggcccggggatagag

SEQ ID NO: 30968 - protein, 48 aa, Zea mays
  misc_feature: Ceres CLONE 1407002-F
MGTSAQESPLWKRIDDAEYYLVSGSFDQAVLTALSVANEIHMGFFGER

SEQ ID NO: 30969 - DNA, 647 bp, Zea mays
  misc_feature: Ceres CLONE 1407004-F
  misc_feature: Encodes the peptide sequence at SEQ ID NO. 30970
  misc_feature (172)..(172): n is a, c, t, g, unknown, or other
  misc_feature (173)..(173): n is a, c, t, g, unknown, or other
  misc_feature (176)..(176): n is a, c, t, g, unknown, or other
  misc_feature (178)..(178): n is a, c, t, g, unknown, or other
  misc_feature (182)..(182): n is a, c, t, g, unknown, or other
  misc_feature (183)..(183): n is a, c, t, g, unknown, or other
  misc_feature (187)..(187): n is a, c, t, g, unknown, or other
  misc_feature (189)..(189): n is a, c, t, g, unknown, or other
  misc_feature (191)..(191): n is a, c, t, g, unknown, or other
  misc_feature (192)..(192): n is a, c, t, g, unknown, or other
  misc_feature (194)..(194): n is a, c, t, g, unknown, or other
  misc_feature (196)..(196): n is a, c, t, g, unknown, or other
  misc_feature (198)..(198): n is a, c, t, g, unknown, or other
  misc_feature (200)..(200): n is a, c, t, g, unknown, or other
  misc_feature (201)..(201): n is a, c, t, g, unknown, or other
  misc_feature (203)..(203): n is a, c, t, g, unknown, or other
  misc_feature (205)..(205): n is a, c, t, g, unknown, or other
  misc_feature (206)..(206): n is a, c, t, g, unknown, or other
  misc_feature (208)..(208): n is a, c, t, g, unknown, or other
  misc_feature (211)..(211): n is a, c, t, g, unknown, or other
  misc_feature (213)..(213): n is a, c, t, g, unknown, or other
  misc_feature (214)..(214): n is a, c, t, g, unknown, or other
  misc_feature (217)..(217): n is a, c, t, g, unknown, or other
  misc_feature (218)..(218): n is a, c, t, g, unknown, or other
  misc_feature (228)..(228): n is a, c, t, g, unknown, or other
  misc_feature (229)..(229): n is a, c, t, g, unknown, or other
  misc_feature (232)..(232): n is a, c, t, g, unknown, or other
  misc_feature (233)..(233): n is a, c, t, g, unknown, or other
  misc_feature (428)..(428): n is a, c, t, g, unknown, or other
  misc_feature (429)..(429): n is a, c, t, g, unknown, or other
  misc_feature (509)..(509): n is a, c, t, g, unknown, or other
  misc_feature (545)..(545): n is a, c, t, g, unknown, or other
  misc_feature (546)..(546): n is a, c, t, g, unknown, or other
  misc_feature (588)..(588): n is a, c, t, g, unknown, or other
caaagctggagctccccgcggtggcggccgctctagaactagtggatcccccgggctgcaggaattcgcacgagaccattacctagaacatcctaatcgaaaaaatctgaagcaaaatgtaccgggaatgttgaagagcgggactcttaagcagtagtgagatggcggcggnntgngntggnngttncngnncncngngnncngnntntgngnncgnngctgggtggnnagnnccccgcggtccgtgcagctcctgctcctgggcgtcgctctcgtcgcagcttctttctacgccggcaccctcttcggctcctccgcgtcccctgcgctcgtactgcccccttcgcgcccccgatcgcccgattccttcagggccgaagttacagatggttccagtgtttaccaacagagtttctcgtacgtaccgnngcaaatcagtgacagttcagatcacggagtttgatgtgtgtccctttggatacaatgagtatgtcccctgccatgatggnagctatataagcagcttggagagcctgatacttctnngcatgaggatcttgaaaagatttgtcctcatggaaaaacggnttggttttgttgggggccccctccaatggctaccagaatccaataagatggcccacagg

SEQ ID NO: 30970 - protein, 87 aa, Zea mays
  misc_feature: Ceres CLONE 1407004-F
  misc_feature (15)..(15): Xaa is any aa, unknown, or other
  misc_feature (54)..(54): Xaa is any aa, unknown, or other
  misc_feature (68)..(68): Xaa is any aa, unknown, or other
MVPVFTNRVSRTYRXKSVTVQITEFDVCPFGYNEYVPCHDGSYISSLESLILLXMRILKRFVLMEKRXGFVGGPLQWLPESNKMAHR

SEQ ID NO: 30971 - DNA, 642 bp, Zea mays
  misc_feature: Ceres CLONE 1407009-F
  misc_feature: Encodes the peptide sequence at SEQ ID NO. 30972
  misc_feature (424)..(424): n is a, c, t, g, unknown, or other
  misc_feature (425)..(425): n is a, c, t, g, unknown, or other
  misc_feature (507)..(507): n is a, c, t, g, unknown, or other
  misc_feature (508)..(508): n is a, c, t, g, unknown, or other
  misc_feature (518)..(518): n is a, c, t, g, unknown, or other
  misc_feature (558)..(558): n is a, c, t, g, unknown, or other
  misc_feature (589)..(589): n is a, c, t, g, unknown, or other
  misc_feature (607)..(607): n is a, c, t, g, unknown, or other
  misc_feature (608)..(608): n is a, c, t, g, unknown, or other
  misc_feature (620)..(620): n is a, c, t, g, unknown, or other
cgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggccccggccacatccaagccgccgcctccggccccggccacacccaagccgccgcctccggccccggccacaccaagcgccgcccagcgggnnaaggagaagggcggtgggcggcggtggtggagcctcacgggcgtccccgcggaagggtaaacgtggaggcgcggcggctggnnacgaaggggncacgggaaggtggtcgcgatgcacggcggcccagggcggnggccaagctcacgctgctctactcccacggnaacgccgccgacttcggnncagatgtacgangctcttcgtcgagctcagcgcc

SEQ ID NO: 30972 - protein, 89 aa, Zea mays
  misc_feature: Ceres CLONE 1407009-F
  misc_feature (70)..(70): Xaa is any aa, unknown, or other
MGAVTSTVAARFAFFPPSPPSYGFEQPAPLPAPATPEPPAPATSKPPPPAPATPKPPPPAPATPSAAQRXKEKGGGRRWWSLTGVPAEG

SEQ ID NO: 30973 - DNA, 701 bp, Zea mays
  misc_feature: Ceres CLONE 1407017-F
  misc_feature: Encodes the peptide sequence at SEQ ID NO. 30974
  misc_feature (543)..(543): n is a, c, t, g, unknown, or other
  misc_feature (583)..(583): n is a, c, t, g, unknown, or other
  misc_feature (598)..(598): n is a, c, t, g, unknown, or other
  misc_feature (657)..(657): n is a, c, t, g, unknown, or other
  misc_feature (658)..(658): n is a, c, t, g, unknown, or other
aaagctggagctccccgcggtggcggccgctctagaactagtggatcccccgggctgcaggaattcgcacgagaccattacctagaacatcctaatcgaaaagtggactgttttggaaggcgttgcgatgagacgctgcggcggcggcggcgaggagtgcatccctcggcgatgagcagaatcaccaccggatcttaatctcccttgcctcgtttgcggcgagcctgcgctgtcggcggcggcgcaccccctccccttcccccggcgcttccgtctgctggctggactcagttcttccaactcggcccttaacaagagaacgacgaccatgccgatgcgtggcgtcgatttcaagtgggtatgatgggttcttcctctccatgctcgccactagcgtaattatcgtttccattaattggaagaggtatcgcctgtgtgcccacccgctcccatttgggatagtggtggactacaccactgtcttcatcttccgcctcctaatgtttggttgataatggtctcgctgcaggaaatgggattagnatctcggatggcaacagagatatggctcggtttttgtggnaagaaaagtggtccntctcagttcttgtgctacttctctacccttttcctctggggtttgggactgtgattggnnaacattggtggtttagcactgcaaagaggctgcttggccagag

SEQ ID NO: 30974 - protein, 43 aa, Zea mays
  misc_feature: Ceres CLONE 1407017-F
MLATSVIIVSINWKRYRLCAHPLPFGIVVDYTTVFIFRLLMFG

SEQ ID NO: 30975 - DNA, 524 bp, Zea mays
  misc_feature: Ceres CLONE 1407018-F
  misc_feature: Encodes the peptide sequence at SEQ ID NO. 30976
  misc_feature (62)..(62): n is a, c, t, g, unknown, or other
  misc_feature (174)..(174): n is a, c, t, g, unknown, or other
  misc_feature (175)..(175): n is a, c, t, g, unknown, or other
  misc_feature (197)..(197): n is a, c, t, g, unknown, or other
  misc_feature (207)..(207): n is a, c, t, g, unknown, or other
  misc_feature (208)..(208): n is a, c, t, g, unknown, or other
  misc_feature (213)..(213): n is a, c, t, g, unknown, or other
  misc_feature (214)..(214): n is a, c, t, g, unknown, or other
  misc_feature (221)..(221): n is a, c, t, g, unknown, or other
  misc_feature (222)..(222): n is a, c, t, g, unknown, or other
  misc_feature (250)..(250): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (290)..(290): n is a, c, t, g, unknown, or other
tggagctccccgcggtggcggccgctctagaactagtggatcccccgggctgcaggaattcnacgagaccattacctagaacatcctaatcgaaaaccatcagacagacgcagactctctcacccgactcgtcagacgtcagccagcagttcgaaaccaaggattgatccaggnnagcttccggaaggcggaagggnccggcccggnnccggnncccgggnnccccccggggggggcccggggggggggnccccccccccccccnnnnnnnnnnnnnnnngggggggggntcttggggggccccccgggggccccccccccccatgggggaattcgggggtttctcggggggattccgggggttccctgtggtttggggggggccctggggtttcccaagggggatccctttgtgggtgcgggggtttttttttccggggggggggggccgaccaaaaaaaagggggggggggggggggccccccccccccccaaaaaaaaaaaacccccgccggggggggccc

SEQ ID NO: 30976 - protein, 67 aa, Zea mays
  misc_feature: Ceres CLONE 1407018-F
MGEFGGFSGGFRGFPVVWGGPWGFPRGIPLWVRGFFFPGGGGRPKKRGGGGGPPPPPKKKNPRRGGP

SEQ ID NO: 30977 - DNA, 704 bp, Zea mays
  misc_feature: Ceres CLONE 1407025-F
  misc_feature (440)..(440): n is a, c, t, g, unknown, or other
  misc_feature (488)..(488): n is a, c, t, g, unknown, or other
aagctggagctccccgcggtggcggccgctctataatagtggatcccccgggctgcaggaattcgcacgagaccattacctagaacatcctaatcgaaaaacataaatcccacacattgtctgtccgatcccatgcttgcgcgcttaccatgcgctgaaccatctaggaaccttcacaaagttccacccgttctcgctaccaccttcttctttgtactcctatgcagctcgctacaagtacgtgtcgcgaactacccgttcgagaaggacgcgcggctgttgaccaacgtgtcgtactacgactacatcatcgtggtcgtctactacgaccgggtgcccgctgtccgctacactgaccgatagtttcagcgtgttgctgatgcagagaggagcctcgacctacgacgacgatcgcatcagggatatgtcccgcttcgcgnaacgatgtcggacatctccacggcgtcagccgcgtagcggtatatgtnaaaggacgtgggtcatcaaactccagaaccgaggtgcttgggcgggggctactggatcaacgccaggctcctaaccggccgccagggacgaactacctgccgggcccccaaggggtaaacctggaaggcccccgggccccccataacccggggggaaaaaagaacctggttaggcccttccaaaccggaactgggttttccctgggaaacccactt

SEQ ID NO: 30978 - DNA, 678 bp, Zea mays
  misc_feature: Ceres CLONE 1407026-F
  misc_feature: Translation starting site: 230
  misc_feature: SWISSPROT Homolog: EC 2.4.1.207 Xyloglucan:xyloglucosyl transferase
aaagctggagctccccgcggtggcggccgctctataactagtggatcccccgggctgcaggaattcgcacgagaccattacctagaacatcctaatcgaaaaacaagctcgatcaccaacccagctcggtcgtcccagctgatcaggtcgagcaccttgcgacctgctcgatcatcagtgtagagtgtctgtaggtgtctgtctctcttggtggctggttgcaacggtcatggcgacgtcgtctcgtcgggtgcccttgctgctgctggtcctgggcgtgctggtgtcgtgctccttcgcggcgggcagcttggaccaggagctggacatcacgtggggcgacgggcggggcaaggtcctggacaacgggcggctgctgacgctgtcgctggaccgcacgtccggctccgggttccagtcccggcacgagtacctgttcggcaagatcgacatgcaggctgcgcgctggtgccggttaactccgccggcaccgtcaccgcctactacctgtcgtcgcagggcggcgcgcacgacgagatcgacttcgagttcctgagcacgtgtctcgtcgagccctacacgctgcacaccaacgtgttcacgcgggggcaggggcagcgggagcagcagttccgcctctggttcgacccaccgccgacttcacacctactccatcct

SEQ ID NO: 30979 - DNA, 667 bp, Zea mays
  misc_feature: Ceres CLONE 1407028-F
  misc_feature: Encodes the peptide sequence at SEQ ID NO. 30980
aagctggagctccccgcggtggcggccgctctagaactagtggatcccccgggctgcaggaattcgcacgagaccattacctagaacatcctaatcgaaaaattttatcgtcaacaatttcgtcttctcagtttctgacttattccggggcatttttttattgtttcgagcctgtgagtctgattccattttgacccatggcggcggctgcggttcatgagccggaggtgatccgcgacaaggcggcgatgcgcgcgtggtcgcgccgccgccgcgcggagggaaaggccgtcgctttagtccccacgatgggcttcctccacgagggacacctctcgctcatctccgcggccgtggcggcctccgccgaccccatcgccgtcgtcgtctccatctacgtcaaccccagccagttcgcccccaccgaggacctcgccacctacccctccgacttcgccggcgacctccgcaagctggctgccaccggggtcgtcgacgcagtattttgccccccggacctctacgtccgcggcagcgctgatcgcccctccgccgccggcgcgtccgggggcgcggtgtcttgcctggagggatgcaggtgggcatgcgcacgagacgtgggattcgggtggagcggctgggagaggggctgtgcgggagcagcagg

SEQ ID NO: 30980 - protein, 156 aa, Zea mays
  misc_feature: Ceres CLONE 1407028-F
  misc_feature (9)..(155): Pfam Name: Pantoate_ligase Pfam Description: Pantoate-beta-alanine ligase
  misc_feature: SWISSPROT Homolog: EC 6.3.2.1 Pantoate--beta-alanine ligase
MAAAAVHEPEVIRDKAAMRAWSRRRRAEGKAVALVPTMGFLHEGHLSLISAAVAASADPIAVVVSIYVNPSQFAPTEDLATYPSDFAGDLRKLAATGVVDAVFCPPDLYVRGSADRPSAAGASGGAVSCLEGCRWACARDVGFGWSGWERGCAGAA

SEQ ID NO: 30981 - DNA, 661 bp, Zea mays
  misc_feature: Ceres CLONE 1407030-F
  misc_feature (661)..(661): n is a, c, t, g, unknown, or other
tggagctccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaatcaatttcttcgtccgccttcgcccctgcttacgtccccgctactaaccctaggatcattctgtcttttctcgtttcttatccgactcttcttcgttttatgcctatcagttatgaggttgaacgccttcagaagcttctctactagattagtgtaaatagtagacttgttcgagtttagcttggctggaagaattagtctctggtccgtgtttatatctgctagcaataatggctgcgatgaacggagaggtattgggtgaatgtggaaggaacataaatagtctcaagagaaagcgggagagccccgctgcatatgctgctggcgtattctgcacctctgaattgn

SEQ ID NO: 30982 - DNA, 571 bp, Zea mays
  misc_feature: Ceres CLONE 1407033-F
aagctggagctccccgcggtggcggccgctctagaactagtggatcccccgggctgcaggaattcgcacgagaccattacctagaacatcctaatcgaaaaaaccagtgtgcgcacttcaccccccctctcggtctcaccctcctggcgacgactgggctgccgaaacggcgtcggcgccggcccacgccaggtttcaaagcttcgtcaggcccttttccggggattccagaaccaagggtgaaaggaataacttctcggggtccctgagggaaaaatcttttccaaccgggaaaaacttttgaagggtgggtgggtgggggaaaaaaggtccaaggggggattataaaccggaaaatctttttttaaaggaaagggcaaaaaggtccaaaagatttgtttcccaaaggattaaaggcccgggggtttatattttttggccccctctttccggggggggtaataaccttttcccccccaaaaaatccccccccctcgcaaggggggtttttgttggggaaaagaaatccccaaaaattttttccccccttttaaaacacaaagtttttttt

SEQ ID NO: 30983 - DNA, 615 bp, Zea mays
  misc_feature: Ceres CLONE 1407038-F
  misc_feature: Encodes the peptide sequence at SEQ ID NO. 30984
  misc_feature (516)..(516): n is a, c, t, g, unknown, or other
  misc_feature (533)..(533): n is a, c, t, g, unknown, or other
  misc_feature (548)..(548): n is a, c, t, g, unknown, or other
gctctagaactagtggatcccccgggctgcaggaattcgcacgagaccattacctagaacatcctaaaaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacaccttcccgggctcgcccgcgcagcgcttcgtgtcggaggacggcgtcatcaactcgcgcccgcgggtgctgggcggcggcagctgcatcaacgccnggcttctacacgcgggnccagcgacgactacntgggggggcgtcgggtgggaacctggggcccccccgggggggtaaccggggggggggagaaaaccgg

SEQ ID NO: 30984 - protein, 157 aa, Zea mays
  misc_feature: Ceres CLONE 1407038-F
  misc_feature: SWISSPROT Homolog: EC 4.1.2.10 Mandelonitrile lyase
  misc_feature (133)..(133): Xaa is any aa, unknown, or other
MSGRSRHFTMSTLLATSFFFVLLCSSLQVRGVNYTFVKDAALAPSVSYYDYIIVGGGTAGCPLAATLSERFRVLLLERGASPYDDDRIGDMARFADTLSDTFPGSPAQRFVSEDGVINSRPRVLGGGSCINAXLLHAGPATTTWGGVGWEPGAPPGG

SEQ ID NO: 30985 - DNA, 666 bp, Zea mays
  misc_feature: Ceres CLONE 1407039-F
  misc_feature: Encodes the peptide sequence at SEQ ID NO. 30986
tggagctccccgcggtggcggccgctctagaactagtggatcccccgggctgcaggaattcgcacgagaccattacctagaacatcctaatcgaaaacctttcgggcagaaagagccagagagagagagagagagaggtcggggctggggagcacacacccatcacccatggcctgactgacctccggactctccctgcttccgtcgccgccgcgggccgcccagctgactgctcctgccctccgcccgccctccatggcgtccgtcaagctcggctccaagcctgacgccttcaagcggcaaggccaggcatggttctgcacaacaggacttcctagcgatgtcaccgttgaggttggggatatgtctttccaccttcacaagttccctttactttcaaaaagtgcctttcttgaacggtcaattgaagaaaattctgaccaagaagaatgcatcatcaaactaaatgacattcctgggggtgccaagtcatttgagctagttgcaaggttctgctatggtgtgaaaatagagctttcacctgcaaatgttgtctacctacggtgtgcctcagagcatctagaaatgactgaagaagtagctgaggaaaacctgattgcacagtcagaaatgttcctcaaccaagtggttctccgtaactggaaa

SEQ ID NO: 30986 - protein, 137 aa, Zea mays
  misc_feature: Ceres CLONE 1407039-F
  misc_feature (23)..(124): Pfam Name: BTB Pfam Description: BTB/POZ domain
MASVKLGSKPDAFKRQGQAWFCTTGLPSDVTVEVGDMSFHLHKFPLLSKSAFLERSIEENSDQEECIIKLNDIPGGAKSFELVARFCYGVKIELSPANVVYLRCASEHLEMTEEVAEENLIAQSEMFLNQVVLRNWK

SEQ ID NO: 30987 - DNA, 655 bp, Zea mays
  misc_feature: Ceres CLONE 1407040-F
  misc_feature: Encodes the peptide sequence at SEQ ID NO. 30988
  misc_feature (310)..(310): n is a, c, t, g, unknown, or other
  misc_feature (363)..(363): n is a, c, t, g, unknown, or other
  misc_feature (389)..(389): n is a, c, t, g, unknown, or other
tccccgcggtggcggccgctctagaactagtggatcccccgggctgcaggaattcgcacgagaccattacctagaacatcctaaaaaaaaaaacctagctagatttagaggaaaaaaaaaactgtccccaaccgtgagatggctgagtacggcgagcgctaccagggcaacggcgacccggccacgcccgagggtggctacgcgcagaccgagtacgccgccgccggtggctcgccgcccgccgaccgcaagccctccgtgttctccgaccacgctgacggtcgctcctcccagccccagcatgagactncatcacatggcagtggttcctcccaatctcgagaaagggaccgagaacgtgantaagggaaggacagggagcgaggcanagaccgtgtccgcgaaaaggagagggaccgagacgggacacaggatcgtggaagaagtgacagagaacggggatcgggatcgccacccacatgaatcgtcccgagggcaccgaaataaaggaacccccggatccgttcggaaggatcgggaccgtccccccgagggatcgggacccgtccccaggagcttgatttttgaaaggggaaaaaaaaacctgggaaaaaaagggccccctaagggaatccgttcccgtccccctttaaaa

SEQ ID NO: 30988 - protein, 74 aa, Zea mays
  misc_feature: Ceres CLONE 1407040-F
  misc_feature (58)..(58): Xaa is any aa, unknown, or other
MAEYGERYQGNGDPATPEGGYAQTEYAAAGGSPPADRKPSVFSDHADGRSSQPQHETXSHGSGSSQSRERDRER

SEQ ID NO: 30989 - DNA, 729 bp, Zea mays
  misc_feature: Ceres CLONE 1407041-F
  misc_feature: Encodes the peptide sequence at SEQ ID NO. 30990
cgctctatcactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccaggccagcggcaaaacctaaccctagatgggcgccgtcacctctacggtcgcggtgcgctttgcctttttcccgccgagcccgccggcgtacgggttcgagcagccggcgccgcttccggcccctgccacacccgagcctccggtcccgggcacatccaagccgccgcctccggccccggacacacccaagccgccgcctccggccccgggcacacccaagccgccgccagcggcggaggacaagggcgacggcgcgtgggtgaagctcacggtcgtcccgcgaaggaataacgtgtaggcgcggtgcttgcggacgaagcgcccaacgaacgtgcccgcgatgcacgtgcgccaggcgtagagcaagatcacgctgctctactcccacggcaatgccgtcgacctcagacagatgtacgagctcttcgtcgagctcagcgtcaacctcaacgtctacctcctggtgtatgactattctggatgatggcaatctactgaggagtctagtgtacagacactgattctggaatagtagctgtgtacagatggct

SEQ ID NO: 30990 - protein, 90 aa, Zea mays
  misc_feature: Ceres CLONE 1407041-F
MGAVTSTVAVRFAFFPPSPPAYGFEQPAPLPAPATPEPPVPGTSKPPPPAPDTPKPPPPAPGTPKPPPAAEDKGDGAWVKLTVVPRRNNV

SEQ ID NO: 30991 - DNA, 689 bp, Zea mays
  misc_feature: Ceres CLONE 1407043-F
  misc_feature: Encodes the peptide sequence at SEQ ID NO. 30992
  misc_feature (521)..(521): n is a, c, t, g, unknown, or other
aaagtggagctccccgcggtggcggccgctctagaactcgtggatcccccgggctgcaggaattcgcacgagaccattacctagaacatcctaatcgaaaaaacagcgtcctcctcccgcgtgctctccactcccagaccccggggactacaagggcactgggctaggtccgttggcaacagccgccacactgctccgctctgctctctggaggcattgcctgcctcgagttgtcatggcggcagcggggacgcagctgggtcggctccttgttggcggcctctggctcctggccgcgttgctgcagcggggcgctgcggcggcagtggccgccgtggatgggcggcgcgccatcgcagcgactggggagaacttcgtgtgcgcgacattggactggtggccgccggacaagtgcgactatggcacctgcccctggggccgcgccggcctgctcaacctggatctctccaacaaggtcctcctcaacgccgtcagaaggacaaaggtggtgtacggcaccngcggacctcgggcggccgtggcgcgccgttcgccaagaacgcgtcggagatgcacggcttcacgcagggctgcctgaccctggcgcaggtgggacgagctcaacgccttcttcagaaaatctggggtttttagatcaggcttgggatgtcagcaaagtatgacacgaa

SEQ ID NO: 30992 - protein, 120 aa, Zea mays
  misc_feature: Ceres CLONE 1407043-F
  misc_feature (96)..(96): Xaa is any aa, unknown, or other
MAAAGTQLGRLLVGGLWLLAALLQRGAAAAVAAVDGRRAIAATGENFVCATLDWWPPDKCDYGTCPWGRAGLLNLDLSNKVLLNAVRRTKVVYGTXGPRAAVARRSPRTRRRCTASRRAA

SEQ ID NO: 30993 - DNA, 845 bp, Zea mays
  misc_feature: Ceres CLONE 1407047-F
  misc_feature: Encodes the peptide sequence at SEQ ID NO. 30994
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
tttttnnnnttttggnnnntccactgttgttatcttttttactcttgattccgcctgcggtccccgcggtggcggccgctctagaactagtggatcccccgggctgcaggaattcgcacgagaccattacctagaacatcctaatcgaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgccccctttcgcgccccgatcgcccgattccttcagggccaaggttacagatgttccaagggttaccaaaagagtttcctcgaaagaaaccgggcaaaaatcgggggaaggttcccgattcccggaggttgatgggggggtccctttgggaatcaaagggggaattgcccccccgcccacgggaggggaccccccatattaagcacagctttggaaacagcccggggaacactttttaggggcagtgggggactcctggaaaacggaatttgcgtcccccccagtggaaaaaaaaccgtccgtgtttcatccttcttgcggctccgcccccagaaggggtccctatgaaaatcgcgagtgggtagtggcgacggataagcgccggggctgacaccggcggcgggagcacaaggcgcgcaccccctccccacctcctctgccctcgcaccctccgagtactctgcctcccccgccgatctttaatcaaaacacacca

SEQ ID NO: 30994 - protein, 113 aa, Zea mays
  misc_feature: Ceres CLONE 1407047-F
MRRWWSPALAAVEPRSVQLLLLGVALVAASFYAGTLFGSSASPALVLPPFAPRSPDSFRAKVTDVPRVTKRVSSKETGQKSGEGSRFPEVDGGVPLGIKGGIAPPPTGGDPPY

SEQ ID NO: 30995 - DNA, 722 bp, Zea mays
  misc_feature: Ceres CLONE 1407048-F
  misc_feature: Encodes the peptide sequence at SEQ ID NO. 30996
  misc_feature (475)..(475): n is a, c, t, g, unknown, or other
acccgcggtggcggccgctctagaactagtggatcccccgggctgcaggaattcgcacgagaccattacctagaacatcctaatcaaaaaactactaccagctgctccctccctccttcccttccctcctacctctctctctctcttcctccgttcgtctcttgactcttctcttctccccatcagccagcagtctctctctctctcacacacacaagcagcgacttgctcacagtagtgctccccggacagaatgaccaaagacgaggagttcaagctggtcaagatccagaaccatgcgctgaaggtgaacatacactgcgacgggtgcaagcacaaggtcaagaagcttcttcagaagatcgaaggcgtgtactcggtggccattgatgtggacaaccacaaggtctcggtgacgggcgatgtggactcggagacccttatcaggaagctcaccagggggcggcaagcacgncgagctgtggtcgcagcccaaggggcggcggcaaccagggccacaagggcaatatggccagcagcagaaacagcagccgccgcaaacccagaaccagaccaccagcagaaacagaggcaggggcccatttcagcaaggatgggaacaacaaagaacagaaacgggggccaaagggcccggggaaaccaagggggagggagagggggttgggggccttaggaagggcctcagggggttaaaaaaccca

SEQ ID NO: 30996 - protein, 146 aa, Zea mays
  misc_feature: Ceres CLONE 1407048-F
  misc_feature (16)..(75): Pfam Name: HMA Pfam Description: Heavy-metal-associated domain
MTKDEEFKLVKIQNHALKVNIHCDGCKHKVKKLLQKIEGVYSVAIDVDNHKVSVTGDVDSETLIRKLTRGRQARRAVVAAQGAAATRATRAIWPAAETAAAANPEPDHQQKQRQGPISARMGTTKNRNGGQRARGNQGGGRGGWGP

SEQ ID NO: 30997 - DNA, 743 bp, Zea mays
  misc_feature: Ceres CLONE 1407051-F
  misc_feature: Encodes the peptide sequence at SEQ ID NO. 30998
aagctggagctccccgcggtggcggccgctctatcactagtggatcccccgggctgcaggaattcgcacgagaccattacctagaacatcctaatcgaaaaatcacagctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgcgctgcagcggggtgcgctcgatcaacagccgtgcgtcttcgacggcggaacgacaggccacctgcaactgcctccagagcatgacgggccggctcggcgggggcgtcagaatgggcaacgccgaccaacatccccttcaagtggcgggtcctccgtctggggtgccccataaaccccaccggtgaatgcacccaagaacaacttggattgatggaaaccaaaaggggaggacacctccgctcgttggaatggaagcggaaaggtggccactaaacgcgatgtgattacgccgcgtcgtaaaaaaaaaaggtcctacaacaaccgagggggcgtccaggaattacaaacacgtgaacaataacataaaaaa

SEQ ID NO: 30998 - protein, 124 aa, Zea mays
  misc_feature: Ceres CLONE 1407051-F
  misc_feature (39)..(116): Pfam Name: Tryp_alpha_amyl Pfam Description: Protease inhibitor/seed storage/LTP family
MAARSSSSQPQLVAAAAVLAAALLLLAAGAGTASAAVSCGEVTSSVAPCLGYAMGSAASPSAARCSGVRSINSRASSTAERQATCNCLQSMTGRLGGGVRMGNADQHPLQVAGPPSGVPHKPHR

SEQ ID NO: 30999 - DNA, 717 bp, Zea mays
  misc_feature: Ceres CLONE 1407053-F
  misc_feature: Encodes the peptide sequence at SEQ ID NO. 31000
aagctggagctcaccgcggtggcggccgctctagaactagtggatcccccgggctgcaggaattcgcacgagaccattacctagaacatcctaatcgaaaaaccacgagtttttcctgttcgctttgctttctcgcttcagatactggtgatctgctaggaacaccaacagcagtgagttcttgcgccgccttttcttgccgcgtttctgctcgatattattgccagattggaactgcccgtcccgtttcaatgaggccgaagaatagagatgctggcgcgcggagagtcatggaccaggtccccgccgccatgaggcccctcgccgtggacgacgacaccgtgtgcctcaaggtgcttgacaacctcctgcgccgctgccagtatcatgagacaacgacgaatcacgctgttgccagcttgagtatgctgaggcacaacagcgaccagtttgatcttgctattagtgatgcgcacatgaaatacatgaatgcctttacgattctagagttcgccgagcatcgaaaaggacctctcctgtcaatatgatatcgcgggaaagtaaagaacaagactgacactgaatggacataactgcatgggcgccagagaactatctccttaaaagcctggatttgttgtggaaatatgcttcaagtaacattctgggcatctacaggcttgaccaggaacaaacaattctagtaatactggctgc

SEQ ID NO: 31000 - protein, 98 aa, Zea mays
  misc_feature: Ceres CLONE 1407053-F
  misc_feature: SWISSPROT Homolog: EC 3.1.4.17 3',5'-cyclic-nucleotide phosphodiesterase
MRPKNRDAGARRVMDQVPAAMRPLAVDDDTVCLKVLDNLLRRCQYHETTTNHAVASLSMLRHNSDQFDLAISDAHMKYMNAFTILEFAEHRKGPLLSI

SEQ ID NO: 31001 - DNA, 684 bp, Zea mays
  misc_feature: Ceres CLONE 1407055-F
  misc_feature: Encodes the peptide sequence at SEQ ID NO. 31002
  misc_feature (526)..(526): n is a, c, t, g, unknown, or other
  misc_feature (527)..(527): n is a, c, t, g, unknown, or other
  misc_feature (544)..(544): n is a, c, t, g, unknown, or other
  misc_feature (585)..(585): n is a, c, t, g, unknown, or other
  misc_feature (645)..(645): n is a, c, t, g, unknown, or other
aagctggagctcaccgcggtggcggccgctctatacatagtggatcccccgggctgcaggaattcgcacgagaccattacctagaacatcctaatcgaaaaccgaatctcacacccaaaagtttcccactgccctcgtcccccattcaattcttccaactccgccgcttcgcctcgttccgtccgccgccctcatggcgtccgccgccgccacgaccacctccgcccccgcccagaacatcaatccccttagtatcaacatcaagctccccccatggctcagcgggctgcgctgccccttcaccttcgtctgcccgcccccgcccccgcctccgccgccgccgccgcctcctcccccgctgccacctacggaacccgtggtcccacggtcgcggaggttaccaagcctgcgggtgaccacggagtacgatagcgaagagggcgtgtttgtgaacaaggtgtcgtgcaagcttgcgggggacctcgccaaactgcggctctccttccagagcgacccgcagggaggnnaaaaagaggggcggggnaagaaaagggaacccgctacagcagctcttcgccgcgccgntggggggggctcatcaccaagcgtttctccgtgctctacgacgtcgaggcacgcaacgcngctgctcccgcggagactgctcgctttccccggaggcgg

SEQ ID NO: 31002 - protein, 163 aa, Zea mays
  misc_feature: Ceres CLONE 1407055-F
  misc_feature (112)..(112): Xaa is any aa, unknown, or other
  misc_feature (131)..(131): Xaa is any aa, unknown, or other
  misc_feature (151)..(151): Xaa is any aa, unknown, or other
MASAAATTTSAPAQNINPLSINIKLPPWLSGLRCPFTFVCPPPPPPPPPPPPPPPLPPTEPVVPRSRRLPSLRVTTEYDSEEGVFVNKVSCKLAGDLAKLRLSFQSDPQGGXKEGRGKKREPATAALRRAXGGGSSPSVSPCSTTSRHATXLLPRRLLAFPGG

SEQ ID NO: 31003 - DNA, 655 bp, Zea mays
  misc_feature: Ceres CLONE 1407064-F
  misc_feature: Encodes the peptide sequence at SEQ ID NO. 31004
  misc_feature (458)..(458): n is a, c, t, g, unknown, or other
aaagctggagctccccgcggtggcggccgctctagaactagtggatcccccgggctgcaggaattcgcacgagaccattacctagaacatcctaatcgaaaaatcacacatattattgagaccaactagcaacatagaaagcacaatagtgtaccaacaatggcagccaaaatattttgcctccttatgctccttggtctttctgcaagtgctgctacggcgaccattttcccacaatgctcacaagctcctatagcttcccttcttccctcgtacctctcaccagcggtgtcttcggtatgtgaaaacccaattcttcaaccctacaggatccaacaggcaattgcagctggcatcttacctttatcacccttgttcctccaacaatcatcagccctattacagcagttacctttggtgcatttattggcacaaaacatcagggcacaacaactacnacaacttgtgctagcaaaccttgctgcctactctcagcaacatcagtttctttccattcaaccaactagctgcattgaaactctgcccctttatttggcacaaccacaacctaccatttcggccgggtttctgctgccttaccccaggaattttcttcattccaccaactgacagaattgaaatctcccggcttatt

SEQ ID NO: 31004 - protein, 156 aa, Zea mays
  misc_feature: Ceres CLONE 1407064-F
  misc_feature (100)..(100): Xaa is any aa, unknown, or other
MAAKIFCLLMLLGLSASAATATIFPQCSQAPIASLLPSYLSPAVSSVCENPILQPYRIQQAIAAGILPLSPLFLQQSSALLQQLPLVHLLAQNIRAQQLXQLVLANLAAYSQQHQFLSIQPTSCIETLPLYLAQPQPTISAGFLLPYPRNFLHSTN

SEQ ID NO: 31005 - DNA, 725 bp, Zea mays
  misc_feature: Ceres CLONE 1407065-F
  misc_feature: Encodes the peptide sequence at SEQ ID NO. 31006
aagctggagctccccgcggtggcggccgctctataactagtggatcccccgggctgcaggaattcgcacgagaccattacctagaacatcctaatcaaaaaagagcagagctgcctccagacgagacgaggaggacgcggcgccgttcgggcttggcagcaaccagcgtctagcgcagtgcccttctgtctcctatctccccggagtccccgctgcccagcccggtctcactttccagtctccgagactccgagtctcgctcgcaccccgtcccctgcagcctgtgctctgggttggagggaggtgagctgcgagggagcgcggagggggcgaggagatggaggcagattcggcgaggaagagacttgcattgctggccctgcttctcctggcggcgcccgtccgcccggcctcggcggctccggtggaggatggcctgctcagcaatggtgactttgagacagcaccaagtggtggttttgtaaaatctgcttctgttgctgagggtgcatcgtcaatccctggttggacgatcaacggcacggctgaactcatttcagcaggccaacaccagggtggcatgatcctgattgttccacagggggaccatgcagtaaggctagggaatgatgctagcgttgggcaggtggtggacgttgagaagggttcggagtatgctatcacattcagtgctgcccggacatgtgcacaactggagggactga

SEQ ID NO: 31006 - protein, 129 aa, Zea mays
  misc_feature: Ceres CLONE 1407065-F
MEADSARKRLALLALLLLAAPVRPASAAPVEDGLLSNGDFETAPSGGFVKSASVAEGASSIPGWTINGTAELISAGQHQGGMILIVPQGDHAVRLGNDASVGQVVDVEKGSEYAITFSAARTCAQLEGL

SEQ ID NO: 31007 - DNA, 728 bp, Zea mays
  misc_feature: Ceres CLONE 1407066-F
  misc_feature: Encodes the peptide sequence at SEQ ID NO. 31008
  misc_feature (392)..(392): n is a, c, t, g, unknown, or other
  misc_feature (442)..(442): n is a, c, t, g, unknown, or other
tggagctccccgcggtggcggccgctctagaactagtggatcccccgggctgcaggaattcgcacgagaccattacctagaacatcctaatcgaaaaaacgaaccaaacataaattcagcccaccgctcctgctgctgctgcttcgaggacaggacggagggaactcacgcgcgagcaaagcaaagcacaagcagcaatggggatctgctgcggcaaggccaaggcggcggcaggggagcccgacgacgacgagggcctgggcttcccatggatgcacgacgacctgttccacagccacctgtgggccagcgccggcgtctccgtgcacaccaagcagggatggaagggcgccaaccaggacgccatgaccgtctgccaggacttcgccggncagaaaggtcacatcctctgcggagtggtcgatgggcacggtcctcgtgncccgggagtcgctcgccacgtccgcgacaccctcccggtgaactagccgccgctctgaagccgagacccgggacgagaaccctcccgctcgagcgacgcttcgaagcttaaactgacaaaatggctcaggggagatggaaaaaatggctcagcaaaaaggggatggctcaacaacgcaatttggatccttcacaaatcaggaggaacggttcgtccgggagtttccaggagcaaacccgcaaaacgtttggggttccctttaaaaaagggtcggggggtttttaaa

SEQ ID NO: 31008 - protein, 96 aa, Zea mays
  misc_feature: Ceres CLONE 1407066-F
  misc_feature (82)..(82): Xaa is any aa, unknown, or other
MGICCGKAKAAAGEPDDDEGLGFPWMHDDLFHSHLWASAGVSVHTKQGWKGANQDAMTVCQDFAGQKGHILCGVVDGHGPRXPGVARHVRDTLPVN

SEQ ID NO: 31009 - DNA, 640 bp, Zea mays
  misc_feature: Ceres CLONE 1407067-F
  misc_feature: Translation starting site: 157
  misc_feature (319)..(319): n is a, c, t, g, unknown, or other
  misc_feature (407)..(407): n is a, c, t, g, unknown, or other
  misc_feature (410)..(410): n is a, c, t, g, unknown, or other
  misc_feature (444)..(444): n is a, c, t, g, unknown, or other
  misc_feature (462)..(462): n is a, c, t, g, unknown, or other
  misc_feature (466)..(466): n is a, c, t, g, unknown, or other
  misc_feature (526)..(526): n is a, c, t, g, unknown, or other
  misc_feature (533)..(533): n is a, c, t, g, unknown, or other
  misc_feature (619)..(619): n is a, c, t, g, unknown, or other
aaagctggagctccccgcggtggcggccgctctagaactagtggatcccccgggctgcaggaattcgcacgagaccattacctagaacatcctaatcaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctttcccgttcgtggctcgcgnaacctcgggcgcctctacgacgccatcaccgacgccctccacgggtccgggtgcacgctcatggttccgcgggccgtggctcgcccgnggncggcggacttcctgctgacgtgcgacccggcggncgtccagcactggctggncgtncaaaccacgggggctacgacagggggccgagacttttgcggagatgttcgacctcctggncgacggnctgctgttgcggatgccccggtcctgggcgggccaagggaacgtcgcgccacccgtttcggaaccccgggggtccgggtccttcgncctggggaccatggggcgcca

SEQ ID NO: 31010 - DNA, 707 bp, Zea mays
  misc_feature: Ceres CLONE 1407073-F
  misc_feature (608)..(608): n is a, c, t, g, unknown, or other
aagctggagctccccgcggtggcggccgctctagaactagtggatcccccgggctgcaggaattcgcacgagaccattacctagaacatcctaatcgaaaaagatggctgagagcctgagacgggcgacgcccgcacgcccgcacaagctgctccgggctccgctgctaggctagggtttggactttggattggagccgcaccgccgcaccgccaccgcagccgccgcagtgccgcacagccgccactcccgtcttggtcttgcggccagtcgccctcgggcctcgaccatcagcccctcgcccgctcgccgagacaccgagtcggcatcgaccgtcgtcgcgtctccgaggtccagcgcctagtggcccagctccaagcctccagccatcggcgcccgccctcctccgccgagacgccgagtgccgagcgcccgagcaccccggtccccagcgcccaacaagctagcaggctgcaggtatgcgctctttgttgatgcgtccaaggagttgagctgaatgcccagaaggctagcaggctgcagaaactgaaggaaaaggcggcattcaggaccccggatgagttctattttaaaatgatcaacagtanggactggttggtggaattcaaagacctaagcctgaagataataagtatactgaagaggaacttcatctgttgaaaataaagatatgggatatatccctt

SEQ ID NO: 31011 - DNA, 670 bp, Zea mays
  misc_feature: Ceres CLONE 1407075-F
  misc_feature: Encodes the peptide sequence at SEQ ID NO. 31012
aaagctggagctccccgcggtggcggccgctctagaactagtggatcccccgggctgcaggaattcgcacgagaccattacctagaacatcctaatcgaaaaacttcttttcccccagttgcgttgcgtgcccctcgtttccacactttgttgcgctcctttagcgccggcggcccgtagcctcaatcatcatttccattccatccggtttcttccgacgacggtgtgtacagagagcaggatcggacaagtctctgctggtagaagcatggcgcagcgccggctgttgggcacggcgccggcgcccgcgggcgatgcggcgtcgcacggctcgggctccagccccgacgcgatgcggatcatggtgggcgtgctggtaacggtcatcgtctgcacgctgctctactgcgtctactctggcggtggcggaagcgcaatgccatccggagatccctgctggacagcctatggcggcggtcgagctcggacctgccgctcatggacctcgcctccatcctcgctgccaccgacaacttctccaaggccaacaagctcggcgagggcgggcttcggccccgtctacagagtgagaaatcaacccaaggtcgatggatgtggccacagctagctgttttgttactctacatctaatagcaatatgcatgatttg

SEQ ID NO: 31012 - protein, 119 aa, Zea mays
  misc_feature: Ceres CLONE 1407075-F
MAQRRLLGTAPAPAGDAASHGSGSSPDAMRIMVGVLVTVIVCTLLYCVYSGGGGSAMPSGDPCWTAYGGGRARTCRSWTSPPSSLPPTTSPRPTSSARAGFGPVYRVRNQPKVDGCGHS

SEQ ID NO: 31013 - DNA, 2447 bp, Zea mays
  misc_feature: Ceres CLONE 1407077
  misc_feature: Encodes the peptide sequence at SEQ ID NO. 31014
ctagtttcatttcctcctgttccagccgctcacccaagaaccggtcgtcaggagcttgggccgaccgagctattctattctccttgttccttttggccgttcgcccctttactccttctttgtttctttgtttctttttttttcctttcttgcatctggccgctagttactctttctctctttctgtttttttttgttctagcagctggccgctagtttctcttggctgacctctcttttctctctttttttttcgaaatctgttccggtttctgttcgtgtgcttagggttcacagaaccctaaactgttcttagttttcttatacctgatctgatcggttgtagtgatttctgccgagctctcagggataaaatccctttcattattttactgtttttttttaaaaaaatgaactcggttcatcagggtttctggaactcgattcgagttggggattctgtactaactcgtactccgagatcctctttctgtttggaactacaggagaaaacgacccccttcctccaatcgtatagagttcttgatattattattattatttttttatttataccaccgcacagatcgaccatcggatttgttgaacccgagctctattatttttctgtgaatgaaatttctgtacctttgactgacaaccagtacatggattatattgatagtgctctgtgcacataatctgtacgtggtttctgttttattgactgtttcttggccgtggatcgtggatctcgagccactgttctcttttgttgacccagattaaaaccgactagggttaggttattaaaccctaactctaaaaaagttatctgtttttaccatctcggaatccatgggtttggcctagactagagtctgacagtggccaaaacccttgattagtgttaggttaaaaccctaacccgagagatctaaaaaaaatctttctattctaaactgtctgttctcgggtgattaactatgaataaaaaaataagttcaatcacatttatccgagaccttctgtgatctcatacaaaccaaaacgtggattaggagatatagggttcttaggttgcctttgataccattgttgggatctatactgtctaggatcgattcctaagtccctagaaaaccaatccgtaactggaactggaagtataatcttgatgacgagtagttctgatctactaagaggaatagaggaatacacaccttacctttgttgctgttgctatcttcataccgtcgccctgcagagaagcagcaggcatcgggatccgagccgctgtaggttgtcgcgtttccaaacactccgacgcctaggcgatgggggcctctgaggactagggttttggggcgaggtactagcgttagtctttcctgcgaccctttagtcctatatataacgtcgtgtgtctgggggctccaaccgaggttagcgtgggccctcccgatcaagggcccgattaaagaaacgatagttgggttaagtccaatccagtctctattgaccggctgtagaggacacacccaacaccacggcctccctcgaccagcggcacgcgtacgccatcaccccttccctactgctcccacccgagattgttgttgtccccatctatgccttaggtttgcactcgccgaggccgcccccgtcctccccaacggcgaatcgcgatgattatgcccccatccacgcgccacgcacctccttccccgtcgctcccaccgaagagggtcagcgtccttcctccttcagtcccttcccttgcttcgctctcaacgcgactgaccatccatggagcaaggctaggggattcgccgagcgggacaaaaactggttcagcggcggtgtggtgctcggcgcgtctaggagctcccggcggcggcctctgggatggtgaccatgatgcatgggctcaggacgatgttcatgtcacacaagggcaagatccaggtgcacagggacgagcagagcattgccttcgcctctgtatctacatctgtcagcacgaacatatgagctgctaggtatcctaatctttttccatgtctatctatccctcacccatgtggatattgtgcccgtgttttgatggcggcttagaatcttgttgaagcagccgttctgtattccctcctttcaaaagcaaatcttgagaataacaggtaaagaagtcccgaagaggagcaaaatcattgattggatgtgggcttacatccaaaatgtgaccgtttctaaagggtgcataatgaatcttacggtgataagcttagacctatttgctgtttggaatactacggcatagaagaagcaatggtgcaattaaacagtttatttaaaagattataaagttggagcaaacttttagctgtagcatacatcttctatcagatttatcacaattttctttgctgaaaaaaaaaaaaaaaaaa

SEQ ID NO: 31014 - protein, 117 aa, Zea mays
  misc_feature: Ceres CLONE 1407077
MIMPPSTRHAPPSPSLPPKRVSVLPPSVPSLASLSTRLTIHGARLGDSPSGTKTGSAAVWCSARLGAPGGGLWDGDHDAWAQDDVHVTQGQDPGAQGRAEHCLRLCIYICQHEHMSC

SEQ ID NO: 31015 - DNA, 732 bp, Zea mays
  misc_feature: Ceres CLONE 1407080-F
tcaccgcggtggcggccgctcttgaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccaacgggaaaacctaaccctagatgggcgccgtcacctctacgggcgtggcgcgatttgtctttttcccgccaagaccgccggctcacggtccccagcaaccggcgccgcttccggcccctgccacacccgagcctccggccccgggcacatccaagccggcggctccggccccggccacacccaagacggcgtcctacgggcccggccacacccaagccgccgccagcgtgcgatgagaagggcggaggcgcgccgctggacctcacggcacgtaccacgcagggataacgtgtaggagcagcgcatgcggacaaaacgtggcacggaagaggccgcgaagcacgcgtgccaggagagggacaagctcacggtgctctagtccagagtgaacgccgacgaccacgtccagatgtacgatctcttcaccgaggtcagcgaccactgcacgtcaacctcatgttgtatgactattctggttatgtgcaatgtactgagaagcctaatggacaacatacttaatctgacagagagac

SEQ ID NO: 31016 - DNA, 679 bp, Zea mays
  misc_feature: Ceres CLONE 1407081-F
  misc_feature: Encodes the peptide sequence at SEQ ID NO. 31017
  misc_feature (512)..(512): n is a, c, t, g, unknown, or other
  misc_feature (579)..(579): n is a, c, t, g, unknown, or other
  misc_feature (586)..(586): n is a, c, t, g, unknown, or other
  misc_feature (619)..(619): n is a, c, t, g, unknown, or other
  misc_feature (620)..(620): n is a, c, t, g, unknown, or other
cgcggtggcggccgctctagaactagtggatcccccgggctgcaggaattcgcacgagaccattacctagaacatcctaatcgaaaaatttcaccttccaccctcccccactttctcctcaccgagtcacaaagccaaaccctaattcacggccgccggagatgggacaaggttctcccggcgggatgggcaagcagcccggcctcccgggcgaccgcaagcagggagacggcaagaaagagaagaaatatgaaccacccgctgccccttcccgtgtcggccggaagcagaagcggcagaagggctccgaggcggcggcgcggctccccgccgtggcgccgctctcaaagtgccgccttcgcctactcaagctcgaacgcgtcaaggactaccttctcatggaagaggagttcgttgccagccaggagcgcctgcgccccagcgaggataagacggaggaggaccgatccaaggtcgacgacctccgcggcactcccatgaacgtcggatcngctggaggagatcatcgacgagagccatgccatcgtctctttcgtccgtcggtcccgagttactacngtcgggnatacttttccttcgttgataaggaccagtccgnnagcctggatgtgccattcgttgggacaaaaccaagggtctggggccgagggtttttgga

SEQ ID NO: 31017 - protein, 172 aa, Zea mays
  misc_feature: Ceres CLONE 1407081-F
  misc_feature (140)..(140): Xaa is any aa, unknown, or other
  misc_feature (142)..(142): Xaa is any aa, unknown, or other
  misc_feature (153)..(153): Xaa is any aa, unknown, or other
MGQGSPGGMGKQPGLPGDRKQGDGKKEKKYEPPAAPSRVGRKQKRQKGSEAAARLPAVAPLSKCRLRLLKLERVKDYLLMEEEFVASQERLRPSEDKTEEDRSKVDDLRGTPMNVGSAGGDHRREPCHRLFRPSVPSYYXRXYFSFVDKDQSXSLDVPFVGTKPRVWGRGFL

SEQ ID NO: 31018 - DNA, 679 bp, Zea mays
  misc_feature: Ceres CLONE 1407085-F
  misc_feature: Encodes the peptide sequence at SEQ ID NO. 31019
  misc_feature (366)..(366): n is a, c, t, g, unknown, or other
aaagctggagctccccgcggtggcggccgctctagaactagtggatcccccgggctgcaggaattcgcacgagaccattacctagaacatcctaatcgaaaaattccttcgcttccgtcaggtcgggtccgcagcctccccctctcgcagatccccacctgctcctccgccggccaccgcgttgctcccctcggcagccaggatgacagaagtaccatttctgccgcgtgagaggctcttcaagcagcaacattacttccagaacttgaccaagcacacctacctgaaagggcgctacgacgtgatcacctccgtcgccatcccccttgcactcgctgcctccagcatgttcatggatgggcgtgnagttttacacatgtctcatgggggtgggaagaaagagtgatcttccactgggtaactattgtttctgcttggcatggaagtcataacgtcaagactgcaaagtcctcttcgcttggaaaataaaacgggccaataacaattcgaataaattttcccaacaattttcggttggaattgggggggggaagggggagaaatttggaaatcccccgggcccgggtttgggaaaaaaaccccctccctttcgcctttggggcccctttaaaaaaaaagggggcgtggaaaaaccccttttctttttatagggcgccgg

SEQ ID NO: 31019 - protein, 67 aa, Zea mays
  misc_feature: Ceres CLONE 1407085-F
  misc_feature (9)..(62): Pfam Name: COX7a Pfam Description: Cytochrome c oxidase subunit VIIa
  misc_feature (55)..(55): Xaa is any aa, unknown, or other
MTEVPFLPRERLFKQQHYFQNLTKHTYLKGRYDVITSVAIPLALAASSMFMDGRXVLHMSHGGGKKE

SEQ ID NO: 31020 - DNA, 676 bp, Zea mays
  misc_feature: Ceres CLONE 1407086-F
  misc_feature: Translation starting site: 219
  misc_feature: Pfam Name: Iso_dh Pfam Description: Isocitrate/isopropylmalate dehydrogenase
  misc_feature: SWISSPROT Homolog: EC 1.1.1.42 Isocitrate dehydrogenase (NADP(+))
  misc_feature (604)..(604): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
ggagctccccgcggtggcggccgctctagaactagtggatcccccgggccaggaattcgcacgagaccattacctagaacatcctaatcgaaaacctgttcctcctgtcatctcctcctcctcagaaacccaccaaccccgtccagccgccggctgtctcggccgtcgccgccgccgccgccgccctatcccggtccttcaggtgaaccaggttggccatggccttcaacaagatcaaggtcgccaaccccatcgtcgagatggacggcgatgagatgaccagggtgttctggaaatctatcaaggacaagcttatattccctttcgtagacctcgacatcaaatattttgacctcgggcttccacaccgtgatgctaccgacgacaaagtcacagtggaggctgcggaggccacactcaagtacaatgtggctatcaagtgtgccaccattacaccagatgaagcaaggggtaaaggagtttggcttgaaggctatgtggaagagcccaaatggcacaattaggaatattctgaatggcactgtgttcagagaaccaatcatctgcaaaaacatcccacggcttggttccagggtggacaaangcccatttgcattgggaggcatggcattcggcgatcagtaccgggaaactgagagnnntattccaagggggc

SEQ ID NO: 31021 - DNA, 736 bp, Zea mays
  misc_feature: Ceres CLONE 1407088-F
  misc_feature (9)..(9): n is a, c, t, g, unknown, or other
  misc_feature (13)..(13): n is a, c, t, g, unknown, or other
  misc_feature (24)..(24): n is a, c, t, g, unknown, or other
  misc_feature (25)..(25): n is a, c, t, g, unknown, or other
tgtttcttntttnattttttttanntgtgtaatattgaattcatttagtctaaaggagatccccgcggtggcggccgctctagaactagtggatcccccgggctgcaggaattcgcacgagaccattacctagaacatcctaatcgaaaagaaaggtagatattttttcccgtctcgctcaatgattcaccccatcgcagccatcgatcagaaaatttacggctcataattctcgtctgcttatccgctcccttctctccctcaacttcagcaagttccccgcaaaaccgcagccggaggtcgccggtcgccaccaccaatggggccacccgccatggcgttccaagccctcaccctcacgccactccccttctcactccacagctcgagccgccgcgtccgcgtgcttgccgttgcggccgaccagactcctccgcccgcccccccttcggagccggcgaacagccctagccgcctccttcgcgagctcgcgcagcggaagaaggccgtatcccctaagaagaagcatccgccgcgtcgcttcatcctgaagccacctctcgatgacgagcgctttacccggcggttcctcagcagcccgcagctgtcgctcaaggcgctcccgctgctctcttcctgcctcccctccgcgccgctctccaccgccgaaggggacctgggatggacgagtacctcctcgaagggccagcaaaggcgcctcgggtacccgctcggc

SEQ ID NO: 31022 - DNA, 665 bp, Zea mays
  misc_feature: Ceres CLONE 1407094-F
  misc_feature: Translation starting site: 226
  misc_feature: SWISSPROT Homolog: EC 2.1.1.125 Histone-arginine N-methyltransferase
  misc_feature (437)..(437): n is a, c, t, g, unknown, or other
  misc_feature (461)..(461): n is a, c, t, g, unknown, or other
  misc_feature (462)..(462): n is a, c, t, g, unknown, or other
  misc_feature (484)..(484): n is a, c, t, g, unknown, or other
aagctggagctccccgcggtggcggccgctctagaactagtggatcccccgggctgcaggaattcgcacgagaccattacctagaacatcctaaaaaactcaaacccctaatccctagccacaccacgccctcttccctccttccccgttggcttcggcggcgggcggccatcagcaaccagcatcgtacggaggagaagcgctgtttacacccgtctggcagggatgccgctggggcagcgttcgggggacaagagcgactcccgctactgcggggtggaggttctcgacttccccgccggggagggcctccctgccgtcctcaatcactccctcgcctccgccttcgactcatcctcgcccctctggttgatcccaactaccggccgcgccccggcgccgttctggcagtgtcagcgtcggacctcgtcctcggnccgtcccagtggagcaaccacgtnncgtcggaagatcagcgagtggnatcgatttggacgcggagggacgagcggctccggctggactccgagctcacgctggaagcagggagatcgcttgggcatctcacgtctcgctggcaggcatgtgttattctgccccccaggaagatctttttgcgcattatttggccagaggtgtgaatcaaaattttgcaggctgccaaa

SEQ ID NO: 31023 - DNA, 660 bp, Zea mays
  misc_feature: Ceres CLONE 1407099-F
  misc_feature: Encodes the peptide sequence at SEQ ID NO. 31024
  misc_feature (291)..(291): n is a, c, t, g, unknown, or other
aaagctggagctccccgcggtggcggccgcccgagaactataggatcccccggtctgcaggaattcgccacgagaccattacctagaacatcctaatcgaaaaagccagcaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggnggaatctcccgggacgcctctccgtccgcgcctccgcgacggtggtatgggcaccgaggaccgaaacgcacccccccaccgtcggaggagcagagatcatgtcctatcaccccggtcgccccaacacaagcacctcacccgtgcgcgcattgccacccaccaccctccccgcaacccccccacgtccacaccaccaaccaaactacccatataagccctcctacaccccccccccatatttacttctcaccagcatctcatccacccccaactccttatctccctcttcttaatacccacctgaaaaataacaccgaacaccacactgaatcagccataaccatccgtactcccatcttagtaccaccc

SEQ ID NO: 31024 - protein, 117 aa, Zea mays
  misc_feature: Ceres CLONE 1407099-F
  misc_feature (21)..(21): Xaa is any aa, unknown, or other
MQSLLLPTAAVAPVAPPCGRXNLPGRLSVRASATVVWAPRTETHPPTVGGAEIMSYHPGRPNTSTSPVRALPPTTLPATPPRPHHQPNYPYKPSYTPPPYLLLTSISSTPNSLSPSS

SEQ ID NO: 31025 - DNA, 686 bp, Zea mays
  misc_feature: Ceres CLONE 1407100-F
  misc_feature (194)..(194): n is a, c, t, g, unknown, or other
  misc_feature (200)..(200): n is a, c, t, g, unknown, or other
  misc_feature (202)..(202): n is a, c, t, g, unknown, or other
  misc_feature (203)..(203): n is a, c, t, g, unknown, or other
  misc_feature (205)..(205): n is a, c, t, g, unknown, or other
  misc_feature (222)..(222): n is a, c, t, g, unknown, or other
  misc_feature (224)..(224): n is a, c, t, g, unknown, or other
  misc_feature (232)..(232): n is a, c, t, g, unknown, or other
  misc_feature (234)..(234): n is a, c, t, g, unknown, or other
  misc_feature (609)..(609): n is a, c, t, g, unknown, or other
  misc_feature (610)..(610): n is a, c, t, g, unknown, or other
aaagctggagctccccgcggtggcggccgctctagaactagtggatcccccgggctgcaggaattcgcacgagaccattacctagaacatcctaatcgaaaaaccctaaccttttcgctgctccagcgaagacacagccaccgccgtttcttcgtcttcctcgcagcgccggcgcgccatctcggtacgaaggngacggngnngntcaggatcgggatctcngngacgacgncngaggcttcccatcccgacccccgccaggcgcctcgcgccctcgactccggactccggtcctccgcacaccggccggtgaccctgcgtttgaacctgctatagaaatttataaaagggccgcggttgccgccacaccaaggagatggatgcaccgcatggttgaaaaaaggatgacccaaaagagaccctggattaagaagaacatggtggcaaccggacaccttccggttggggcagggtcagccctttgctccggaggggggaccatgatgaagaacggccaaggtgaaggccccctccccgggagggggcccccgcctgtccgggaagaaaacacaaaagacaacaccggaaaggaaaaaggggccccccttnncatcagaggatccccccctcatctactggggggttgaagctcttccccctccagtatttttttttgatagggctat

SEQ ID NO: 31026 - DNA, 683 bp, Zea mays
  misc_feature: Ceres CLONE 1407101-F
  misc_feature: Encodes the peptide sequence at SEQ ID NO. 31027
tccccgcggtggcggccgctctagaactagtggatcccccgggctgcaggaattcgcacgagaccattacctagaacatcctaatcaaaaaaaacgaaagatcctcctccctcccaaaggtgaggccgttagccaggaattccggcaacaatgacttccctctcctccgctgtggcactgccgtcctcgtgccgggcccggccggcggcgggcagccggagggcgcggatggtggtgacgcgcgcggcgacgtctagcccgaagctgccgaacgggcgacggctgcggctggcgccgcagcgaggcggacccgccgtagttgccgcgcgggaggcgctgggcaacggcggggcttgagacgccgctaatcaagcggacgatggacaactgcaaagccctgcggcgctaccatcgctctgtgcatggtggtcgtagttcgaccttgccggtcgacctttgagggccggacggtgaggaaagatgaacatgatttccgccgtccaaggtcgcctgggaacatagagcgggacgcttggtgccccaggagaatctctggaatggacgggtggggagggtgaacgacccccaaccccgggctccaggaccccccccgcccggccccccaagacgggtaaggccctcctgctaagggccggaggggctcccaaaaaacttaagggccc

SEQ ID NO: 31027 - protein, 68 aa, Zea mays
  misc_feature: Ceres CLONE 1407101-F
MTSLSSAVALPSSCRARPAAGSRRARMVVTRAATSSPKLPNGRRLRLAPQRGGPAVVAAREALGNGGA

SEQ ID NO: 31028 - DNA, 627 bp, Zea mays
  misc_feature: Ceres CLONE 1407102-F
  misc_feature: Encodes the peptide sequence at SEQ ID NO. 31029
  misc_feature (325)..(325): n is a, c, t, g, unknown, or other
  misc_feature (592)..(592): n is a, c, t, g, unknown, or other
aaagctggagctccccgcggtggcggccgctctagaactagtggatcccccgggctgcaggaattcgcacgagaccattacctagaacatcctaatgcgaaaaatcccacgctgccctcggagctgcgcctggacccggcacctacctcccccctccccacctcgccgccggaggctggagtcgcgctgtagcagcggctctcctctgttacctccctagccccgtataaggaaaaggataaaacacagagagagagagcgagcgtacggtcgactcggaagccatggcggacggggtggagttgcgcccgtaccggggtagagnccaattacttccgggaggcctgggttggggacctcttaggccctcgggggagctccttcaaaagcgtaccgcttttaaaaaaagccggggcccggggtttggaacccccatttcggttttcccaaaaaagacctcccgaatggggcggcccccaggtggccccccaatggacttgaggaccccgaggggccccccttataccccagagggaccgtcccaaaaggacaacggggggggttcccctctgcccttttgaaaagggagaantggcccccccccggacaaaaaggggcccgcacaaa

SEQ ID NO: 31029 - protein, 98 aa, Zea mays
  misc_feature: Ceres CLONE 1407102-F
  misc_feature (14)..(14): Xaa is any aa, unknown, or other
MADGVELRPYRGRXQLLPGGLGWGPLRPSGELLQKRTAFKKSRGPGFGTPISVFPKKTSRMGRPPGGPPMDLRTPRGPPYTPEGPSQKDNGGGSPLPF

SEQ ID NO: 31030 - DNA, 654 bp, Zea mays
  misc_feature: Ceres CLONE 1407103-F
  misc_feature (461)..(461): n is a, c, t, g, unknown, or other
  misc_feature (464)..(464): n is a, c, t, g, unknown, or other
  misc_feature (616)..(616): n is a, c, t, g, unknown, or other
  misc_feature (628)..(628): n is a, c, t, g, unknown, or other
  misc_feature (629)..(629): n is a, c, t, g, unknown, or other
aagctggagctccccgcggtggcggccgctctagaactagtggatcccccgggctgcaggaattcgcacgagaccattacctagaacatcctaatcgaaaaagcggaaggcccgccgcttccccttcttcattcccgtcccacacacgccgccgccgccggtgcggctcgcttccgtcccccccggtccgcgcgggctgcctgcgggagcagggtggcagggcactccggcaaccacgtgggtggggatgcgacgacaccaccctatgctctgtcctcgcccgcagagtaagattgcagcagcagtgaatttgggagcttgaagcattcatctgagacatggaaaaagtgatctgctgggcatatctccttcaacgcaagcagttctcgaaagaaactcttgattgctgtgtcttagctcgtgggaacactcctctctcctctctcgtgactacacatagnggntatatggtcctctatgctcaacaacagcaggctgatgcgatattttgctgaaagtattatatttcagtctatgccagacatctacaatgtagatggtgctcaataaaaggggggggtgaaatattttgcctgggttcagcctaacatctggntggcggcctagnntagctatttgggccttttggggaaa

SEQ ID NO: 31031 - DNA, 645 bp, Zea mays
  misc_feature: Ceres CLONE 1407104-F
  misc_feature: Encodes the peptide sequence at SEQ ID NO. 31032
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (434)..(434): n is a, c, t, g, unknown, or other
  misc_feature (435)..(435): n is a, c, t, g, unknown, or other
  misc_feature (539)..(539): n is a, c, t, g, unknown, or other
  misc_feature (540)..(540): n is a, c, t, g, unknown, or other
gcggtggcggccgctctagaactagtggatcccccgggctgcaggaattcgcacgagaccattacctagaacatcctaaaaaaaaaacggttaaacccatgccgctaatcgacgccgccgcctcggcggtcgcgccgcccccaccccggcgagtggctcaactccgcttcttcagcactcgcagacccggaatcctatccctaactgccaccagctgctccccctcccctccgcccccggtcgctgcggaggtgcctgcggcgccacaggaagcgaagtcgaagccgaggccacggcggtacccgaagcagtaccccggcgagtcggtgggcgttgctgaggagatgcgctttgtcgccatgcgcctgcgtaaccccaagcgcaccaccataaaagacaaagtcggggacggaggacgcgacgccggnnnncgnngggtgtcggagggcgaggctgaggaggacgacgggcggcggcgtgaaggaggacacgaggagggaggatgagggcgagctcgaggaaggggaatgatccccccnntggtgggggggtttcggcgaatactggggggacagcaggctcgtcttcgaacatcgagggggggccgggggcgaaccccaccgaaggccgcggtgggagtccagt

SEQ ID NO: 31032 - protein, 135 aa, Zea mays
  misc_feature: Ceres CLONE 1407104-F
  misc_feature (111)..(111): Xaa is any aa, unknown, or other
  misc_feature (113)..(113): Xaa is any aa, unknown, or other
MPLIDAAASAVAPPPPRRVAQLRFFSTRRPGILSLTATSCSPSPPPPVAAEVPAAPQEAKSKPRPRRYPKQYPGESVGVAEEMRFVAMRLRNPKRTTIKDKVGDGGRDAGXRXVSEGEAEEDDGRRREGGHEEGG

SEQ ID NO: 31033 - DNA, 686 bp, Zea mays
  misc_feature: Ceres CLONE 1407107-F
  misc_feature: Encodes the peptide sequence at SEQ ID NO. 31034
  misc_feature (280)..(280): n is a, c, t, g, unknown, or other
  misc_feature (331)..(331): n is a, c, t, g, unknown, or other
  misc_feature (604)..(604): n is a, c, t, g, unknown, or other
tggagctccccgcggtggcggccgctctagaactagtggatcccccgggctgcaggaattcgcacgagaccattacctagaacatcctaatcgaaaaaaaaataggaaacgagcaaaggtctggcgagctacctaccaataaactaccatctccacaaacaggctagcacgtagctatatgccagaactgacctagtagaggatcgatcgcagatggtgtttcctgccatcctccccaaggtggccgcacgatggctcttcacgttctaccgcgccgccngaaagctcaggcgccacgccttccagctctactaccgcaacaccgccgccnagccgtcgtccgccgtctcgcagcagcaggccggggccgccgccactgtcactgccgccgccgccttcaagaccggcgccgccatcccctgacgccggcggccgggaccgttgtgtgcgacatgcacggcgccctgctgcgctccaccgcgctcttccctactcatgctcggggcctgggggaaggggggaaaagcctcgtccgcgccatgcatgctgctctgcgcctccccccctcatatgggcggctcggaggagcgcccgcggcggcggncatcccgagtggatggcggtccgccaacctttcgcggggctcagggccccagggaacagggaacctccatggacccggcgcc

SEQ ID NO: 31034 - protein, 69 aa, Zea mays
  misc_feature: Ceres CLONE 1407107-F
  misc_feature (23)..(23): Xaa is any aa, unknown, or other
  misc_feature (40)..(40): Xaa is any aa, unknown, or other
MVFPAILPKVAARWLFTFYRAAXKLRRHAFQLYYRNTAAXPSSAVSQQQAGAAATVTAAAAFKTGAAIP

SEQ ID NO: 31035 - DNA, 690 bp, Zea mays
  misc_feature: Ceres CLONE 1407108-F
tggagctccccgcggtggcggccgctctagaactagtggatcccccgggctgcaggaattcgcacgagaccattacctagaacatcctaatcgaaaagttccataaaccctaacctcgttggattcgcggcaaaaatcctcccaattcggaaccctccgatgttccagctacctgcgggagctgagccgtgctcggtttggcgaaatttcgcacccctcttgtgctaggaccacccggttcaagctgttcctcggaagggtcaggtcttcaccggtgttctccggcgccggatccaggtttgttccggcgagagggtcggcctcttggtgggggccagcccagcttcgagctcaatttgccggcctgagatggaatcgcgactgcggtgccggtgcctcaggtagtcgcgtcgagtcgacgcgcgattcctgccattttgggtgggccagcctttcctggaatcttccggggggcgtttcgcctcgctgcgtggcagaaaggtggtgacgtgtgatgcatcccaaggctcgaatccacgccgaccgggggcggcgaggtcgaccacttcgactggctggcggaatcgctcgtcctgctcatctgaaaaaggtcgagggaggggcggtcgcttcgccgggggttaagcgggtccaaaggggtctggggggcttcgttccctcgccaaggga

SEQ ID NO: 31036 - DNA, 741 bp, Zea mays
  misc_feature: Ceres CLONE 1407124-F
  misc_feature: Translation starting site: 240
tccccgcggtggcggccgctctagaactagtggatcccccgggctgcaggaattcgcacgagaccattacctagaacatcctaatcgaaaaagcacctccattcccagccacgagacgacgaaaccctagcctccctccccctctctcaccaggccaccacctcgccggaacccggcgcctcgaaggagcacgggatcatcggccgccgtcggccgcggctgcggaggagcggtgtaagatgttgaacggcggcggcggcggccagaagaagcggaacacgaagatcgagccctatcggcaccgcgtagagaccgacccccagttcttcgacaagtcgtgggcggaagctccatgacgccatccgcgagatctacaacccacacggcagcggtctctccttcgaggagctctacaggactgcttattacaatgggatggaaacagtttgctcctcagctctatgaaaaactcccagaaaacttgaaggagcttcttgaagagatggcccaatggaatgaaggtggtctcagggggtttggtccctgaaaaaatttgccccaaaaagggaaggcccatacaagggtttggcaagggttaaagaattcccggggggtatggaacggaaaaatttccccccaaaaaaaacacccggcttctcaatgggaaaaagtttgggggaaacaaaatccgcgccccaagtaaggggggggggtgggcccctctccgcgtaaaaaaaaaag

SEQ ID NO: 31037 - DNA, 636 bp, Zea mays
  misc_feature: Ceres CLONE 1407126-R
  misc_feature (615)..(615): n is a, c, t, g, unknown, or other
cgaattgggtaccgggccccccctcgaggtcgacggtatcgataagcttttttttttttttttttgttaaaatttgtagtgtaaaatttagagcccgttaccacctctaattgcaggttctcatatagttcaataataggcatgaatgagaatggatgacatgtccatgacacaaagctgcaggctctactctactatatgtattgtatctgaaacgcaagatgatcgaaagaagtgtccatatactgacatgaccaatataatcagcgcccctgggctctctgttccacctagggagaggaggggagctgtatctccggcgcatccgaggagtgagatgattcatcatcggatgttgatggtgccatcttctcgtccacatccccccttgtccactcccagacatcgcttagccaagagtaaacagactcggtcacctggcgcttcttttctccctcgtcaggctgtcccggcgaaacattatcttctggtgaaaggtcgtcgtcgtctcccgggagcgtaggtggtggtgacgacagctcccaggcatcgacgatggggcgggaggattggaacatgatgacttgatcacggtctataagacattccttgcangtaatgacctgcttcttgagc

SEQ ID NO: 31038 - DNA, 663 bp, Zea mays
  misc_feature: Ceres CLONE 1407126-F
  misc_feature: Encodes the peptide sequence at SEQ ID NO. 31039
  misc_feature (510)..(510): n is a, c, t, g, unknown, or other
  misc_feature (511)..(511): n is a, c, t, g, unknown, or other
gctggagctccccgcggtggcggccgctctagaactagtggatcccccgggctgcaggaattcgcacgagaccattacctagaacatcctaatcaaaaaaaatcaaaccaatacaaccgactcgccccctcctacccaaacaagtgcagtgcagcgcctcgccataccggccatgtcggcgattgaattggtgcaggggtcgcgtgccggccaggaagcggagcaggaaccagagtcggagccgcagcgcaagtgggtggccctcgtctccgttgccgtcctcgacaaagaggacgatcggacccaggagatcgtcctctgctactccaccgccgaacgtcggtggtttgtcaggcacctcacccgggaaacggaccacatgtgcagccccttctcgcagaacggcgtgctcgcccacgaaggtcgcctctggtggatcgccctcgcctatggcatattcttctgcgaccccttcacgcctgacctccggttccccgagctgtgcttccnntccgcttcgggcgactgccagatggacggctacgtcgtcttcgagccacacatcaggaccctcatcaaccaacgacgctgcgtcagggccagcgagggcaagctgcggttcgtcgagatccgcggcctcgcctacgacgatgtgctcatcga

SEQ ID NO: 31039 - protein, 163 aa, Zea mays
  misc_feature: Ceres CLONE 1407126-F
  misc_feature (113)..(113): Xaa is any aa, unknown, or other
MSAIELVQGSRAGQEAEQEPESEPQRKWVALVSVAVLDKEDDRTQEIVLCYSTAERRWFVRHLTRETDHMCSPFSQNGVLAHEGRLWWIALAYGIFFCDPFTPDLRFPELCFXSASGDCQMDGYVVFEPHIRTLINQRRCVRASEGKLRFVEIRGLAYDDVLI

SEQ ID NO: 31040 - DNA, 636 bp, Zea mays
  misc_feature: Ceres CLONE 1407132-F
  misc_feature: Encodes the peptide sequence at SEQ ID NO. 31041
  misc_feature (367)..(367): n is a, c, t, g, unknown, or other
  misc_feature (378)..(378): n is a, c, t, g, unknown, or other
tccccgcggtggcggccgctctagaactagtggatcccccgggctgcaggaattcgcacgagaccattacctagaacatcctaatcgaaaaaattcgaagccttcccggttaccccttcggcctccacctatcaccacccgggacgtcttccatggcctcctcgtagtagaatagctctatctcaccgcaacaactcctcattacatcctttatgagaggctgatcgattggtagatacgtactcgggtggagcagaacaacgagagacatggcgacgacgacgcgtgttgccgccaccgccgccggcgtgctgctggtcctggtcgcgttggcgaccctggcgcgggccgaggacccgtacctggntctcgagtggnaggtgacgtacgggaccagtccctgctggcgtggcccaaaaggtcatctcatcaacggggaggtcccgggcccaggatcactgctcctcacaaaaacatcgtcggtaatggcttcaccagctcgacaatcggtcttttcacctggaagggatgaccaaggaaaaactccggatgggcgggatgccggaaccaagtggccatcctgctaaacccatttccggaaaagggcagccaagggccaaaaggggttttttctat

SEQ ID NO: 31041 - protein, 105 aa, Zea mays
  misc_feature: Ceres CLONE 1407132-F
  misc_feature (33)..(33): Xaa is any aa, unknown, or other
  misc_feature (37)..(37): Xaa is any aa, unknown, or other
MATTTRVAATAAGVLLVLVALATLARAEDPYLXLEWXVTYGTSPCWRGPKGHLINGEVPGPGSLLLTKTSSVMASPARQSVFSPGRDDQGKTPDGRDAGTKWPSC

SEQ ID NO: 31042 - DNA, 737 bp, Zea mays
  misc_feature: Ceres CLONE 1407133-F
  misc_feature: Encodes the peptide sequence at SEQ ID NO. 31043
  misc_feature (551)..(551): n is a, c, t, g, unknown, or other
  misc_feature (637)..(637): n is a, c, t, g, unknown, or other
tccccgcggtggcggccgctctagaactagtggatcccccgggctgcaggaattcgcacgagaccattacctagaacatcctaatcgaaaaaaaaaaaaaaaaaagcttctcgtgccggcttctcgtgccgttttttttttttttttttggaaaatccataggtgaatattgatacaggattcaatggttcacacaaagatcataggaacatacagtgaaaattatcagtgctaccgttcaggaaagcaaatgctaaatctgtttcttggatccgagaaggccggcacatgttcagatgatgatgaaaggtcattcatgaatagaacggaagtatataatgatattcaacttccacactgctttgtccagatcattaaattcagcgcctaccagcccgtcttttactctgcctcctcgccctccgccgcctcaaccgcgacacgggactcttcaagcgccgccgcgacgagcccgctcccgccgtccctgcctccgatctgactcctacacgcgccgaaacagccccattcgcaggaatcacccgtccggnattcactccctcctcaccgcccgacgtagcggctccccgggatgctgctgagtcagagcttgaaggcctgtcagagctggtcgacnaactatgttcagatgacaccaccagtcagctcgaagccacaatccagttcaggaacttctttcagatgagaagaactcaactgtgataaaatcatccgaa

SEQ ID NO: 31043 - protein, 37 aa, Zea mays
  misc_feature: Ceres CLONE 1407133-F
MLLSQSLKACQSWSTNYVQMTPPVSSKPQSSSGTSFR

SEQ ID NO: 31044 - DNA, 689 bp, Zea mays
  misc_feature: Ceres CLONE 1407136-F
  misc_feature (269)..(269): n is a, c, t, g, unknown, or other
  misc_feature (333)..(333): n is a, c, t, g, unknown, or other
tccccgcggtggcggccgctctagaactagtggatcccccgggctgcaggaattcgcacgagaccattacctagaacatccgaatcgaaaaatcgcagaaattctccgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgncggggaagaaggccaaggcggagaagcggctacctgcgggcaagtccgccggcaaggagggggncgacaagaagggggaggaagaaggcgaagaagagcgtggagacctacaagatctacatcttcaagggtctccgttctcccccaattcgccttcacctcgccgcttcctcttgaccgcaccgggttgggacgtcgccttcccgggggaggaacttcgcccggaagacctcacctggaacttttccgacgcaccctccacacactctttaaccctcccggaatgggcgcctgcttctagactcgtcgacgccccaatctccggttgctttctcgacagccccatccggctcttctcgctctcgctacggttcctctgcctgttccgccatgcggatccggatcaccggctccaactcg

SEQ ID NO: 31045 - DNA, 834 bp, Zea mays
  misc_feature: Ceres CLONE 1407137-F
  misc_feature: Encodes the peptide sequence at SEQ ID NO. 31046
  misc_feature (1)..(1): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
naaaaaaaaatccaactacaaccccctccccttccccnnncccnnnnnnntnnnnntccccgcggtggcggccgctctataactagtggatcccccgggctgcaggagttcgcacgagaccattacctagaacatcctaatcaaaaaagaaaagtgagccccaaaccctacaccctcatggaagcgtggccacctctcgcccccgcggcgggcactccggcctgtgccttggggtggggagcaacaccaacggcgcaacggaagggcctggagaaagagtcaccggcggcaggggtgagccgcatcgtggcgagctgccccaactccagcggcgtggccagtcgccgtggtggacgccaacgccgtcatctccggggggtccgctctctccacttccgcggggcgccttgtcaccgtgcccgaggtgctcgagggaggccgggaacgcaaacggggggggggggccccccgggttccctcccccttcccgttgaaaaccgtttgaacccgggccccgaaatttgggttaggaaaagttaccacagtttttgccaagggaaaaaagggaaaaaattccaaaccgcctttccaaatgggtgaaaaaaaaaaaaaatattgggtttttgcgctaaacaggcttaaaaagctgggagatccacgggcgacctaaggcattttgggagaggacccccctccccctctcctccatggaggggaatgtgctaaaaaagcttgccaaaaaccccaaagggcccgggctgcgcgatctccaacggggcacaaacccccaagaagcgggggaaaagacgtggtcccgagggctccgagaggggg

SEQ ID NO: 31046 - protein, 140 aa, Zea mays
  misc_feature: Ceres CLONE 1407137-F
MEAWPPLAPAAGTPACALGWGATPTAQRKGLEKESPAAGVSRIVASCPNSSGVASRRGGRQRRHLRGVRSLHFRGAPCHRARGARGRPGTQTGGGGPPGSLPLPVENRLNPGPEIWVRKSYHSFCQGKKGKKFQTAFPNG

SEQ ID NO: 31047 - DNA, 650 bp, Zea mays
  misc_feature: Ceres CLONE 1407140-F
  misc_feature: Encodes the peptide sequence at SEQ ID NO. 31048
  misc_feature (494)..(494): n is a, c, t, g, unknown, or other
  misc_feature (513)..(513): n is a, c, t, g, unknown, or other
  misc_feature (581)..(581): n is a, c, t, g, unknown, or other
  misc_feature (650)..(650): n is a, c, t, g, unknown, or other
tggagctccccgcggtggcggccgctctagaactagtggatcccccgggctgcaggaattcgcacgagaccattacttagaacatcctaatcgaaaacaaagcctttcttcctcctgtgaagccaactcgtcccctcgggccaacgcgaggccaaaaccaatctcacatctcctccccctcccaccaccgaggacccttccccaagaactgctccgagtcctggagcgggagagaggtcgagggaggagcccaataagagtttctcctcgcctctctctctctctttctgctcgaaaaattattgtcgcattggtttggttcccttgccaaaggaggctgcttttctgtcctccctgatctaacatgatggcgagcaccgcatcagcgaccgccgccgccgccgccgtggcattcggggcagccgccaagccgcggggaccggcggctgtggcgctccgcgcaagggtgcctgccggcggcaggcgcgctccgnccgtggttggtgcgctgcnacgcccggcgtggaggtccaggcgcaggccggtggccaagggcgccagcatcgccgcgctcgagcagntcaagatctccgcagaccggtacatgaaggaaaggagtagcgtagctgtgataggtctcagtgtacacn

SEQ ID NO: 31048 - protein, 94 aa, Zea mays
  misc_feature: Ceres CLONE 1407140-F
  misc_feature: SWISSPROT Homolog: EC 1.2.1.70 Glutamyl-tRNA reductase
  misc_feature (43)..(43): Xaa is any aa, unknown, or other
  misc_feature (49)..(49): Xaa is any aa, unknown, or other
  misc_feature (72)..(72): Xaa is any aa, unknown, or other
MASTASATAAAAAVAFGAAAKPRGPAAVALRARVPAGGRRAPXVVGALXRPAWRSRRRPVAKGASIAALEQXKISADRYMKERSSVAVIGLSVH

SEQ ID NO: 31049 - DNA, 695 bp, Zea mays
  misc_feature: Ceres CLONE 1407141-F
  misc_feature: Encodes the peptide sequence at SEQ ID NO. 31050
  misc_feature (429)..(429): n is a, c, t, g, unknown, or other
  misc_feature (441)..(441): n is a, c, t, g, unknown, or other
  misc_feature (449)..(449): n is a, c, t, g, unknown, or other
  misc_feature (457)..(457): n is a, c, t, g, unknown, or other
tccccgcggtggcggccgctctagaactagtggatcccccgggctgcaggaattcgcacgagaccattacctagaacatcctaatcaaaaagaggcaaagccgttagccaatctgctgttgcgtgttgcaccgatcaacgtcggttcccagcgcttgctcgtcaagcgtgtcctgctgctgttctctgctcctgcttgccgcgagagctcctctcgctcatctacccaaggtccgacagcaacgacttcgtcgagctgctatgggagaacggccagcgggtggtgcaccggaaggaggaagcagcatccccaggccgccttcccgcccttcacctgcggcgcggccagcagcagtagagctcagaaaaccagccgggactaccgacccgggtctccgctgtccaaggacgggaggcctcttcgccgacnttctcgtccggnctagacgnccgcccgntggcaaacgtgggaccttgacgacaccgtggccctggatccactgcccccatcggccgaggaaagacagcgccgcacccgcacttgcccttcgggggagggctccagcccagattttcttctcggagctcaatgcagcggcgttaagcagcggcggcgggcagagacgaacctcagccctctggccaccaccggtccagcacacagagagacacccccgtttgccacaaccagcagag

SEQ ID NO: 31050 - protein, 145 aa, Zea mays
  misc_feature: Ceres CLONE 1407141-F
  misc_feature (57)..(57): Xaa is any aa, unknown, or other
  misc_feature (61)..(61): Xaa is any aa, unknown, or other
  misc_feature (66)..(66): Xaa is any aa, unknown, or other
MGERPAGGAPEGGSSIPRPPSRPSPAARPAAVELRKPAGTTDPGLRCPRTGGLFADXLVRXRRPPXGKRGTLTTPWPWIHCPHRPRKDSAAPALALRGRAPAQIFFSELNAAALSSGGGQRRTSALWPPPVQHTERHPRLPQPAE

SEQ ID NO: 31051 - DNA, 707 bp, Zea mays
  misc_feature: Ceres CLONE 1407142-F
  misc_feature: Encodes the peptide sequence at SEQ ID NO. 31052
  misc_feature (213)..(213): n is a, c, t, g, unknown, or other
  misc_feature (405)..(405): n is a, c, t, g, unknown, or other
  misc_feature (418)..(418): n is a, c, t, g, unknown, or other
  misc_feature (448)..(448): n is a, c, t, g, unknown, or other
tccccgcggtggcggccgctctagaactagtggatcccccgggctgcaggaattcgcacgagaccattacctagaacatcctaatcgaaaagagtccacactccccactccattatctaccatcacactgacacgttcatagctagctagtcttcagctagtaacttacgacgggataatctcgatctgggagcgagggggaggacgacgacnatgaagatgagctccgtgcccgcggtagcggcggtgatggtggtggtggtggtgctgctatctgcagcggcgacgactgtgacggggcaggcgcttgtgccgggcgtgatgatcttcggcgactcggtggttgacgccggcaacaacaaccggctagcgacgctggtgcgcgccgacttcccgccctacggncgcgacttccggncgacgcacgcgcccacggggcgcttctggncacggcagctcgccacggactacaccgtggagagcctgggggctgagctcgtacccgccggcgtacctttaccgaggaggggcaaagcaacaacaagagccctctccagggggccaacttcgggtcggggggcggcggttacctcgaggccaccgcggcctttaaggggccatggccttgacccggaagggggggaattccggaaggacaatccgggggggggggggttgcccgacccaaggggccgggggagtgagcg

SEQ ID NO: 31052 - protein, 164 aa, Zea mays
  misc_feature: Ceres CLONE 1407142-F
  misc_feature (69)..(69): Xaa is any aa, unknown, or other
  misc_feature (79)..(79): Xaa is any aa, unknown, or other
MKMSSVPAVAAVMVVVVVLLSAAATTVTGQALVPGVMIFGDSVVDAGNNNRLATLVRADFPPYGRDFRXTHAPTGRFWXRQLATDYTVESLGAELVPAGVPLPRRGKATTRALSRGPTSGRGAAVTSRPPRPLRGHGLDPEGGEFRKDNPGGGGLPDPRGRGSE

SEQ ID NO: 31053 - DNA, 657 bp, Zea mays
  misc_feature: Ceres CLONE 1407146-F
  misc_feature: Translation starting site: 287
  misc_feature (393)..(393): n is a, c, t, g, unknown, or other
aaagctggagctccccgcggtggcggccgctctagaactagtggatcccccgggctgcaggaattcgcacgagaccattacctagaacatcctaatcgaaaaccccgaaacgaaagcttacttttttatactaacttctagggtttcaggactaacctccctcccttcgcgccatctcccgcggtgctgcctcctctggcgccgattcgccgctgggagccccaattctataacccctctgttcgatctgggatccgctagattcgttggggcggtgatgagggcgatggcggaggtgatgcaggaggggtgcgtggagaatcggcagccactggcggcttcgagctcgtccgtgtcggatggcagcagctgtggcggcggagagcgggcggngacgtcgccgccggtgtcaagctcccgggattgcatctccgttctgagacgaacaagtggaccgataagaagaaataaagggtggctggacactgaaagaggatgaaacactgcgggaagcagttgaagctttcaagggtaaaaaattgaaaaaaaatagctgaattttttccggacagaactggaggtccaaggtttggaatcgtgggaaaaagggttcttaatccggaacctaaatcaagggccttggggacccaaggagag

SEQ ID NO: 31054 - DNA, 607 bp, Zea mays
  misc_feature: Ceres CLONE 1407149-F
  misc_feature: Encodes the peptide sequence at SEQ ID NO. 31055
  misc_feature (260)..(260): n is a, c, t, g, unknown, or other
  misc_feature (326)..(326): n is a, c, t, g, unknown, or other
  misc_feature (332)..(332): n is a, c, t, g, unknown, or other
tccccgcggtggcggccgctctacaactagtggatcccccgggctgcaggaattcgcacgagaccattacctagaacatcctaatcgaaaaacgctcgtggcaccgcactcactccgaatcctgaagcaacaaacaccagaagcgcaccaactccccaaccaccggagaccgcaccccagcaaaggatggcatctgactccacggccgccgtgacggtggacggcagcgcgcttgcggggcgcgcgctggccgcggcggncacgcggcacatgttcggggtggtgggcatccccgtcacctccctcgcgtcccgtggcgccgcggncggggnccgcttccctcgctttcccggaaaaaagaacccgggggggtaaaccccgcccccccctaaagggttttctccccgggggtccccccggggggggcaaaaaaaaacaattttttatcggggacaaaaagaaaggaggtcccccccacccggcgcgggtgggggggggtgtttttttttttgccccccccattacccccacccccgcgggcggggcgggtaattcgaatcgccccgcctattttgccccgcaggtaaagatcgagcaccggtagcca

SEQ ID NO: 31055 - protein, 62 aa, Zea mays
  misc_feature: Ceres CLONE 1407149-F
  misc_feature (25)..(25): Xaa is any aa, unknown, or other
  misc_feature (47)..(47): Xaa is any aa, unknown, or other
  misc_feature (49)..(49): Xaa is any aa, unknown, or other
MASDSTAAVTVDGSALAGRALAAAXTRHMFGVVGIPVTSLASRGAAXGXRFPRFPGKKNPGG

SEQ ID NO: 31056 - DNA, 734 bp, Zea mays
  misc_feature: Ceres CLONE 1407150-F
  misc_feature: Encodes the peptide sequence at SEQ ID NO. 31057
  misc_feature (490)..(490): n is a, c, t, g, unknown, or other
  misc_feature (678)..(678): n is a, c, t, g, unknown, or other
  misc_feature (702)..(702): n is a, c, t, g, unknown, or other
tccccgcggtggcggccgctctagaactagtggatcccccgggctgcaggaattcgcacgagaccattacctagaacatcctaatcgaaaagtctcgcctctcccttggttcctcgcggcgacgactgggcgagcgcctcctcccctccctcactccctccgtgagctcctcgccggcggcgcgcgccgccgcccgtcgccacgtcttctccgctgacgtgggctcaccagatccaatgaaggctgccaacttgacgcaaggtgttcaagaaatttaaaccatgcactcttcatcgtaggttcaaggcaatatctgtgttaatcttggggaccttcagtagattgctgagagttctccttgatacaggggaataaagatccaaataagtttttgacattgatctgtagccagtactgcaatggctatgaagcttgtggttctcggtatcccctgggatgttgacactgaagggttacgagagtacatggncaagtttggacccctagacgattgtgtcgtcatgaaggagcggtcttctgggcgatctcggcgggtttggctatgtaacattcgcctcagctgacgatgcaaagaaatgtctttgatgcgagcatggtccttgggagccgtacatttagaagtgaaggtagctactccaaaggaagaaatggaatcancaggatcaaagaaagctacaaggnatattcgttgctcgaattccgcaatcggtgga

SEQ ID NO: 31057 - protein, 54 aa, Zea mays
  misc_feature: Ceres CLONE 1407150-F
  misc_feature (24)..(24): Xaa is any aa, unknown, or other
MAMKLVVLGIPWDVDTEGLREYMXKFGPLDDCVVMKERSSGRSRRVWLCNIRLS

SEQ ID NO: 31058 - DNA, 604 bp, Zea mays
  misc_feature: Ceres CLONE 1407152-F
  misc_feature (247)..(247): n is a, c, t, g, unknown, or other
  misc_feature (329)..(329): n is a, c, t, g, unknown, or other
  misc_feature (391)..(391): n is a, c, t, g, unknown, or other
aaagctggagctccccgcggtggcggccgctctagaactagtggatcccccgggctgcaggaattcgcacgagaccattacctagaacatcctaatcaaaaatcgctctctcctttgcacccctagctagctagtactactctgctcctccgacttgctcttcgcgcagcaggacggagaaacaagaaccatccctccccctaccggctaccgctgctactcatggtcgcgcgcactgcctcctggntgcgccgcgtatgatccagacatgaaataggcgcacagcagcagctccaagctcatcaacgagaagctcgtggaaacacggnatctccactgcgaaggactgcccccactggcggcaagaaaatcgacagaaaaccgaatgggngggggttgcccgaaagggttcaagtttcatcccactggcccgaaaattgattaaggccccccgggggaaagggaaggggagaaggttccaaaatttcccccctttcccgggggagtttatcccccccaaaaatgggggggaggggggatttgttacccccccccccaaaaatttccccggggggacaagggggggccaaaaaaaaaacttttt

SEQ ID NO: 31059 - DNA, 669 bp, Zea mays
  misc_feature: Ceres CLONE 1407153-F
  misc_feature: Encodes the peptide sequence at SEQ ID NO. 31060
  misc_feature (389)..(389): n is a, c, t, g, unknown, or other
  misc_feature (452)..(452): n is a, c, t, g, unknown, or other
aaagctggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctaccttcggtcggtcgatagatcgatcgatcgctcggccatcatggcgcgggaggagcaggcgctgctgccgacggagatagtgaaccgcgccgggtagccgtcgtccccggaggcggtttcgccggccttctcgatgcgcgtgcgccgccgcctgccggacttcctgcagtcggtgaacctcaagtacgtgcgcctcgggtacgactacctcatcagccacgntgtgtagctggccaccatccgcatcatcgtgctggtgtgcgccgccgagctgggcaacctcanccgcgacgagctgtgcccaaggggtggaggagagagcacctacgagctcggcaccgtggtgggcttcctcgacgtcctcgccttcaacatctccgtctaaatcatgtccagggccagggccgggaacctcatccacttctcatggtacaagccggccgaagagttaagggtgtcaaggtggcattccatggactggggcgcaagcccgcaaggtcga

SEQ ID NO: 31060 - protein, 31 aa, Zea mays
  misc_feature: Ceres CLONE 1407153-F
  misc_feature: SWISSPROT Homolog: EC 2.3.1.119 Icosanoyl-CoA synthase
  misc_feature (30)..(30): Xaa is any aa, unknown, or other
MRVRRRLPDFLQSVNLKYVRLGYDYLISHXV

SEQ ID NO: 31061 - DNA, 677 bp, Zea mays
  misc_feature: Ceres CLONE 1407154-F
  misc_feature (400)..(400): n is a, c, t, g, unknown, or other
  misc_feature (424)..(424): n is a, c, t, g, unknown, or other
  misc_feature (548)..(548): n is a, c, t, g, unknown, or other
  misc_feature (580)..(580): n is a, c, t, g, unknown, or other
  misc_feature (588)..(588): n is a, c, t, g, unknown, or other
  misc_feature (589)..(589): n is a, c, t, g, unknown, or other
  misc_feature (625)..(625): n is a, c, t, g, unknown, or other
  misc_feature (658)..(658): n is a, c, t, g, unknown, or other
  misc_feature (659)..(659): n is a, c, t, g, unknown, or other
  misc_feature (664)..(664): n is a, c, t, g, unknown, or other
acccgcggtggcggccgctctagaactagtggatcccccgggctgcaggaattcgcacgagaccattacctagaacatcctaatcgaaaacttggatagtccgtagccgcttgccctgttcgcatcttcgcgcgtggcgcacaccgctccagctctccttcgacgggcacggccgagccgccttcgtcttggccgcagcggtgcgcgctctccatggcgtcctaattagcctagccgcaacgccgcgcccgtgcctgcgaagtagggtgtaaagttttgtatatgatgccaggcatggatgaaccccttcttggcaatggtcttaagaccagcgggaaaagagagagcctggtaagtggccgaggtcagaaaacagatgtaccttgctgggccactcatncgctgcatggatcctacagaacantgtccagagatatcttatcattggtttgtcggtcacctttggtgagcttgccctctccagtgcctccatcgccccctcccttttgcaggcgttactggcttcagccttattggtctggcatggncgagcagcttggacaccactgggttgggcaantcggtcgnngggcaaagcagtacctatccttcttggcatctaacnagcagagggggcaatcccttgtgctcatctagnnaaagnccctggggggttg

SEQ ID NO: 31062 - DNA, 818 bp, Zea mays
  misc_feature: Ceres CLONE 1407157-F
  misc_feature: Encodes the peptide sequence at SEQ ID NO. 31063
tctcaccccctcccccactgcacggtactttctaatcccttccaaactggcactccccgcggaggcggccgctctttaactagtggatcccccgggctgcaggaattcgcacgagaccattacctagaacatcctaatcgaaaaaccagctttccccttctctacggtccgggaatcggaagctcacggcagaagccatggggcagacgcatcttttgttgctcgcttgtttctgggtcctgtcaacatgctccttgctacttgatgcttcctccgatggactgctaagaatcaacctgaacaagaagagactggacaaggaagctttgactgctgcgaaattggcgaagaaggagagcaaccttcgaaggtctgtgggtgctgaccagtatctcagggcctcaactgatgacatagaccctttggacaactacctggacacccagtattttggacccatccgcatcggcacgccaccacagaacttcacagtgatattcgacactggaagctccaactggggcgggccctcacccaagggctacttttcgatagcatggctacttagtgcatagaatacagggtcacccacgccccaaggactcacccgaaagaacggggacgaccctgggacgataacgtaagggcttcggggaaaatcagttgggcttctttcacggaggacaaggggggttgggtgggcgaaccttcggctggggccattcccgaaatttttagtgggaaccgcctccgggaaagccggacctcactttttattcgtttggggaagcctcggagggtaaccccccgtggcctct

SEQ ID NO: 31063 - protein, 125 aa, Zea mays
  misc_feature: Ceres CLONE 1407157-F
  misc_feature: SWISSPROT Homolog: EC 3.4.23.40 Phytepsin
MGQTHLLLLACFWVLSTCSLLLDASSDGLLRINLNKKRLDKEALTAAKLAKKESNLRRSVGADQYLRASTDDIDPLDNYLDTQYFGPIRIGTPPQNFTVIFDTGSSNWGGPSPKGYFSIAWLLSA

SEQ ID NO: 31064 - DNA, 704 bp, Zea mays
  misc_feature: Ceres CLONE 1407160-F
  misc_feature: Encodes the peptide sequence at SEQ ID NO. 31065
  misc_feature (503)..(503): n is a, c, t, g, unknown, or other
aaagctggagctccccgcggtggcggccgctctagaactagtggatcccccgggctgcaggaattcgcacgagaccattacctagaacatcctaatcgaaaaagatccattgttcacgacctcaccctattcagatcccaagcggccacgcccaagcccaaaccctacccacccatctcaaccagcgatgatggcagcggagccctcgccgtcggttccctccaccgccgctgaagacatggaaaccctcgccctcgactcatcctcttcgtccgccgccgctacggcctccgcctccgaccccctccttcggccacctacctccccgaccgccgccgcgagcgacgaccccttcgtcatcgacgacttcctcgacgaggacgacttcaccgccccggcgcccagcgtcgccggcccgccgcccgccgggcttggcgatgcggcgtccccagtgttccccaagatcaccgtatccgatcccaagaagcacgccgagcctagcnggcgggggtgctgccggtgtgatcccgggatccggcagctacttttcttacctcatcaccacccgttttgcgggcggcggtggggaagtcagcgtgcggcggcgcttccgcgacgtggtgggcctcggggacggtctttgcgtagctcaccgcggcttatttggtccggtccgggccgacaacagcgccctccgaggtgaa

SEQ ID NO: 31065 - protein, 89 aa, Zea mays
  misc_feature: Ceres CLONE 1407160-F
MRRPQCSPRSPYPIPRSTPSLAGGGAAGVIPGSGSYFSYLITTRFAGGGGEVSVRRRFRDVVGLGDGLCVAHRGLFGPVRADNSALRGE

SEQ ID NO: 31066 - DNA, 743 bp, Zea mays
  misc_feature: Ceres CLONE 1407161-F
  misc_feature (564)..(564): n is a, c, t, g, unknown, or other
  misc_feature (581)..(581): n is a, c, t, g, unknown, or other
tccccgcggtggcggccgctctagaactagtggatcccccgggctgcaggaattcgcacgagaccattacctagaacatcctaatcgaaaaattcgtgtcctggcatccgcagagagtttgttccgtccaggcaaccaaaaagcgttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcgctgcgcgagatccgcaagtaccagaagagccgagctgctgatccgcaagctgcccttccagcgcctggtgcgcgagatcgcgcaggacttcaagacagacctccggttccagatccacgccgtgctgggcctccagggaggccgccgaggcctacctcgtcggcctcttcgaggacaccaacctctgcgccatccacgccaagcgcgtcaccatcatgcccaaggacatccagctcngccgccgcatccgtggngagcgcgcgtagccatcatctccgaggatctgatggatgtctagttaccaaacaataggccgtatttagcgtcgttgttctgtattcgttatttttggattcgggtgcaagggaaaacagctttactgatccaaaaaaaaaaaaaaaaggttatcgatacgc

SEQ ID NO: 31067 - DNA, 669 bp, Zea mays
  misc_feature: Ceres CLONE 1407166-F
  misc_feature (314)..(314): n is a, c, t, g, unknown, or other
  misc_feature (337)..(337): n is a, c, t, g, unknown, or other
  misc_feature (338)..(338): n is a, c, t, g, unknown, or other
  misc_feature (341)..(341): n is a, c, t, g, unknown, or other
  misc_feature (343)..(343): n is a, c, t, g, unknown, or other
  misc_feature (349)..(349): n is a, c, t, g, unknown, or other
aaagctggagctccccgcggtggcggccgctctagaactagtggatcccccgggctgcaggaattcgcacgagaccattacctagaacatcctaatcgaaaacccaaaatactccaccaccgcacccactagggtttccgcaccgcattgcagaacctcgccgcctccaccctcaccacaccaccggcgatgtccacagcggcggcgcagggcggcagcgacaagccggcgctccggaggcccgtcttcaccaaggtcgaccagctcaggccgggcaccaacgggcacaccctcaccggtcaaggtcgtcagcngccacccccgttgcccctggggnngcngngggggnccccaggggggaaaacccgggcgggggggggcccaaattccccggggggggggggggggaaaatttcgcgggggggggggcctcctcccccggggggggaaaaaaaaaaaaaaacggggggggccccactttttttttttttttttcccccccgcccgccaaaaaaaaaaaaaaaaaaaattttttttttttttgttggtgggtaaacaaccccccccccggggggggggaaaaagggtttttttttttttttttttggtgggggggggggggggggaaaaaaaaaaaaaaaaaaaatgttgtggtggggtgtggggggg

SEQ ID NO: 31068 - DNA, 694 bp, Zea mays
  misc_feature: Ceres CLONE 1407167-F
  misc_feature: Encodes the peptide sequence at SEQ ID NO. 31069
  misc_feature (350)..(350): n is a, c, t, g, unknown, or other
  misc_feature (474)..(474): n is a, c, t, g, unknown, or other
  misc_feature (530)..(530): n is a, c, t, g, unknown, or other
  misc_feature (533)..(533): n is a, c, t, g, unknown, or other
  misc_feature (538)..(538): n is a, c, t, g, unknown, or other
  misc_feature (544)..(544): n is a, c, t, g, unknown, or other
  misc_feature (629)..(629): n is a, c, t, g, unknown, or other
  misc_feature (630)..(630): n is a, c, t, g, unknown, or other
tccccgcggtggcggccgctctagaactagtggatcccccgggctgcaggaattcgcacgagaccattacctagaacatcctaatcgaaaatttttctgctgcccagccgccgtccgtccgcgcttcactatccttcattccctcccctgtcagcgacgactgggtaggctaccgccgccgccctacgctaggtgcccatctcttcgccggcgaagagcgcccaccaagctccggccaagggcgtgatggcggctgtaggcagcttgaagccggggatggagactcttcatgtgcaggactacaaggacgcgcctccggccaaggccgcggtagagagcctccagccggncgatggagagtctgcatgtgcaggattacaaggacgcgcctccggcccaagggcgtggccgccgccgccgccggtagggagcttgcagccggggggggcggagaatcctggcaggtgcaggacntacaaggacgctaaattgggaatttatgggtgcttacccggcttatgccatggagnctnatggnggggcntggggggggaagtacccatacctggagccatgatggagcacagacaccaactgctggtacctatgctgacatgtactatggtagnnccccccaatggtgttgcaccatggggcatgatggtccaatattatgggtccagaataccagtac

SEQ ID NO: 31069 - protein, 149 aa, Zea mays
  misc_feature: Ceres CLONE 1407167-F
  misc_feature (35)..(35): Xaa is any aa, unknown, or other
  misc_feature (95)..(95): Xaa is any aa, unknown, or other
  misc_feature (96)..(96): Xaa is any aa, unknown, or other
  misc_feature (98)..(98): Xaa is any aa, unknown, or other
  misc_feature (100)..(100): Xaa is any aa, unknown, or other
  misc_feature (128)..(128): Xaa is any aa, unknown, or other
MAAVGSLKPGMETLHVQDYKDAPPAKAAVESLQPXDGESACAGLQGRASGPRAWPPPPPVGSLQPGGAENPGRCRTYKDAKLGIYGCLPGLCHGXXWXGXGGEVPIPGAMMEHRHQLLVPMLTCTMVXPPNGVAPWGMMVQYYGSRIPV

SEQ ID NO: 31070 - DNA, 701 bp, Zea mays
  misc_feature: Ceres CLONE 1407170-F
  misc_feature: Encodes the peptide sequence at SEQ ID NO. 31071
  misc_feature (349)..(349): n is a, c, t, g, unknown, or other
  misc_feature (350)..(350): n is a, c, t, g, unknown, or other
tggcggccgctctagaactagtggatcccccgggctgcaggaattcgcacgagaccattacctagaacatcctaatcaaaaattttccaaatccgtctacgccctcacgcacgcggcccaactagcctaacaaaccctagctagatttagaaaaaaagtttgtccccaatccgaaccgacgaggagctcgccgccgtgagatgtccgagtacgacgagcgctaccagggcaacgccgacatgcccgcagccgaaggcggctatccgcaggccgagtacgccgccgccgccgcgcctggcccgccgggggttcgccgcccgcagacagcaagcccctccgggttctccgnnaccacgccgacggccgctcctcccagcaccagcatgagacacatcacattggacagtggttcctcgaaatctcgagaaagggaccgagaacgcgataagggcaaggattagggagcgtggacagggaatcgtgggccgagaaaaaagggggagggacgagaaaggggaaataaggatcgggggaaagaagtgaccgaagaccggagtatcgcggatcgccccccacagggtaccatcggagagcgcagcgagaaaggggaaaaccccgtggtgccgtttttggaaggaatcgggacgcccccccccgggggggggggccggggccgccccccccctgggtatgtatcggtg

SEQ ID NO: 31071 - protein, 86 aa, Zea mays
  misc_feature: Ceres CLONE 1407170-F
  misc_feature (50)..(50): Xaa is any aa, unknown, or other
MSEYDERYQGNADMPAAEGGYPQAEYAAAAAPGPPGVRRPQTASPSGFSXTTPTAAPPSTSMRHITLDSGSSKSRERDRERDKGKD

SEQ ID NO: 31072 - DNA, 725 bp, Zea mays
  misc_feature: Ceres CLONE 1407173-F
  misc_feature: Translation starting site: 261
  misc_feature (350)..(350): n is a, c, t, g, unknown, or other
  misc_feature (511)..(511): n is a, c, t, g, unknown, or other
  misc_feature (521)..(521): n is a, c, t, g, unknown, or other
aaagctggagctccccgcggtggcggccgctctagaactagtggatcccccgggctgcaggaattcgcacgagaccattacctagaacatcctaatcgaaaacctttcgggcagaaagagccagagagagagagagagagaggtcggggctggggagcacacacccatcacccatggcctgactgacctccggactctccctgcttccgtcgccgccgcgggccgcccagctgactgctcctgccctccgcccgccctccatggcgtccgtcaagctcggctccaagcctgacgccttcaagcggcaaggccaggcatggttctgcacaacaggacttcctagcgatgcnaccgttgaggttggggatatgtctttccaccttcacaagttccctttactttcaaaaagtggcctttcttgaacggtcaattgaagaaaattctgaccaagaagaatgcatcatcaaactaaatgacatttcctgggggtgccaagtcatttgagctaagntgcaaggttnctgctatggtgtgaaaatagagctttcacctgcaaatgttgtctaccctacggtgtgcctcagagcatctagaaatgactgaagaagtagctgaggaaaacctgattgcacagtcagaaatgtcctccaaccaagtggttctccgtaactggaaagattccttggcagcattggaaacatgtgatgacctactcccccatgctg

SEQ ID NO: 31073 - DNA, 827 bp, Zea mays
  misc_feature: Ceres CLONE 1407175-F
  misc_feature: Encodes the peptide sequence at SEQ ID NO. 31074
  misc_feature (827)..(827): n is a, c, t, g, unknown, or other
gtctccccccccccccccgaaggaaatgaccacgaaaggggggaaccctaaaacctggactccacgcgggggcggacgctctattaataatggatcccacgggactgcaggatttcgcacgagaccattacctagaacatcctaatcgaaaaacgtcgacggccacttttcccacagccgcgacaaactcttcctcagacccacgccacgaacgatgcctctctccccttcccctccgcccaacgccgccgccgccgccgccctacccctcctcctgctgctcgtctgcgccagcaacattgccgcgcagccgctggcgtcgtcgcaggccaaggcgctcctccgggtgcgccgcctgctgttctacccgccggtgctcgagccgctgcgcgaggcgacggacccctgttatttgccgcccgcgccggccctcgaagtcgcctgcgagggcgggcagggtcccggcgctctccagaccaggggagaccgggaacccggacccgggactgggagcgcccgcgcctgccggtccagctttcaccctccgaaggaggctggtcccccagggctccaacaagcctacccggagggaatccgccgcgccttcccggcactgcgaggcctccggcagccggggggtccagcttcccgggctgaccaaaacttcggccgggtttccaggcggcgtaaagccagacccagcctgccggagcgaaactaactgtggaagggggcccggacctcgaagggtacaggcaccggctccaacccgcggcagaaccgcttccgggttgcccggaaacaggtttcaagtggcgacagtgaan

SEQ ID NO: 31074 - protein, 168 aa, Zea mays
  misc_feature: Ceres CLONE 1407175-F
MPLSPSPPPNAAAAAALPLLLLLVCASNIAAQPLASSQAKALLRVRRLLFYPPVLEPLREATDPCYLPPAPALEVACEGGQGPGALQTRGDREPGPGTGSARACRSSFHPPKEAGPPGLQQAYPEGIRRAFPALRGLRQPGGPASRADQNFGRVSRRRKARPSLPERN

SEQ ID NO: 31075 - DNA, 671 bp, Zea mays
  misc_feature: Ceres CLONE 1407177-F
  misc_feature: Encodes the peptide sequence at SEQ ID NO. 31076
  misc_feature (303)..(303): n is a, c, t, g, unknown, or other
  misc_feature (430)..(430): n is a, c, t, g, unknown, or other
aaagctggagctccccgcggtggcggccgctctagaactagtggatcccccgggctgcaggaattcgcacgagaccattacctagaacatcctaatcgaaaaaccttgtctacaagggttttccgctgtcttatcccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgcctcgccgctcgcggggcggngccccgtcgtacaacagcgtgccaccgcccccccgatgagatccagctcgcgaagcagcgcgcgcaggagatcggcggcgcggatcttttacgccgcagaggccaagcggtctcgcgtcgaccacgncgacgatgacagcggcggctttcggtgtagggctggcagactggggggcggggggccgatcggcgggggaaggatcgggttctcgcctctggccgggggggggacgggggttccatcccacaatattctctcagagcgcggaactcagactccccttaagggggatatccgggtaacagcaaaaagaattgaatccaaagggaagggttggggggtttctttggaaaagcggggaaattat

SEQ ID NO: 31076 - protein, 160 aa, Zea mays
  misc_feature: Ceres CLONE 1407177-F
  misc_feature (38)..(38): Xaa is any aa, unknown, or other
  misc_feature (80)..(80): Xaa is any aa, unknown, or other
MADDHYSSKRKYDDPSPPPRRTGFSSGPPPASPLAGRXPVVQQRATAPPMRSSSRSSARRRSAARIFYAAEAKRSRVDHXDDDSGGFRCRAGRLGGGGPIGGGRIGFSPLAGGGTGVPSHNILSERGTQTPLKGDIRVTAKRIESKGKGWGVSLEKRGNY

SEQ ID NO: 31077 - DNA, 668 bp, Zea mays
  misc_feature: Ceres CLONE 1407178-F
  misc_feature: Translation starting site: 399
  misc_feature: Pfam Name: IMS Pfam Description: impB/mucB/samB family
  misc_feature: SWISSPROT Homolog: EC 2.7.7.7 DNA-directed DNA polymerase
aaagctggagctccccgcggtggcggccgctctagaactagtggatcccccgggctgcaggaattcgcacgagaccattacctagaacatcctaatcgaaaagccgaggtttcctcgataactcgaaaaaggaatggaaaaggtgtcctcgatgactgaccatggccggcgactggacctactcagtggattgctgtctcatgagtcccgacctaccaagtcggaaagggacagcacctcgtgggcggccgcgaaataactggaacgcgaggtctgagggcgagctcacagtacgcgggctatcgctttcttttacattttctctgttccgcaggctggagcatcaggtatgtcgcgtcgctaggccaggagagcgagcgagccccgtgtgatcgcccatgtcgacatgtactgcttctatgttcaagtcgagcagcggaggaacccggtgctcaggggacaggcgaccgccgtggtgtagtacaacgggtggtaaaggaggcgaattgattgccgtcagctacaaggttcgtgaatttggtgagaaaagtccatgcgggaagatgagggcaagaatattgcctggaattaatcttggtcgggccccagggggggcgggcaagggttgacttaattctttacgaaaggcttggggcttaagttgttcg

SEQ ID NO: 31078 - DNA, 747 bp, Zea mays
  misc_feature: Ceres CLONE 1407179-F
  misc_feature: Encodes the peptide sequence at SEQ ID NO. 31079
  misc_feature (661)..(661): n is a, c, t, g, unknown, or other
  misc_feature (664)..(664): n is a, c, t, g, unknown, or other
ggagctccccgcggtggcggccgctctagaactagtggatcccccgggctgcaggaattcgcacgagaccattacctagaacatcctaatcgaaaaaatcaactcgtttctctccgattgctcctccgagtccgagactccgttctctcccgcatccaccgccgtctcatccccaatccgagcaacgcctcccctcgcctccaaaaccctacccctcctgtcaccggcgggggcatgaaccggtgatcgcttacctggtctcgtctgtctgcgcacgcgcgaggtcagtgagtgagcattgcggtggtccgatcgcccgcggggggccatggcgtctgtggcgggatcgggcggcggggcaagcgcgggggccggtgggttgaagacttacttcaagacccccgaggggcggcacaagctgcagtacgagaagacgcactcccccgccgtcgtgcactacaaccacaacggcaagaccgtcgcccagatgacggtggcatatttgaaggagaagccagcaggccagggttccacgccttcaacaccaagtgctggtagtggggatgcggtctgcagctgcgagactgcttggcactgggaatggtagccggacacttagcttcgggagcatggtacccagcagggctgtctcaggagcagncgnatgggtggaggggaatttggtggtgtcaactagttgcaagtggatcgcaaggcatggccgacttacgatgggaagggctcata

SEQ ID NO: 31079 - protein, 92 aa, Zea mays
  misc_feature: Ceres CLONE 1407179-F
MASVAGSGGGASAGAGGLKTYFKTPEGRHKLQYEKTHSPAVVHYNHNGKTVAQMTVAYLKEKPAGQGSTPSTPSAGSGDAVCSCETAWHWEW

SEQ ID NO: 31080 - DNA, 676 bp, Zea mays
  misc_feature: Ceres CLONE 1407181-F
  misc_feature: Encodes the peptide sequence at SEQ ID NO. 31081
  misc_feature (507)..(507): n is a, c, t, g, unknown, or other
  misc_feature (529)..(529): n is a, c, t, g, unknown, or other
tggagctccccgcggtggcggccgctctagaactagtggatcccccgggctgcaggaattcgcacgagaccattacctagaacatcctaatcgaaaaacaaggaaaaacctagacacgaagtccaacccaaatctcaatatcccaaccctccgatccccatttccatccactccgacaccaatcctccgctccgaccaccgccggagaaatggggcggcgccgccggttcgcgcagctggacgatgacgacgacgacgacgaagacgtgcccatcaatttcaagccctcgggtggcgcctcctcctcggacgccaaacccaggaagccccagccgccgccgcagcagcgccgcggagtctccgatgacgacgacgaggacgtggaggaagtggaacttgaggaggaggaggacgacgagaaggatctcgaggcaatgcgacgggccgaggaggaggagcgccgcgagcagaaggccgagacgaagactcgccgccgccggggacggnccaagcgccgccgcgacccggngagcgaggatgaggagcccgaggagctagagctgcaaacggaggatccccgtgagggaggagatcacggaggcggggccccgaagctgtagggggaccgggtcaagatcactggcaagggggaagaagcaaaaaaagcactatgctt

SEQ ID NO: 31081 - protein, 136 aa, Zea mays
  misc_feature: Ceres CLONE 1407181-F
  misc_feature (100)..(100): Xaa is any aa, unknown, or other
  misc_feature (107)..(107): Xaa is any aa, unknown, or other
MGRRRRFAQLDDDDDDDEDVPINFKPSGGASSSDAKPRKPQPPPQQRRGVSDDDDEDVEEVELEEEEDDEKDLEAMRRAEEEERREQKAETKTRRRRGRXKRRRDPXSEDEEPEELELQTEDPREGGDHGGGAPKL

SEQ ID NO: 31082 - DNA, 691 bp, Zea mays
  misc_feature: Ceres CLONE 1407187-F
  misc_feature: Translation starting site: 221
  misc_feature: SWISSPROT Homolog: EC 1.4.1.2 Glutamate dehydrogenase
  misc_feature (557)..(557): n is a, c, t, g, unknown, or other
  misc_feature (627)..(627): n is a, c, t, g, unknown, or other
  misc_feature (651)..(651): n is a, c, t, g, unknown, or other
  misc_feature (658)..(658): n is a, c, t, g, unknown, or other
  misc_feature (659)..(659): n is a, c, t, g, unknown, or other
aaagctggagctccccgcggtggcggccgctctagaactagtggatcccccgggctgcaggaattcgcacgagaccattacctagaacatcctaatcgaaaaaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgatccgtcagtgcagagtgacatgaagctatggccgttcaaggtcatcccagggcctggtgacaagcccatgattgtagtgaactacaagggcngaggagaagcagtttgctggctgaggagatctcctccatggtcctcatcaagaatgaaggagattgctgnaggcctaccttggttccccatcangaaacgnnagtggttgacagtgccggcctacttcaacgac

SEQ ID NO: 31083 - DNA, 743 bp, Zea mays
  misc_feature: Ceres CLONE 1407188-F
  misc_feature: Encodes the peptide sequence at SEQ ID NO. 31084
  misc_feature (603)..(603): n is a, c, t, g, unknown, or other
  misc_feature (666)..(666): n is a, c, t, g, unknown, or other
  misc_feature (707)..(707): n is a, c, t, g, unknown, or other
aagctggagctccccgcggtggcggccgctctagaactagtggatcccccgggctgcaggaattcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatggcggcggcgccagcgctcgcgcgggagctgctggacgcggcgcgggagccggagttcgcggagtggcagcgcggcgtgcggcgccggatccaccagcacccggagctggccttccaggagcaccgcaccagcgcgctcgtgcgcgccgagctcgacgcgatcggcgtcccgtacgcctggcccgtcgcgcagacgggcgtcgtggccaccatcaccggccccgccgcgggccccgtgttcgcgctccgcgccgacatggacgcgctccccatccaggaaatggtagaatggggagtcaagagcaaggaagacgggaagatgcatgcgtgcggccatgacgcccacgtgncgatgcttcttggagcagctaggttgcttcagtctcggagggacgatttaaagtactgatagnttttttggctggctttttttgcagagaatttcagtaatcgntctactacgtacagtgtgaagcttaatttggtgtaa

SEQ ID NO: 31084 - protein, 136 aa, Zea mays
  misc_feature: Ceres CLONE 1407188-F
  misc_feature: SWISSPROT Homolog: EC 3.5.1.14 Aminoacylase
  misc_feature (118)..(118): Xaa is any aa, unknown, or other
MAAAPALARELLDAAREPEFAEWQRGVRRRIHQHPELAFQEHRTSALVRAELDAIGVPYAWPVAQTGVVATITGPAAGPVFALRADMDALPIQEMVEWGVKSKEDGKMHACGHDAHVXMLLGAARLLQSRRDDLKY

SEQ ID NO: 31085 - DNA, 697 bp, Zea mays
  misc_feature: Ceres CLONE 1407190-F
  misc_feature: Encodes the peptide sequence at SEQ ID NO. 31086
  misc_feature (474)..(474): n is a, c, t, g, unknown, or other
  misc_feature (648)..(648): n is a, c, t, g, unknown, or other
aaagctggagctccccgcggtggcggccgctctagaactagtggatcccccgggctgcaggaattcgcacgagaccattacctagaacatcctaatcgaaaaacggatcaaaatcgaatccaacgctactgcctagggtttcctctgcatttcccctaccacaccccgcgccgcccacccatggccgccgcagacgcgtccgccgagaccgccgccatcgcgcggcgcctggcctcctgcaacaccggcacccgggagcgcgcgctccgctacctcctctccgaatttctgccggcctccgcgccgcgcctctccgccaccgacctcctcaagctctggaagggcatcttcttctgcttctggcacgccgacaagccgctctaccagagctccgtcgcctcgcctccgccgtctccgtcccgcccgtcccccgccgatggtgccgccttcctcgccgcctacctcaccacgctnccgccgcgagtggccccacatcgacgtccaccgcctcgacaagttctacctcctcaaccgccggttcctccaccacgccttcctgcttctccatgctaactccttcgcccccgacgtcacctcccagggtcgtgtccgtcctgtcagacaaggccctgctcccggaagccgacnacgtcgccgctgccacctcccggggcctcgggtaccacgtcgcccaggg

SEQ ID NO: 31086 - protein, 130 aa, Zea mays
  misc_feature: Ceres CLONE 1407190-F
  misc_feature (9)..(130): Pfam Name: Nop52 Pfam Description: Nucleolar protein,Nop52
MAAADASAETAAIARRLASCNTGTRERALRYLLSEFLPASAPRLSATDLLKLWKGIFFCFWHADKPLYQSSVASPPPSPSRPSPADGAAFLAAYLTTLPPRVAPHRRPPPRQVLPPQPPVPPPRLPASPC

SEQ ID NO: 31087 - DNA, 609 bp, Zea mays
  misc_feature: Ceres CLONE 1407197-F
  misc_feature: Encodes the peptide sequence at SEQ ID NO. 31088
  misc_feature (314)..(314): n is a, c, t, g, unknown, or other
  misc_feature (355)..(355): n is a, c, t, g, unknown, or other
  misc_feature (427)..(427): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
cgcggtggcggccgctctagaactagtggatcccccgggctgcaggaattcgcacgagaccattacctagaacatcctaatcaaaaagatacacatccgtcccttctagtctcctaataactagtttctatcttgctccccaaaccagcgcaaaccctgccctgacaccggcagcgacacgtccaccggcggcgccatggtgctcgaggcaacgatgatctgcatagacaattcggaatggatgcggaacggcgactacgctccgtcgcggttccaggcgcaggccgatgccgtcaacctcatctgcggcgccnagacccagtcaaacccggagaacacggtaggcgtgatgacnatggccgggaagggtgttcgcgtgcttgtcactcccaccagcgacctcgggaagattctcgcctgtatgccngggttagaagttggcgctgaagcaaacttggctgcggcaatccaggttgcccagcttgctctaaagcatcgccagaacaagaggcagcagcagagggatatagcttttcattggaagtccctgtgaagacccatcaannnnnnnnnnnnnnnnnnnnnnnnnnnnnnnnnnnnnnnnnnnnn

SEQ ID NO: 31088 - protein, 118 aa, Zea mays
  misc_feature: Ceres CLONE 1407197-F
  misc_feature (40)..(40): Xaa is any aa, unknown, or other
MVLEATMICIDNSEWMRNGDYAPSRFQAQADAVNLICGAXTQSNPENTVGVMTMAGKGVRVLVTPTSDLGKILACMPGLEVGAEANLAAAIQVAQLALKHRQNKRQQQRDIAFHWKSL

SEQ ID NO: 31089 - DNA, 681 bp, Zea mays
  misc_feature: Ceres CLONE 1407199-F
  misc_feature: Encodes the peptide sequence at SEQ ID NO. 31090
ggagctccccgcggtggcggccgctctataactagtggatcccccgggctgcaggaattcgcacgagaccattacctagaacatcctaatcgaaaaatcgattcattcaactgaacagcaagcgcacctaccctacccgccgccgccgaaggcgaaggcctagctcccggtccggcgcgatggctgccgcggcccgccgcggcccgccgcggccccggggcgctcctcctcgtggcgctcctcctgctggcgctggtcgtctccgggcactgcctggacgcgcaccaccgcgggctgaagcgccgccggcggaagcacgagattcactctccgatcaagacggtggtggtcgtggtgatggagaaccgcagcttcgaccacatcctcggttgggtccgccgcacccgccccgacatcgacggcctcacgggccgcgagtccaaccgcctcaacgcctccgacccctcctccccggatatcttcgtcacggacgaggccggctacgtcgactccgaccccgggccacggtttcgaggacattccgggaggagatctttcgggtccggccgacacctccggggggggccgccgccccatggcccggcttccccccaaaaacggcgcggggcatggggcctccggcatgcccgcaataccgccattgaagcgggttcaaagccc

SEQ ID NO: 31090 - protein, 108 aa, Zea mays
  misc_feature: Ceres CLONE 1407199-F
MENRSFDHILGWVRRTRPDIDGLTGRESNRLNASDPSSPDIFVTDEAGYVDSDPGPRFRGHSGRRSFGSGRHLRGGPPPHGPASPQKRRGAWGLRHARNTAIEAGSKP

SEQ ID NO: 31091 - DNA, 675 bp, Zea mays
  misc_feature: Ceres CLONE 1407200-F
  misc_feature: Encodes the peptide sequence at SEQ ID NO. 31092
tcagaactagtggatcccccgggctgcaggaattcgcacgagaccattacctagaacatcctaatcgaaaaaaaaggcttccctttggcttgcctgtgagtgggatctcttcttcctcccccagagcccctgccctcttccgccgacagcgagaaagcacgcggcgcacagcaacacgtccctgcctttccttttgactccggggatccctctcctccttgcctgccgaggaacccactagcttcctactacttcccctccgtcctctcgatccctctccccgttcccttgaccacccgagcatcaagtggcggggagggaacgcggcggcgcggcgtaggaccgatggagaaggggagcgcgccggcgatggccctggcgctcgccatgcttctcgcctgctccagcatcgctgccgtcacggcgcaggagaccgagcggatcgaaggaagccgctggtgatgtgttagaagataacccctgttgggaggctcaaggtcttttgtctatgatctccccagcaaatacaacaagaagctggctgaagaagggatcctaggtggcctgaaccacatgtttgggccccggagactttcatgcagcagggttccctggttggtccaaggggttggcccgaacttttaattcctgagggaaaaagcaaaatggggtcca

SEQ ID NO: 31092 - protein, 38 aa, Zea mays
  misc_feature: Ceres CLONE 1407200-F
MEKGSAPAMALALAMLLACSSIAAVTAQETERIEGSRW

SEQ ID NO: 31093 - DNA, 697 bp, Zea mays
  misc_feature: Ceres CLONE 1407205-F
  misc_feature: Encodes the peptide sequence at SEQ ID NO. 31094
  misc_feature (561)..(561): n is a, c, t, g, unknown, or other
  misc_feature (572)..(572): n is a, c, t, g, unknown, or other
aaagctggagctccccgcggtggcggccgctctagaactagtggatcccccgggctgcaggaattcgcacgagaccattacctagaacatcctaatcgaaaacagcatcgccgccccccctctccgcctcaaggctctcctctcggaggtctgataggcaacccaataatggcagaagtcctatcaggatctcatgaacaccgtctaagctctgccttagatggacactacgacgagaagaggaaatccaatgtggaatacacagaggacgagaagaaagccgtgatcgcggctctgaaaaagaaggctttgagcgcctcacagaagtttaggcattccatgaagagggggaggaagagcagcaaggtgatgtccatctcgattctggatgagcgtgaacctgaggaggtgcaggctgtggatgccttccgccagcttcttgtacttgaagagctgctaccatcgcagcatgatgactaccacatgatgctaagatttctcaaggcaagaaagtttgatatcgagaaggcaaagcaaatgtggtctgatatgctgaagggnagaaagggagntcggtgcagataccattctcgaggaattcgaattcgaagaagctgataaggtggcagaatgctaccctcagggtaacatgggggtgataagggaaggaaggcctggctactttgaagggtttgga

SEQ ID NO: 31094 - protein, 149 aa, Zea mays
  misc_feature: Ceres CLONE 1407205-F
  misc_feature (71)..(137): Pfam Name: CRAL_TRIO_N Pfam Description: CRAL/TRIO, N-terminus
  misc_feature (135)..(135): Xaa is any aa, unknown, or other
MAEVLSGSHEHRLSSALDGHYDEKRKSNVEYTEDEKKAVIAALKKKALSASQKFRHSMKRGRKSSKVMSISILDEREPEEVQAVDAFRQLLVLEELLPSQHDDYHMMLRFLKARKFDIEKAKQMWSDMLKGRKGXRCRYHSRGIRIRRS

SEQ ID NO: 31095 - DNA, 670 bp, Zea mays
  misc_feature: Ceres CLONE 1407206-F
tcagaactagtggatcccccgggctgcaggaattcgcacgagaccattacctagaacatcctaatcgaaaagttccataaaccctaacctcgttggattcgcggcaaaaatcctcccaattcggaaccctccgatgttccagctacctgcgggagctgagccgtgctcggtttggcgaaatttcgcacccctcttgtgctaggaccacccggttcaagctgttcctcggaagggtcaggtcttcaccggtgttctccggcgccggatccaggtttgttccggcgagaggtcggcctcattggtgggggccagcccagcttcgagctcaatttgccggcctgagatggaatcgcgactgcggtgccggtgcctcaggtagtcgcgtcgagtcgacgcgcgattcctgccaatttgggtgggccagcctttcctggcaatctcgggggggcgtttcgccctcgctgcggggcagaaaggtggtgacgtggtgtagccttcccaaggttcgaatccacgccgaccgggagccgggagggcgaccaacttcgactggcctgccgggatttcgttcggccctgctcatcctggacacaagggcggtggcgcgtgtgggtgtgtctccgcccgtttgctacgccatattactacaacagcttcttgggggggcttg

SEQ ID NO: 31096 - DNA, 686 bp, Zea mays
  misc_feature: Ceres CLONE 1407209-F
  misc_feature (309)..(309): n is a, c, t, g, unknown, or other
  misc_feature (485)..(485): n is a, c, t, g, unknown, or other
  misc_feature (524)..(524): n is a, c, t, g, unknown, or other
  misc_feature (541)..(541): n is a, c, t, g, unknown, or other
  misc_feature (655)..(655): n is a, c, t, g, unknown, or other
tccccgcggtggcggccgctctagaactagtggatcccccgggctgcaggaattcgcacgagaccattacctagaacatcctaatcgaaaagagaaaaaacataggggtcccggtgacctaactctgcctccgggccatcgccggagttgcgccgccgccctagtctacagtgctaccaccacctagataggctacctgcaggttgtggcgtcggatgcttcaccgtgcactcgaaccctacgagagtcttggaagttgcaactcgcgcgacggtagcgaggggaagcgaagtcagcagacggcaacgnaagtccagacgagggaggggaaggcggcttccggctccagccgagaacccaaaaggagatccggaaaacgacacgagcactgcctgcctgcgcaccgcctccagttggcacttggcagccgcctataatccccaccggcgggccggatccccatcgtcctgcccccgtgccctcgnccgatcagcgatcaacaaaccactcctttcctctctctncggtcattggtgttccnggacttcccgttgcctcgaaatcccaagctgtagctgacagaaggcatttctttgggagtactagcgacttaccgagccgagcaagcgctagctctccatgtccatgcccgatngcaaggacgacgggcaaatggcggagccacc

SEQ ID NO: 31097 - DNA, 680 bp, Zea mays
  misc_feature: Ceres CLONE 1407210-F
  misc_feature (293)..(293): n is a, c, t, g, unknown, or other
  misc_feature (324)..(324): n is a, c, t, g, unknown, or other
  misc_feature (348)..(348): n is a, c, t, g, unknown, or other
  misc_feature (364)..(364): n is a, c, t, g, unknown, or other
  misc_feature (372)..(372): n is a, c, t, g, unknown, or other
  misc_feature (497)..(497): n is a, c, t, g, unknown, or other
  misc_feature (537)..(537): n is a, c, t, g, unknown, or other
  misc_feature (577)..(577): n is a, c, t, g, unknown, or other
cgcggtggcggccgctctagaactagtggatcccccgggctgcaggaattcgcacgagaccattacctagaacatcctaatcgaaaaaaccttttcgcagctccaggctccagcgcacagccgccgccgtttcttcatcttcttcgcagagccggcgctccatcttcggctccctcccttacttgcgctcggcacgcaggcggcggcggcggcgctgtggctcgggatctcagtgacggcatcagcggcttcccctcccgcctctcgccagtcgcctccggtcctccgcacancgggccggtgatctctctcctcccgcctccnggtggatcgtcaacgacgccgggncccccggcggctgcgnccgcgcgncgtccctggagggcagctggcaggcgctgctccaaccaaggcggtcgcgccgcttttggggaaggcggtttatgcccccaaaagtgaagcgttggctcttagtggccgctctttggaaccctggnctactggcctgttaaatggctcaaccttcagtcattctancaactggcaagttatgatcacacaatcagattttgggagncaagagagggtcgctgttacgccactattcagtatccagactctcaagttaatcgccttgagataccctggacaagcggttccttagctgctgctggcatcct

SEQ ID NO: 31098 - DNA, 669 bp, Zea mays
  misc_feature: Ceres CLONE 1407211-F
  misc_feature: Encodes the peptide sequence at SEQ ID NO. 31099
  misc_feature (454)..(454): n is a, c, t, g, unknown, or other
  misc_feature (459)..(459): n is a, c, t, g, unknown, or other
  misc_feature (641)..(641): n is a, c, t, g, unknown, or other
  misc_feature (667)..(667): n is a, c, t, g, unknown, or other
tggagctccccgcggtggcggccgctctagaactagtggatcccccgggctgcaggaattcgcacgagaccattacctagaacatcctaatcaaaaagttcaacgttcaaacccttgcagctccctctcccttggtcgcgcagtcgccattcacgaccccgaccccgacccccgacccccgtccccctctcttaaatcccacctctccccgtctacgcctcattcgctccagctcgcatcccacagccaagccagttagcccgggagatctccaagaaaccatcttggaatccgagaacgcccagcattcttggtcggccaaggattcgaattccgacgaacggcttctacggccgaaaaaagtccgataatttccgcggggagctcagaaggtgtctcggtctcgggaaccggaggaggaggccgtgggggattgacgagggggcaagatggngaggntgccgtacacaacggcgctgaccacgctgttcagctacgggctgctcttcgccttcggccagcttagggatttcttccgcaaggttcgtcgaactggttcaaggccaagaacgtcaagggggtacgcgacgaatttgcccggggcctggaagaattcctatgcgcgacgtcctgtactttgngcatccaggaatggtttttagaaagnct

SEQ ID NO: 31099 - protein, 70 aa, Zea mays
  misc_feature: Ceres CLONE 1407211-F
  misc_feature (2)..(2): Xaa is any aa, unknown, or other
  misc_feature (4)..(4): Xaa is any aa, unknown, or other
  misc_feature (64)..(64): Xaa is any aa, unknown, or other
MXRXPYTTALTTLFSYGLLFAFGQLRDFFRKVRRTGSRPRTSRGYATNLPGAWKNSYARRPVLXASRNGF

SEQ ID NO: 31100 - DNA, 527 bp, Zea mays
  misc_feature: Ceres CLONE 1407212-F
  misc_feature (91)..(91): n is a, c, t, g, unknown, or other
  misc_feature (243)..(243): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (290)..(290): n is a, c, t, g, unknown, or other
aaagtggagtccccgcggtggcggccgctctagaactagtggacccccgggctgcaggaattcgcacgagaccattacctagaacatcctnaatcgaaaagttcgcatcttcgcgcgtggcgcacaccgctccagctctccttcgacgggcacggccgagccgccttcgtcttggccgcagcggtgcgcgctctccatggcgtctaatagcctagcgcaacgcgcgcccgtgctgcgaagtanggtgtaaaggnnnntttttgggtaataatggatgggcgcccaggggnaagtgggaatggaaccccccttcttggcatggctctaaaaccaggggaaaaaaaaaagcctggaagggcccgagccaaaaaaaaatgaccctggttgggcccctttcgggtggggggccccaaaaaattttgcccaaggttttatttcgtggttgggcgccccccgggggaggggtgcgccccccgaggggccccccccccccccctttttggggggggtttgggggtttttttttt

SEQ ID NO: 31101 - DNA, 760 bp, Zea mays
  misc_feature: Ceres CLONE 1407213-F
  misc_feature: Encodes the peptide sequence at SEQ ID NO. 31102
  misc_feature (547)..(547): n is a, c, t, g, unknown, or other
  misc_feature (597)..(597): n is a, c, t, g, unknown, or other
  misc_feature (600)..(600): n is a, c, t, g, unknown, or other
  misc_feature (633)..(633): n is a, c, t, g, unknown, or other
  misc_feature (733)..(733): n is a, c, t, g, unknown, or other
gagctccccgcggtggcggccgctctagaactagtggatcccccgggctgcaggaattcgcacgagaccattacctagaacatcctaatcgaaaaatacccagagctcctccctctctctctgtctgctgtgctcagataatagcgacacctcctttcctctccctcgaggtgtctctcccagaacgcacagcacagtcgcagaacaggaaggcagagagcagcgccgcgatgagaggaggaggagcggggcccactgcggcgttcatgtccgacgagccgcctccagccgacgcggaagaggtggaggagaactccggcgccgaggaggaggacgaggagacggtggtggagcaggacgacgacgagctggagctggggctctgcctcggctccaagcaacagcagcagcagcatccgccgccgtgccggatcctcacggcccgggacctggcagccgaggtccctggtcaccggattcctccgtgtcctcttcctcccccgcgggcaggtgcaggtaccgcggcgccaagcaagagggccaaggncggatgcggcgcccaactcgccagggacgggtcgcgtctggcccccacanagnctttggaggtgggtggggatggccacccataangaactttcaggatgaacagcctatttaaaccagccaaagagaaatgcatcggaggctggccgccagaaagccatcgtcgaacctgacatgcaggaagacnaggaggaagagcagaaggccgggaccc

SEQ ID NO: 31102 - protein, 133 aa, Zea mays
  misc_feature: Ceres CLONE 1407213-F
  misc_feature (106)..(106): Xaa is any aa, unknown, or other
  misc_feature (123)..(123): Xaa is any aa, unknown, or other
  misc_feature (124)..(124): Xaa is any aa, unknown, or other
MRGGGAGPTAAFMSDEPPPADAEEVEENSGAEEEDEETVVEQDDDELELGLCLGSKQQQQQHPPPCRILTARDLAAEVPGHRIPPCPLPPPRAGAGTAAPSKRAKXGCGAQLARDGSRLAPTXXLEVGGDGHP

SEQ ID NO: 31103 - DNA, 727 bp, Zea mays
  misc_feature: Ceres CLONE 1407216-F
  misc_feature: Encodes the peptide sequence at SEQ ID NO. 31104
  misc_feature (329)..(329): n is a, c, t, g, unknown, or other
  misc_feature (391)..(391): n is a, c, t, g, unknown, or other
  misc_feature (456)..(456): n is a, c, t, g, unknown, or other
tccccgcggtggcggccgctctagaactagtggatcccccgggctgcaggaattcgcacgagaccattacctagaacatcctaatcgaaaaagcccaattctacagcactagtctttttcgtctcggtcgccatgtccttcagcgatgacgaaccgatcatcccttctccaaactcagggccgaggccgacgccgatcgtgcccgggagggtgcagctggtgagcaagaacaacaacatggctccactggaggagaatacccagaaggtgctgcttgagctgaccggcggcgactccaccagcgaccggtcggggcttgacctggtggncgtgctggacgtgagcggcagcatgcagggcgagaagatcgagaagatgaagactgccatgnaagtcgtggtgaagaagctcagttccatcgacccggctctcatcgtcactttcctggacaacgcnaccagatcttgccgctgcgcaagtggacgaggactccagccgcaggtggtgaagttatcgacgccctccagccgggggaaaaccaaatagggagggctccaagggggtcagggccctcccgaacgaaattaatttcgggcggggttttgggtttgcttttgcccaaggccaaaaacggggggcccccccccaagcaaaatggaaggggcggggaacccttgggtggggggggataaacccccgggttaaacgggggcaaaaaaaagggagg

SEQ ID NO: 31104 - protein, 137 aa, Zea mays
  misc_feature: Ceres CLONE 1407216-F
  misc_feature (66)..(66): Xaa is any aa, unknown, or other
  misc_feature (87)..(87): Xaa is any aa, unknown, or other
MSFSDDEPIIPSPNSGPRPTPIVPGRVQLVSKNNNMAPLEENTQKVLLELTGGDSTSDRSGLDLVXVLDVSGSMQGEKIEKMKTAMXVVVKKLSSIDPALIVTFLDNATRSCRCASGRGLQPQVVKLSTPSSRGKTK

SEQ ID NO: 31105 - DNA, 622 bp, Zea mays
  misc_feature: Ceres CLONE 1407218-F
  misc_feature: Encodes the peptide sequence at SEQ ID NO. 31106
  misc_feature (231)..(231): n is a, c, t, g, unknown, or other
  misc_feature (389)..(389): n is a, c, t, g, unknown, or other
  misc_feature (390)..(390): n is a, c, t, g, unknown, or other
  misc_feature (412)..(412): n is a, c, t, g, unknown, or other
  misc_feature (488)..(488): n is a, c, t, g, unknown, or other
  misc_feature (518)..(518): n is a, c, t, g, unknown, or other
aaagctggagctccccgcggtggcggccgctctagaactagtggatcccccgggctgcaggaattcgcacgagaccattacctagaacatcctaaaaaaaaaaagcgaagccaaccagcacaaaaaggagcacaaagcttctctctccctcccccctctctctctctcctgttccccgcgagagtcgctcaaggccgcggcgaggagaagcagcagcgcgtcacctctccnatggcatccccgtccttcctccgtgcaacctgtgcgcttctcgagtgctgaggctccctgtccctaaaacaagcttgcgcgcgcgatggagggtttttcgagggacttgctgtgcgggattggcaagggggacgcgccgccaccggagaagaagccgnngcagctgcggaggagatggganggaagtggagcttaccctcgggctgtcgcttggcggccgattcggtcccaacgggaaggggagcagctccccccgntcgtcgtccgtgggcgccatgctgacacgnccggtggaaggggccgggcgccgcctcccctcttcgggggcgagcctcgctgccggtccagggcggagggcgcccgaaagttgaaaagaaccaggggttgggaa

SEQ ID NO: 31106 - protein, 102 aa, Zea mays
  misc_feature: Ceres CLONE 1407218-F
  misc_feature (25)..(25): Xaa is any aa, unknown, or other
  misc_feature (32)..(32): Xaa is any aa, unknown, or other
  misc_feature (58)..(58): Xaa is any aa, unknown, or other
  misc_feature (68)..(68): Xaa is any aa, unknown, or other
MEGFSRDLLCGIGKGDAPPPEKKPXQLRRRWXGSGAYPRAVAWRPIRSQREGEQLPPXVVRGRHADTXGGRGRAPPPLFGGEPRCRSRAEGARKLKRTRGWE

SEQ ID NO: 31107 - DNA, 643 bp, Zea mays
  misc_feature: Ceres CLONE 1407219-F
  misc_feature (370)..(370): n is a, c, t, g, unknown, or other
  misc_feature (436)..(436): n is a, c, t, g, unknown, or other
  misc_feature (438)..(438): n is a, c, t, g, unknown, or other
  misc_feature (439)..(439): n is a, c, t, g, unknown, or other
  misc_feature (511)..(511): n is a, c, t, g, unknown, or other
  misc_feature (567)..(567): n is a, c, t, g, unknown, or other
  misc_feature (569)..(569): n is a, c, t, g, unknown, or other
  misc_feature (574)..(574): n is a, c, t, g, unknown, or other
aaagctggagctccccgcggtggcggccgctctagaactagtggatcccccgggctgcaggaattcgcacgagaccatttacctagaacatcctaatcgaaaaaacagcaaagcccaggctgcccagcacacgcgacgcgaaccagctgccgaggaaccctagcggagcactgtgcaggcgaccgcggcgcgcttatcacttacggggggatacggcggcatcgtccccctcggcccctcctccatccctggtgcggcggcgccagcctgcaggtgttgaatgctgatttgttgtggctgattaattgggttgatcgtcgattaatcgtgattagtccgctgatcgcccttctggcgatcagaaacgatnaggcaatctgaaaacattggccgccaaacctccagagcgactcccgcgagccgtgaccaccatagncnnaatcacgcaccagaagctttcacggagctgtctcggtcacgagtggtccagctgactcctattccctgcgtncatggcgagctctggcgatgaaggggcgtggtgggtgttggacctcgctccccggncngaaantcggtggcttgcccaacgaaggaggcgcacgcccacgcctctcaaccgagatggagtcccttttgcatg

SEQ ID NO: 31108 - DNA, 697 bp, Zea mays
  misc_feature: Ceres CLONE 1407220-F
  misc_feature: Encodes the peptide sequence at SEQ ID NO. 31109
  misc_feature (384)..(384): n is a, c, t, g, unknown, or other
  misc_feature (432)..(432): n is a, c, t, g, unknown, or other
  misc_feature (636)..(636): n is a, c, t, g, unknown, or other
  misc_feature (654)..(654): n is a, c, t, g, unknown, or other
  misc_feature (669)..(669): n is a, c, t, g, unknown, or other
agagctggagctccccgcggtggcggccgctctcgaactagtggatcccccgggctgcaggaattcgcacgagaccattacctagaacatcctaatcgaaaaatcccacgctgccctcggcgctgcgcctggacccggcacctacctcccccctccccacctcgccgccggcgggtggagtcgggctggagcagccgctctcctctgttacccccctaaccccctataaagaaaaagaaaaaaaaacagagagagagagcgagcgaccggcggctcggcagccatggggcacggcgtcagctgcgcccgcaccggcgacgagcacgactacttccgcgcggcgcaggtcggggacctcgagggcctggacgcgctcctcgacgncgacccctctctcgcccgccgggccacggtctacgaacggctcttcgnggttcaaattcgcgccgcgaatgcccgcctccagggggttgcaatgggcttggaatcagggggggcccccggacggggttgaatttgaacaaaaaaaccccgttgatggctccgcggaattcacggcaaaaatggattgcgggctgaaactcccgggagggcgggggcgagaacacccagggcgggattccccaagcggggggngactgattcggaaaatcngttcaaaatttgggncgagggacatgggtgcaggacctaccat

SEQ ID NO: 31109 - protein, 76 aa, Zea mays
  misc_feature: Ceres CLONE 1407220-F
  misc_feature (34)..(34): Xaa is any aa, unknown, or other
  misc_feature (50)..(50): Xaa is any aa, unknown, or other
MGHGVSCARTGDEHDYFRAAQVGDLEGLDALLDXDPSLARRATVYERLFXVQIRAANARLQGVAMGLESGGAPGRG

SEQ ID NO: 31110 - DNA, 694 bp, Zea mays
  misc_feature: Ceres CLONE 1407223-F
  misc_feature: Encodes the peptide sequence at SEQ ID NO. 31111
  misc_feature (462)..(462): n is a, c, t, g, unknown, or other
  misc_feature (463)..(463): n is a, c, t, g, unknown, or other
  misc_feature (496)..(496): n is a, c, t, g, unknown, or other
  misc_feature (512)..(512): n is a, c, t, g, unknown, or other
  misc_feature (522)..(522): n is a, c, t, g, unknown, or other
  misc_feature (598)..(598): n is a, c, t, g, unknown, or other
  misc_feature (603)..(603): n is a, c, t, g, unknown, or other
  misc_feature (604)..(604): n is a, c, t, g, unknown, or other
  misc_feature (606)..(606): n is a, c, t, g, unknown, or other
acccgcggtggcggccgctctagaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggaccatcgccaggtccgnngacgaaggagttcatggaagcccttgctgccgncgctgatgtgtcatgnattggccagntcccggcggtcggttctactctgccacctcgcgccccaataggaggttgtcgtgacccaccagcacacgatgacancagtnncngggtgggagtccaagggggggggggggtccgtcacttggtactcgtgacaccgccaggggagcagcctttggcaggggcactaaggat

SEQ ID NO: 31111 - protein, 178 aa, Zea mays
  misc_feature: Ceres CLONE 1407223-F
  misc_feature (102)..(102): Xaa is any aa, unknown, or other
  misc_feature (113)..(113): Xaa is any aa, unknown, or other
  misc_feature (118)..(118): Xaa is any aa, unknown, or other
  misc_feature (122)..(122): Xaa is any aa, unknown, or other
  misc_feature (147)..(147): Xaa is any aa, unknown, or other
  misc_feature (149)..(149): Xaa is any aa, unknown, or other
  misc_feature (150)..(150): Xaa is any aa, unknown, or other
MASETETFAFQAEINQLLSLIINTFYSNKEIFLRELISNSSDALDKIRFESLTDKSKLDAQPELFIHLVPDKATNTLSIIDSGIGMTKSDLVNNLGPSPGPXTKEFMEALAAXADVSXIGQXPAVGSTLPPRAPIGGCRDPPAHDDXSXXVGVQGGGGVRHLVLVTPPGEQPLAGALR

SEQ ID NO: 31112 - DNA, 649 bp, Zea mays
  misc_feature: Ceres CLONE 1407224-F
  misc_feature: Translation starting site: 398
  misc_feature: SWISSPROT Homolog: EC 1.4.1.2 Glutamate dehydrogenase
  misc_feature (205)..(205): n is a, c, t, g, unknown, or other
  misc_feature (215)..(215): n is a, c, t, g, unknown, or other
  misc_feature (232)..(232): n is a, c, t, g, unknown, or other
cacccgcggtggcggccgctctagaactagtggatcccccgggctgcaggaattcgcacgagaccattacctagaacatcctaatcgaaaaaaccatcattgcaaaagcgaagcaaagcaatcggaattctctgcgatttctctagatctcgactaccccccactagttttggttcctcctttcgttcgagagagcgattctggntggcaatggncgaagagcgagggtccnggcgatcgggatcgacctcggcaccacctactcgtgcgtcggcgtgtggcagcacgaccgggtggagattatcgccaacgaccaggggaaccgcaccacgccgtcctatgtcggcttcaccgacaccgagcggctcatcggcgacgctgccaagaacaggtcgccatgaaccccaccaacaccgtcttcgatggcaagcgggtgatcggcaggaggttctctgatccgtcagggcagagggacatgaagctatgggcggtcaaggtcatcccaggggctggggacaagcccatgattgtaaggaactacaagggcgagggaaaaacagtttggtggtggaggaaaatccccccagggccccccttaaaaatgaaggaatttggtgaaacccaccttgggtccccccctaaaaaaagg

SEQ ID NO: 31113 - DNA, 871 bp, Zea mays
  misc_feature: Ceres CLONE 1407225-R
  misc_feature: Encodes the peptide sequence at SEQ ID NO. 31114
ttgggtactgggccccccctcgaggtcgacggtatcgataagcttttttttttttttttttggactagtggcatgagctctgcctcgcaattaagaagaatataattgatccagtttttggaaaaaccggacccgaaacctacactggaaaccggcgaaggccctaaccaaccacctttactacgataacctcacgcgctcgtgcacatctagagtgcatcgttgcccagctcaaactctagggacgagcagctccgacttccctagacgagccacacactgccaaagctgctcgacgacgcctaattccagacaccgacgcaagggataagatcactgcgcaccatcgttgccaatcctctgactcccctctcgagggagctccgattcttcaccacgagctatgatccacaacgccgaactccgggagcaagcagacgcctaaagcgacaatggcctcgactccaccgagccaagcggagtgtccaagagcctccacaacggcgacgatcacacaaactaggtcttctgggccgcgccttctagaaggagaaacgagtcgtcgcctcccgcctggtaccaccaagcatagtttcctccgaaaaacttttgtcagtcgccgacgcaccaaccctcagagacctaacttcggtactagcaccagcgggagacccccagaaaggccaaggccagggttccccacatggggggcgaggaggaccaaagacgggcccctcaattgggtttaggggggggccccccgcgggggggttacccatcgttcccgcaccccaaagcgggggaatgggctttttgcacaaaaaagaccccttccaaacaagaaaggcccccaaaaccctccgggggctag

SEQ ID NO: 31114 - protein, 55 aa, Zea mays
  misc_feature: Ceres CLONE 1407225-R
MGGEEDQRRAPQLGLGGGPPRGGYPSFPHPKAGEWAFCTKKTPSKQERPPKPSGG

SEQ ID NO: 31115 - DNA, 686 bp, Zea mays
  misc_feature: Ceres CLONE 1407233-F
  misc_feature: Encodes the peptide sequence at SEQ ID NO. 31116
  misc_feature (557)..(557): n is a, c, t, g, unknown, or other
cgctctagaactagtggatcccccgggctgcaggaattcgcacgagaccattacctagaacatcctaatcgaaaagctggtgcttctacggggcctggcgatttgaattcaagtggtgcgtgtatatagcgtgagagagagaaaagagagtggctcttgcgctctgcagtccagttcttgaatccagagctgcgattcgtgctcgcctgacgccgatgggccggagcctgagcccgctgctacggcaggagctggacaacctggacaaggacgctgacagccgccgcgccgccatgaaggcgctcaagtcgtacgccagacacctggactccaagtccatcccgcacttcctcgccgaggtctccgacaccaccgcggtcggcgccggcgccggcagcggcatgtccaccgggtgcgagttcaccatctcgctctacgaggtgctggggcgggtgcacggtcgtcacatcgtgccgcagatcggcaacatcatgggcaccatcatgtgcacgctctcctccagggggggctccttcccggtccacaggcctggtccnaggtggggcccgcatcggggggatgggatcaacccctcccggcgaaaggggaaaaaggccgaatcatcccctcctctggagccgctctggaggggttcttgggggaaacccaagaaggggcgccccccg

SEQ ID NO: 31116 - protein, 157 aa, Zea mays
  misc_feature: Ceres CLONE 1407233-F
MGRSLSPLLRQELDNLDKDADSRRAAMKALKSYARHLDSKSIPHFLAEVSDTTAVGAGAGSGMSTGCEFTISLYEVLGRVHGRHIVPQIGNIMGTIMCTLSSRGGSFPVHRPGPRWGPHRGDGINPSRRKGKKAESSPPLEPLWRGSWGKPKKGRPP

SEQ ID NO: 31117 - DNA, 666 bp, Zea mays
  misc_feature: Ceres CLONE 1407235-F
  misc_feature: Encodes the peptide sequence at SEQ ID NO. 31118
  misc_feature (393)..(393): n is a, c, t, g, unknown, or other
  misc_feature (471)..(471): n is a, c, t, g, unknown, or other
  misc_feature (472)..(472): n is a, c, t, g, unknown, or other
gctggagctccccgcggtggcggccgctctagaactagtggatcccccgggctgcaggaattcgcacgagaccattacctagaacatcctaatcgaaaagctggtgcttctacggggcctggcgatttgaattcgagtggtgcgtgtatagagcgtgagagagagaaaagagagtggctcttgcgctctgcagtccagttcttgaatccagagctgcgattcgtgctcgcctgacgccgatgggccggagcctgagcccgctgctacggcaggagctggacaacctggacaaggacgctgacagccgccgcgccgccatgaaggcgctcaagtcgtacgccagacacctggactccaagtccatcccgcacttccctcgccgaggtctccacnaccaccgcgggccgggcgccggcgcccggcagcggcatgcccacccggcggcgagttcaccatctcgctctacgaggnngctggcgcgggtgcacggccgcaacatcgtgccgcagatcggcaacatcatggccaccatcatgtgcacgcttctcctcccagcgggggctccttcccgctccacccagcctgctcccagggtggtgcccgccatcgcgcggcacgggatcgacccctccgcgccgaagggggagaagggcggcatcatcgcct

SEQ ID NO: 31118 - protein, 142 aa, Zea mays
  misc_feature: Ceres CLONE 1407235-F
  misc_feature (52)..(52): Xaa is any aa, unknown, or other
  misc_feature (78)..(78): Xaa is any aa, unknown, or other
MGRSLSPLLRQELDNLDKDADSRRAAMKALKSYARHLDSKSIPHFPRRGLHXHRGPGAGARQRHAHPAASSPSRSTRXLARVHGRNIVPQIGNIMATIMCTLLLPAGAPSRSTQPAPRVVPAIARHGIDPSAPKGEKGGIIA

SEQ ID NO: 31119 - DNA, 673 bp, Zea mays
  misc_feature: Ceres CLONE 1407238-F
  misc_feature: Encodes the peptide sequence at SEQ ID NO. 31120
tggagctccccgcggtggcggccgctctagaactagtggatcccccgggctgcaggaattcgcacgagaccattacctagaacatcctaatcgaaaaaaaaataggaaacgagcaaaggtctggcgagctacctaccaataaactaccatctccacaaacaggctagcacgtagctatatgccagaactgacctagtagaggatcgatcgcagatggtgtttcctgccatcctccccaaggtggccgcacgatggctcttcacgttctaccgcgccgccagaaagctcaggcgccacgccttccagctctactaccgcaacaccgccgccaagccgtcgtccgccgtctcgcagcagcaggccggggccgccgccactgtcactgccgccgccgccttcaagaccggcgccgccatccctgacgccggcggccgggaccgttgtgtgcgacatgcacggcgccctgctgcgctccacgcgctcttccctacttctgcgggggccttggggggggaggggaaaacctcctccgggccatggctgctgctctgcgcctccccccctggtctgggcgcgccggggagcgcccgcggcgccggcggcccgggggatggcgttcgccacccttcgcggggctcaggcccagggaagggggacctcggggccccgcgcg

SEQ ID NO: 31120 - protein, 153 aa, Zea mays
  misc_feature: Ceres CLONE 1407238-F
MVFPAILPKVAARWLFTFYRAARKLRRHAFQLYYRNTAAKPSSAVSQQQAGAAATVTAAAAFKTGAAIPDAGGRDRCVRHARRPAALHALFPTSAGALGGEGKTSSGPWLLLCASPPGLGAPGSARGAGGPGDGVRHPSRGSGPGKGDLGAPR

SEQ ID NO: 31121 - DNA, 596 bp, Zea mays
  misc_feature: Ceres CLONE 1407241-F
  misc_feature: Encodes the peptide sequence at SEQ ID NO. 31122
  misc_feature (396)..(396): n is a, c, t, g, unknown, or other
tccccgcggtggcggccgctctagaactagtggatcccccgggctgcaggaattcgcacgagaccattacctaaaacatcctaatcgaaaaaagtagacaacccagctctccagcggtccagcggtccagcctctcctagccgaggccaaaacccccataccaacacacacttcgcttctcgctgcctccgcggcggcgcgccgctccgctccgagccctcttcctcctcctcctctgcccgttcggtcgagaatgttctactcgcatcagcttctcgcgcggaagggcgccgctcggccagaatatgggatgggcggcgacgctccactcgaagatcacccgcaacgctcgacagctcgacatcatcaaatctgtgaggaaatttgacccctcgngccatggctctgaggtctctgaatcctcatggtgcggggtgatccggacaaaaggaggggaagctcccaaactgaaggcccgggttctgagtgaatcacggggatgggggataaacgggcaaaaccccccgcctccccagggaaaaatcggccacggttgaaagagaacccggcaaaaacaaaaggggggggaaaccccc

SEQ ID NO: 31122 - protein, 83 aa, Zea mays
  misc_feature: Ceres CLONE 1407241-F
  misc_feature (31)..(31): Xaa is any aa, unknown, or other
MGWAATLHSKITRNARQLDIIKSVRKFDPSXHGSEVSESSWCGVIRTKGGEAPKLKARVLSESRGWGINGQNPPPPQGKIGHG

SEQ ID NO: 31123 - DNA, 686 bp, Zea mays
  misc_feature: Ceres CLONE 1407245-F
gctctagaactagtggatcccccgggctgcaggaattcgcacgagaccattacctagaacatcctaatcgaaaactttttttcctccgacttctttcagcagcatcccctagtcctcgcctggactccgcggagtctttggttgctccgagttcctcgcctggttttcggcaaggccaaggaaaggtggtcacttcacttctgttttttttttttactgccgccgcaaacctccgctcctgtgccataccgccattccattcttaatctgggcgccgaagaagagaggacgggagcgaggtccggtcgaaatcgttaagcggattgcgggaaggcggcaccgccgtcggcgtcgggcggaggccgtttcggtatgattcaactgctgctcctcgtgctgtttcgcggaggcgcgcgttggcgctgctccttcatggaagaaggccgcgccccctgccgaagactcccgacgccgcggcgtgaaccctggtgaataacggtctaaggccccaggtcaagggtaaagaagggttgggggggaccggttctccgaggttcccaaatgtcaaggggtagccagcggccccctaggaaccaaagaaaagcggtatctacgcctccgctcaccgttagaccccatggcaccaaccggtgttttaaaggaacgcccccccttccggggacgcg

SEQ ID NO: 31124 - DNA, 710 bp, Zea mays
  misc_feature: Ceres CLONE 1407246-F
  misc_feature: Encodes the peptide sequence at SEQ ID NO. 31125
tccccgcggtggcggccgctctagaactagtggatcccccgggctgcaggaattcgcacgagaccattacctagaacatcctaatcgaaaaaaaaacgcaactgaaaaacctcgtctacattcgcatctaggcgcccctccacctcgttccgatccagctcgccggcgcccggcggccatgtcgcagcccacggcggcggtggccgcggaggcgcagccgcagggtcgcggcctcgcggggcgccagggcggcggtggcggccttgggcagagcatctctggcatcgtgcggatggcggtgttctggtacttcgcggccaagttcttcgggcccaagtgcccgcccgcggaccccgggattctcatgtccaacctcttccagaagggcgagccaatggatatgtggatgtatttatcagagagtgacaagttcaacgattttgctaatgaggacgcacttatttggcatgaggcaaacataccatatgcagtatggggacctaccagtactagaacacggtcattaacatactacccttcagaggctctcaagcataatggatctttgtatgctcatgtttactttgcccgctcgggttaccctgtggacccacagatcctgaatatgagcagaaatctgcatttgggaggacgcaccctggtgtggcattcttgccaaatcaaaagctggtaaaagaagagcttgctgg

SEQ ID NO: 31125 - protein, 171 aa, Zea mays
  misc_feature: Ceres CLONE 1407246-F
MSQPTAAVAAEAQPQGRGLAGRQGGGGGLGQSISGIVRMAVFWYFAAKFFGPKCPPADPGILMSNLFQKGEPMDMWMYLSESDKFNDFANEDALIWHEANIPYAVWGPTSTRTRSLTYYPSEALKHNGSLYAHVYFARSGYPVDPQILNMSRNLHLGGRTLVWHSCQIKSW

SEQ ID NO: 31126 - DNA, 649 bp, Zea mays
  misc_feature: Ceres CLONE 1407247-F
  misc_feature (173)..(173): n is a, c, t, g, unknown, or other
  misc_feature (177)..(177): n is a, c, t, g, unknown, or other
  misc_feature (183)..(183): n is a, c, t, g, unknown, or other
  misc_feature (201)..(201): n is a, c, t, g, unknown, or other
  misc_feature (210)..(210): n is a, c, t, g, unknown, or other
  misc_feature (234)..(234): n is a, c, t, g, unknown, or other
  misc_feature (256)..(256): n is a, c, t, g, unknown, or other
tggagctccccgcggtggcggccgctctagaactagtggatcccccgggctgcaggaattcgcacgagaccattacctagaacatcctaaaaaaaaatctgaagcaaaatgtaccgggaatgttgaagagcgggactcttaagcagtagtgagatgcgggcggtggtggtccnccgncgttgncggctgtggagccccggnccgtgcagntcctgctcctggcggcgttctcgncgcaggttcttcctacgccggnccctttttcggttctcggggtccccggggttggactgccctctttcggccccccgatggcccgatttccttcggggccagggtcaccaaggtccccgggttcccccacaagattttccgggcggcgccgggggaaatttttggggggtccccacccccgcgggggggggggggggcttttgaaaacacagggggggtcccccgcgcccggggggggcgccccttttcgccgggtggggagaaccccgcggcttcttggggggggggggggctttaagaaattttcctccccccccgggaaaaaagggtttttttttttttgtggcccccccccccccggtttctctttgcccccccaaaaggggggggggccgccccgacatttccttttggg

SEQ ID NO: 31127 - DNA, 680 bp, Zea mays
  misc_feature: Ceres CLONE 1407248-F
  misc_feature: Encodes the peptide sequence at SEQ ID NO. 31128
  misc_feature (360)..(360): n is a, c, t, g, unknown, or other
  misc_feature (509)..(509): n is a, c, t, g, unknown, or other
  misc_feature (540)..(540): n is a, c, t, g, unknown, or other
  misc_feature (550)..(550): n is a, c, t, g, unknown, or other
  misc_feature (568)..(568): n is a, c, t, g, unknown, or other
  misc_feature (584)..(584): n is a, c, t, g, unknown, or other
cgcggtggcggccgctctagaactagtggatcccccgggctgcaggaattcgcacgagaccattacctagaacatcctaatcgaaaaaatcaactcgtttctctccgattgctcctccgagtccgagactccgttctctcccgcatccaccgccgtctcatccccaatccgagcaacgcctcccctcgcctccaaaaccctacccctcctgtcaccggcgggggcatgaaccggtgatcgcttacctggtctcgtctgtctgcgcacgcgcgaggtcagtgagtgagcattgcggtggtccgatcgcccgcggggggccatggcgtctgtggcgggatcgggcgggcgggcaagcgcggnggccggtgggttgaagacttacttcaagacccccgaggggcggcacaagctgcagtacgagaagacgcactcccccgccgtcgtgcactacaacccacacggcaagacgtcgccccagatgacggtggcatattttgaggagaagcagnaagggccagggttccacgcttcaacacaaanggttgggaanggggaatgcggtctgcanttgcaaaactgctggnaactggggaaatggtaccgggaactttactttcgggagaaggggaaccacgcagggttgcttaagaaccccgcttgggtggggggagtttttttgg

SEQ ID NO: 31128 - protein, 120 aa, Zea mays
  misc_feature: Ceres CLONE 1407248-F
  misc_feature (14)..(14): Xaa is any aa, unknown, or other
  misc_feature (64)..(64): Xaa is any aa, unknown, or other
  misc_feature (74)..(74): Xaa is any aa, unknown, or other
  misc_feature (77)..(77): Xaa is any aa, unknown, or other
  misc_feature (83)..(83): Xaa is any aa, unknown, or other
  misc_feature (89)..(89): Xaa is any aa, unknown, or other
MASVAGSGGRASAXAGGLKTYFKTPEGRHKLQYEKTHSPAVVHYNPHGKTSPQMTVAYFEEKQXGPGFHASTQXVGXGECGLXLQNCWXLGKWYRELYFREKGNHAGLLKNPAWVGGVFL

SEQ ID NO: 31129 - DNA, 679 bp, Zea mays
  misc_feature: Ceres CLONE 1407251-F
  misc_feature: Encodes the peptide sequence at SEQ ID NO. 31130
  misc_feature (528)..(528): n is a, c, t, g, unknown, or other
aaagctggagctccccgcggtggcggccgctctagaactagtggatcccccgggctgcaggaattcgcacgagaccattacctagaacatcctaatcgaaaaacactaccatactgctgcgcgctagtggcagtgctcgcgctcccactcgcaccacagtacgccaccgctgctgccggctcctccccgcgctcgcattgcgatttgcgacctagcgcgagggtaccgggggtggtgcgcgtgctccgtgatccgggaagcgccgcgagatggtcgagggcgtatgcgttctcgccgcgccgaaggacgactacttcacgacgcaccgcgatcgaggaacagcactctggtgtctgctactgcatcaccagacctcccccgggatatggagccgatcgtcttggaaatgaacactatctggacatgcttgggactactgtgatcataccaactgcacttgctccctgatgagaggtaacactgaggagctgagcagtgtctgtcaaaacattgctgttcgatgcatanaacagcgaccgtctgccgatattctttaggaccatgttgcctgggagaaagatggaacataacctgggaagtggcaaacatttccagaatatttgttggacggtaggatggggggctaaacccccaattaattttcccggaatcggggggg

SEQ ID NO: 31130 - protein, 155 aa, Zea mays
  misc_feature: Ceres CLONE 1407251-F
KAGAPRGGGRSRTSGSPGLQEFARDHYLEHPNRKTLPYCCALVAVLALPLAPQYATAAAGSSPRSHCDLRPSARVPGVVRVLRDPGSAARWSRAYAFSPRRRTTTSRRTAIEEQHSGVCYCITRPPPGYGADRLGNEHYLDMLGTTVIIPTALAP

SEQ ID NO: 31131 - DNA, 733 bp, Zea mays
  misc_feature: Ceres CLONE 1407254-F
  misc_feature: Encodes the peptide sequence at SEQ ID NO. 31132
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (708)..(708): n is a, c, t, g, unknown, or other
  misc_feature (709)..(709): n is a, c, t, g, unknown, or other
  misc_feature (719)..(719): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
aagctggagctccccgcggtggcggccgctctataactagtggatcccccgggctgcaggaattcgcacgagaccattacctaaaacatcctaatcgaaaaatccaattcacaggctcaccacaccaaccaacaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccgcgacgccgccccaccacgcccgatggccgccgtaaggtcgctgctccgctcgtcggcctcccttcttcgcgccgcccccgccctcgcgagatcctcggctaccacgcgtccgtctcttcggcgcgcattggctgctcctcctcgcctcctcaggtcgcccgtcgagtcgaagcttctgcgtggagtcgcttctgcctctgcacaccgccaccgccggtgcacgcatgacgtccatgctcgccgctcctggccaagggcctcggctggctcacccaagctgaaaactgacggagtaaacgcccccctgtgggtgcttaggaagnnnnnnnnntnnttgttggggntnnnnnnnnnnnnn

SEQ ID NO: 31132 - protein, 182 aa, Zea mays
  misc_feature: Ceres CLONE 1407254-F
  misc_feature (176)..(176): Xaa is any aa, unknown, or other
  misc_feature (177)..(177): Xaa is any aa, unknown, or other
  misc_feature (178)..(178): Xaa is any aa, unknown, or other
  misc_feature (179)..(179): Xaa is any aa, unknown, or other
MSGRGKGGKGLGKGGAKRHRKVLRDNIQGITKPAIRRLARRGGVKRISGLIYEETRGVLKIFLENVIRDAAPPRPMAAVRSLLRSSASLLRAAPALARSSATTRPSLRRALAAPPRLLRSPVESKLLRGVASASAHRHRRCTHDVHARRSWPRASAGSPKLKTDGVNAPLWVLRKXXXXLLG

SEQ ID NO: 31133 - DNA, 720 bp, Zea mays
  misc_feature: Ceres CLONE 1407256-F
  misc_feature: SWISSPROT Homolog: EC 3.4.23.1 Pepsin A
ttaactagtggatcccccgggctgcaggaattcgcacgagaccattacctagaacatcctaatcgaaaaggccggtactccggactcgggagtacagtactcgtcactcaaggtctcgtcacgatgagaggcatctgcccacacgaccttgtctatgttccatgcgtcttctgcccgaatcagatcatcaggctgagcgagcacgaaccggtgctctacctgcattatgatcccttctatgggacccagttcccgatcatatgccagtattgcctcctccacgacccctaccgccgtaggctaacactggaatatgagaaagaatgaaaatgagtgctcgtccgtttactgcattcccgatgagcactgtgggaagaggggcgatactagaagactgagacccgccatacatgtctcaagctaaggaatggctgcctggctgcgtgcgggatcctgaatatgcactgccgggtcggtccgataaacggactctcaatcacttccctgaaggattcccaggcagtgttgacatggcgaatattttgctgaaaagcctgacagacgcgttggaactgtaaaaacgatgattccatcctagggaaaccttacaccaaatgataccattatgaagctttcaaagaaaacaccttactagaagaggctcggaacctcatggttagcgctaccctccgggaaagcggatggacaaagacgacctga

SEQ ID NO: 31134 - DNA, 688 bp, Zea mays
  misc_feature: Ceres CLONE 1407257-F
  misc_feature: Encodes the peptide sequence at SEQ ID NO. 31135
  misc_feature (594)..(594): n is a, c, t, g, unknown, or other
  misc_feature (595)..(595): n is a, c, t, g, unknown, or other
  misc_feature (621)..(621): n is a, c, t, g, unknown, or other
cgctctagaactagtggatcccccgggctgcaggaattcgcacgagaccattacctagaacatcctaatcaaaaagatctacctgtctgttcttcgatcgagtctgagagatttgggaggaggagggaaacaaagcgaaagagcccatcttttttgtctttttggttcggtttcgtggttgcttcttttggaccccgcggaggagcccaccgtttctacaaaaacccaatctttgctgccttctcagcggtcgagatcgataggtttccagatctgaggctccgtgttctggctgtgagatcggaggcgcagcaatccgagcacgcagctagtagggaaagtatccgagaaaagttgcagattttgctgggggcaacggagcgagaacaagttactgcagaaggaaagggcaaaggtgggggaggcgccggagatgagggatgctatcagctctgatggattatttgaaatcttgctcgggtccggcatcaccggctgggcgtccccgcaaaggatcggatgccaccggccgccaggacgggctcctgtggtacaaggacggcgggcaggtcgtcgatggtgagtctccatggnncgtggtccagccaataacctattggnagacatagccaggttgaaatcgggccgcttagcacatcggagcctggactggcagcacccttcgtcg

SEQ ID NO: 31135 - protein, 62 aa, Zea mays
  misc_feature: Ceres CLONE 1407257-F
  misc_feature (52)..(52): Xaa is any aa, unknown, or other
  misc_feature (61)..(61): Xaa is any aa, unknown, or other
MLSALMDYLKSCSGPASPAGRPRKGSDATGRQDGLLWYKDGGQVVDGESPWXVVQPITYWXT

SEQ ID NO: 31136 - DNA, 783 bp, Zea mays
  misc_feature: Ceres CLONE 1407260-F
  misc_feature: Encodes the peptide sequence at SEQ ID NO. 31137
tccccgcggtggcggccgctctagaactagtggatcccccgggctgcaggaattcgcacgagaccattacctagaacatcctaatcaaaagcctttttctctcctcccaatctcccattaccccagcggcccagcgtgcggagacgggagacgcgctccccagtccccacccccctctcgtgtcgtggcgacgactggggggctgtcgctgccgctgccgccctacgtcaggtggccaggtcgtattagggcacttcgccggcgacgagtaccacaaggcagtggacactttctctggtatcagaggatcaatgtccaattattatgatgactacgatgacattgacgagatggaggatgattatgatatggatgatcccattgatgacatggtagacgagcagcaagggattaaggatcctgatggggaagataatgattatggacacccaaatgattagatcccagatattccatcagcaaaaggcaagaaagggaagggacatccaggggattaccctggggagcaaattaccttaaccccgtaaaaaaatacggacgggcccgaattaaaaccggccaaaaattttggggaatggccctaaacctcgggaaaaaaaacttttggggggtttggaacccccacgggaaaagggggggaatatcctttggggtttaaaacaaaaaaaacaaaacggggaaaatccccatatttccccatttttccgcgttaaaaatatgggaggggggaaacagcccaaggcgctaatttttccctttttt

SEQ ID NO: 31137 - protein, 49 aa, Zea mays
  misc_feature: Ceres CLONE 1407260-F
MSNYYDDYDDIDEMEDDYDMDDPIDDMVDEQQGIKDPDGEDNDYGHPND

SEQ ID NO: 31138 - DNA, 723 bp, Zea mays
  misc_feature: Ceres CLONE 1407262-F
  misc_feature: Translation starting site: 140
  misc_feature: Pfam Name: DUF246 Pfam Description: Plant protein family
  misc_feature (505)..(505): n is a, c, t, g, unknown, or other
  misc_feature (626)..(626): n is a, c, t, g, unknown, or other
  misc_feature (635)..(635): n is a, c, t, g, unknown, or other
  misc_feature (710)..(710): n is a, c, t, g, unknown, or other
gctctagaactagtggatcccccgggctgcaggaattcgcacgagaccattacctagaacatcctaatcgaaaacctcactctgtctcttcctcagtcccggcatcagcgctcaaaccctaacacgccacgcgatcccgatgcgcaggggtctgggcagcgaggcatcgttgcgccggcggcgcgggccggcgcggctttgggtggcagtggcggcgctggtggtcggcaccgtgtgcctcttctcctcctcttcggtcggcctgttgggcgcctcttacagggtccaggatgttgatgtaaataagttgtggagaactgcagattcaaatggttggagagcatcttctgcaccacgcacctactggcctcccccaccaactgaatctgagagcaatggctacttgcgcgtccggtgcaatggtggcttgaaccacaacgtagtgcaatatgtaatgctgttgttgctgcacggatcatgaatgctacactggtgctgccagaanttagacacaattcattctggcatgatgaaagtggctttgtaggtatttatgatggtccccactttcatcagacactgaaatatgacgtccgaaatgttatgagcattccctgaatcactancaatggaangaccagaagctcaagggcagcagcttcggccaccagagatgcaccgtatcttgtatgcactgatgctttgagacnatgaaaagtatga

SEQ ID NO: 31139 - DNA, 723 bp, Zea mays
  misc_feature: Ceres CLONE 1407264-F
  misc_feature: Encodes the peptide sequence at SEQ ID NO. 31140
  misc_feature (521)..(521): n is a, c, t, g, unknown, or other
  misc_feature (617)..(617): n is a, c, t, g, unknown, or other
  misc_feature (618)..(618): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (675)..(675): n is a, c, t, g, unknown, or other
  misc_feature (708)..(708): n is a, c, t, g, unknown, or other
cgctctagaactagtggatcccccgggctgcaggaattcgcacgagaccattacctagaacatcctaatcgaaaaaaaccgatcgagcctcgacgagccagcagagaggactcatcctagctagctaagctgtccgacacagcacagcagaccgatacgacgatgatgagtagcaccggcggcgagagcaagctggagagcccgctgctgggcctgcccgcgccgggctcgtcggccggcagcgggcacagccacggcgaggcggtgagcgggcagctggagagcatcctcagcgacgcctccctgccgtggaggcagcggatgctgtcagcgtccatggttgagatgcggctgctcgtgcgcctggccgcgcccgccgtgctcgtctacatgatcaactacctcatgtccatgtccacgcagatcttctcgggacacctcggcacgctcgagctcgccgccgcgtcgctcggcaacaccggcatccaggtcttcgcctatggcctcatgctgggcatggngagcgcggtggagacgctgtgcgggcaggcgtacggcgcgcacaagtacgacatgctgggcatctacttgcagcgctccaccatcctgctgatggnncacgnnngtgcctctgaccgtgctctacgccttctcccgccccatctggtccttccntcgggagtcccccgagatcgcctcccgcgccgncgttcttcgtgtacg

SEQ ID NO: 31140 - protein, 187 aa, Zea mays
  misc_feature: Ceres CLONE 1407264-F
  misc_feature (120)..(120): Xaa is any aa, unknown, or other
  misc_feature (152)..(152): Xaa is any aa, unknown, or other
  misc_feature (154)..(154): Xaa is any aa, unknown, or other
  misc_feature (155)..(155): Xaa is any aa, unknown, or other
MMSSTGGESKLESPLLGLPAPGSSAGSGHSHGEAVSGQLESILSDASLPWRQRMLSASMVEMRLLVRLAAPAVLVYMINYLMSMSTQIFSGHLGTLELAAASLGNTGIQVFAYGLMLGMXSAVETLCGQAYGAHKYDMLGIYLQRSTILLMXHXXASDRALRLLPPHLVLPSGVPRDRLPRRRSSCT

SEQ ID NO: 31141 - DNA, 713 bp, Zea mays
  misc_feature: Ceres CLONE 1407266-F
  misc_feature: Encodes the peptide sequence at SEQ ID NO. 31142
  misc_feature (199)..(199): n is a, c, t, g, unknown, or other
  misc_feature (486)..(486): n is a, c, t, g, unknown, or other
  misc_feature (594)..(594): n is a, c, t, g, unknown, or other
  misc_feature (599)..(599): n is a, c, t, g, unknown, or other
  misc_feature (654)..(654): n is a, c, t, g, unknown, or other
gctctagaactagtggatcccccgggctgcaggaattcgcacgagaccattacctagaacatcctaatcgaaaaaccagtcagtccacacagcctacggcctgctctggctctgcctgtagagggctagacctacaagctacaactctgaaagtctgaacagtgcgccgcccaaccagagatggcgccgcataccaccngcagccgccggcggcggcggcggcgaggaggcgctggaggaggccagcactctccggcaccgccacagcgctgccaaggacggcggcgaggagggccaggccaacaacggggtcgccgccgccgccgacgacgacggggaggggaacgcgctgtcggtggagcgcgcgttcgcggaccaggcggttccgtcgtggcgggagcagctgacggtgcgcgccttcgtggtcagcttcttcctggccatcatgttcagcgtcatcgtgatgaagctcaacctcaccacggngatcatcccctcgctcaacgtctccgcggggctcctcggcttcttcttcgtacgcctctggaccgccgccatcgagagggttggcctcctcaggcagcccttcacgcngcagnagaacaccgtcatccagaactgcgtcgtcgcagcctacgactcgccttcagcggngggtttgggacatacttggttggcatgagcgaaaccatcgccagcaagcaacagagggt

SEQ ID NO: 31142 - protein, 78 aa, Zea mays
  misc_feature: Ceres CLONE 1407266-F
  misc_feature: The sequence is a functional homolog of SEQ ID NO 214 in the 10/412,699 US patent application
  misc_feature (14)..(14): Xaa is any aa, unknown, or other
  misc_feature (50)..(50): Xaa is any aa, unknown, or other
  misc_feature (52)..(52): Xaa is any aa, unknown, or other
  misc_feature (70)..(70): Xaa is any aa, unknown, or other
MFSVIVMKLNLTTXIIPSLNVSAGLLGFFFVRLWTAAIERVGLLRQPFTXQXNTVIQNCVVAAYDSPSAXGLGHTWLA

SEQ ID NO: 31143 - DNA, 735 bp, Zea mays
  misc_feature: Ceres CLONE 1407273-F
  misc_feature: Encodes the peptide sequence at SEQ ID NO. 31144
  misc_feature (624)..(624): n is a, c, t, g, unknown, or other
  misc_feature (625)..(625): n is a, c, t, g, unknown, or other
  misc_feature (724)..(724): n is a, c, t, g, unknown, or other
  misc_feature (725)..(725): n is a, c, t, g, unknown, or other
ggagctccccgcggtggcggccgctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggccgggacagctgactagctgagaggcatggggatggacgccggcggcggcaagctgccgtacagctacgccggccagcaggacggcgggaagctggtgaagagcgtcagccgcgtggagccgcgcaggttcggcctgggcctcgtggcgggcttcctcgtcgtcacctgcgcctacttctccaccgccaagttcgacgccatccagatcgccatgaccagccgacccgtctccagcaatgcggctgggcgtcggagtcggtcggctggggagtgggcgccgccgccgccgacacctccacgcctcnnagcagggattagatttgggcgcgatgtcatggccggagaagggagcgaggcccaagcgctcgagaagacggcggcaagcttcttcacttcggggccagnntccttggccg

SEQ ID NO: 31144 - protein, 130 aa, Zea mays
  misc_feature: Ceres CLONE 1407273-F
  misc_feature (94)..(94): Xaa is any aa, unknown, or other
  misc_feature (127)..(127): Xaa is any aa, unknown, or other
MGMDAGGGKLPYSYAGQQDGGKLVKSVSRVEPRRFGLGLVAGFLVVTCAYFSTAKFDAIQIAMTSRPVSSNAAGRRSRSAGEWAPPPPTPPRLXAGIRFGRDVMAGEGSEAQALEKTAASFFTSGPXSLA

SEQ ID NO: 31145 - DNA, 701 bp, Zea mays
  misc_feature: Ceres CLONE 1407274-F
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (397)..(397): n is a, c, t, g, unknown, or other
  misc_feature (398)..(398): n is a, c, t, g, unknown, or other
  misc_feature (403)..(403): n is a, c, t, g, unknown, or other
  misc_feature (404)..(404): n is a, c, t, g, unknown, or other
  misc_feature (407)..(407): n is a, c, t, g, unknown, or other
  misc_feature (408)..(408): n is a, c, t, g, unknown, or other
  misc_feature (413)..(413): n is a, c, t, g, unknown, or other
  misc_feature (415)..(415): n is a, c, t, g, unknown, or other
  misc_feature (417)..(417): n is a, c, t, g, unknown, or other
  misc_feature (421)..(421): n is a, c, t, g, unknown, or other
  misc_feature (422)..(422): n is a, c, t, g, unknown, or other
  misc_feature (424)..(424): n is a, c, t, g, unknown, or other
cgctctctacctagtggtcccccgggctgcaggaattcgcacgagaccattacctagaacatcctaatcgaaaaaaacaggcacaggctccctcctccactgtccagtgtccactcctcgtcccgagaagcagacaaagcgcggcgctgcagatttcggtacggttcccaatgcctcccatgcccgccgtcgtcccgtgctagcacccggcgccgctcctccacctgccgcgtcgcgccgcctggatccggcgggcacgtggctaggagcctcagatccgggcgaaacccagccttccgtgcggacgtcttcactctacctccagactggcggctgccatttccccccctcttcttgctgttttttttggtgggggtggggggtgnnnncnnncggnngggtnntgnngccgntngntggnngnggggggggtgtctctctttcttggcggctgggtctgcctcttgcccccttcgctgcgtcgcgctgttgcgtgggtcggtgttttgcgccgtcgcgtgtggtcccgtcccttgtcggggccgtcccgggggtctccccgcgccccggcgtgcttggtttccgcccgccgttttcttggctcttcgcgccgctccgcccggttttctcttcctccgcgtccggcccccggcccctggttccgcccctcgtgtggttgcgttctctcccccccgcccctg

SEQ ID NO: 31146 - DNA, 667 bp, Zea mays
  misc_feature: Ceres CLONE 1407278-F
  misc_feature: Encodes the peptide sequence at SEQ ID NO. 31147
gctctccaactagtggatcccccgggctgcaggaattcgcacgagaccattacctagaacatcctaatccaaaagaaataaaggactatctcagcgatttccgaaccctccccacccccacacccacccgatccaaccgagtcccggcggcgatggcggcggcggcgacgaacgccgatgtggaggtggtcgacttcgacctcgatgacgacgacctcatggacgaggacgccgggccggatccagcaccgccccccgcctcccgcctccgctccaccatcgcgggcgacgacgcgccgcgtaggaccaagggccgcggcttccgcgaggaccctaactcctccgcgacccgcgactcgcgctttggcgcggggggacgcgccgacctcgactcgcttggcggccctggacccatccagtgtacgtctacccttctctttcaatttttttctcaaagatttgcttgaaccgattattattttcttttggcaacgtagtactgaggctgaggcaagtaatacttcgttttgggtgactgaatgcctatgtagttagtatttgtgctgcctagacatattgccttctctgtgtgatttgcggatatggggtattccaacaactgaacaacctaaagatttcgcatgtatcggttagtttcatggcggac

SEQ ID NO: 31147 - protein, 104 aa, Zea mays; identical to SEQ ID NO: 26881
  misc_feature: Ceres CLONE 1407278-F

SEQ ID NO: 31148 - DNA, 692 bp, Zea mays
  misc_feature: Ceres CLONE 1407280-F
  misc_feature: Encodes the peptide sequence at SEQ ID NO. 31149
  misc_feature (486)..(486): n is a, c, t, g, unknown, or other
tcaccgcggtggcggccgctctacaactagtggatcccccgggctgcaggtattcgcacgagaccattacctagaacatcctaatcgaaaagttccgcttcgtcccagcctctagttcttcctttcctccagagtgatggccaaatgctactcagattggcccccgattccgcctttccatccatcgcgaagaacgccgccgcaatcccacgcctccccgatcacgatcaggcggcagctcgcgtccttcgtgctccactgctccagatcctgcgctcccctcctcgagcccaagaacctgcccgatgagttcgaggccgtaccggcgacgccgccgccgccgctgccggacgccgccccgaagctggggatttctaacaagttcatccgaggcctctgcggtgacccgcagaccgagcagctggccttcgagggctacaggagggcgctgctgcagcccgagttccggctggagaagaagacggncaacgcgctgaccctgcagctgatcagggagaagcagtggggctccctggagctgctggtcgaggacttcagggcccacggcgtgctcccggagaagcggacgtgcgcgcggctcggtcgctgctgcatcagggcggggaagttcggcctcgccgagcgggtgttcggggccctcaaggggaaaaaggagcccccgctgccatgcc

SEQ ID NO: 31149 - protein, 185 aa, Zea mays
  misc_feature: Ceres CLONE 1407280-F
  misc_feature (117)..(117): Xaa is any aa, unknown, or other
MAKCYSDWPPIPPFHPSRRTPPQSHASPITIRRQLASFVLHCSRSCAPLLEPKNLPDEFEAVPATPPPPLPDAAPKLGISNKFIRGLCGDPQTEQLAFEGYRRALLQPEFRLEKKTXNALTLQLIREKQWGSLELLVEDFRAHGVLPEKRTCARLGRCCIRAGKFGLAERVFGALKGKKEPPLPC

SEQ ID NO: 31150 - DNA, 698 bp, Zea mays
  misc_feature: Ceres CLONE 1407286-F
  misc_feature: Encodes the peptide sequence at SEQ ID NO. 31151
tccccgcggtggcggccgctctagaactagtggatcccccgggctgcaggaattcgcacgagaccattacctagaacatcctaatcgaaaacctttcgggcagaaagagccagagagagagagagagagaggtcggggctggggagcacacacccatcacccatggcctgactgacctccggactctccctgcttccgtcgccgccgcgggccgcccagctgactgctcctgccctccgcccgccctccatggcgtccgtcaagctcggctccaagcctgacgccttcaagcggcaaggccaggcatggttctgcacaacaggacttcctagcgatgtcaccgttgaggttggggatatgtctttccaccttcacaagttccctttactttcaaaaagtgcctttcttgaacggtcaattgaagaaaattctgaccaagaagaatgcatcatcaaactaaatgacattcctgggggtgccaagtcatttgagctagttgcaaggttctgctatggtgtgaaaatagagctttcacctgcaaatgttgtctacctacggtgtgcctcagagcatctagaaatgactgaagaagtagctgaggaaaacctgattgcacagtcagaaatgttcctcaaccaagtggttctccgtaactggaaagattccttggcagcattggaaacatgtgatgacctact

SEQ ID NO: 31151 - protein, 149 aa, Zea mays
  misc_feature: Ceres CLONE 1407286-F
  misc_feature (23)..(124): Pfam Name: BTB Pfam Description: BTB/POZ domain
MASVKLGSKPDAFKRQGQAWFCTTGLPSDVTVEVGDMSFHLHKFPLLSKSAFLERSIEENSDQEECIIKLNDIPGGAKSFELVARFCYGVKIELSPANVVYLRCASEHLEMTEEVAEENLIAQSEMFLNQVVLRNWKDSLAALETCDDL

SEQ ID NO: 31152 - DNA, 710 bp, Zea mays
  misc_feature: Ceres CLONE 1407288-F
  misc_feature: Encodes the peptide sequence at SEQ ID NO. 31153
  misc_feature (408)..(408): n is a, c, t, g, unknown, or other
  misc_feature (409)..(409): n is a, c, t, g, unknown, or other
  misc_feature (415)..(415): n is a, c, t, g, unknown, or other
gctctagaactagtggatcccccgggctgcaggaattcgcacgagaccattacctagaacatcctaatcgaaaaaaaccctaaccccatcccgcactccccccctcccccaacacgcgcgtgctttcttagccgctaagcatatccctccccgccacgatctcgatggtggagatgtctgtggtggagctcaggacgctgccgctcggcttccgcttccaccccaccgacgaggagctcgtcacccactacctcaagggcaagatcaccggcaggatcaactccgagtccgaggtcatccccgagatcgacgtctgcaagtgcgagccgtgggacctcccagataagtccctgatccggtccgacgatcctgagtggttcttcttcgccccccaggacccgcagtacnnccacgntagcaggtcgaacagggccaccgaggcgggatactggaaggctactggcaaggacaggataatcaatccaaggcggacaggcgcagcagcataccatcggtatggagagaccctcggctcccaccgggtcggggccccaaggcaaggggacgggtgggattttgcccgaatacccgaccaccgaccctgattcaagtcggggaacaggggggttaggttttttatcccctttcccgaacaaaagggaaaaattgggccttccccccaagaggaaggggaaaagggggctccccct

SEQ ID NO: 31153 - protein, 146 aa, Zea mays
  misc_feature: Ceres CLONE 1407288-F
  misc_feature (12)..(128): Pfam Name: NAM Pfam Description: No apical meristem (NAM) protein
  misc_feature (82)..(82): Xaa is any aa, unknown, or other
  misc_feature (84)..(84): Xaa is any aa, unknown, or other
MVEMSVVELRTLPLGFRFHPTDEELVTHYLKGKITGRINSESEVIPEIDVCKCEPWDLPDKSLIRSDDPEWFFFAPQDPQYXHXSRSNRATEAGYWKATGKDRIINPRRTGAAAYHRYGETLGSHRVGAPRQGDGWDFARIPDHRP

SEQ ID NO: 31154 - DNA, 750 bp, Zea mays
  misc_feature: Ceres CLONE 1407293-F
  misc_feature: Encodes the peptide sequence at SEQ ID NO. 31155
  misc_feature (432)..(432): n is a, c, t, g, unknown, or other
  misc_feature (468)..(468): n is a, c, t, g, unknown, or other
aagagctggagctccccgcggtggcggccgctctagaactagtggatcccccgggctgcaggaattcgcacgagaccattacctagaacatcctaatcgaaaactaacctctttgcgcaaaaaaccccactccggcagctcaaaaccccaatcttccccggcctccccacccaaccctagcaccagaacacccgatgcggcatctgaagcgcggccgtggcggctttgaccccggcgacgcggtggttctcgacgtcgtggggctaggggagttcgcgcggttgtccctccctgagcccccgcccgacgagcttgggctatccgccgcctacgacgacgcttcaggcacgcattatggtttctatctgcgggtgacgctgtctctgcctcccccgccggaacctcgcggtcgccctcggggctgccgctgtngcccggtcggactctctcgcgggtatgggcatgagntctgtgctctccacgcacggatggcgatcggagaccgatgagaaggtttgtgctgcgatcgcgtgcttgctgcagatgtattcagagagcaggctttaccatcgtgcgatgggaggtcgctgcctgggttaaggcttgcaagaagtagaggcaaggagtacgtaggccaacatggactcgggttgattgtgcacaacggtgaaaaagggaaggtagtaccttgcaacgacacggcgaaaccgcaccgtaccttcccccagctgaagggggcggcaaaaggcc

SEQ ID NO: 31155 - protein, 104 aa, Zea mays
  misc_feature: Ceres CLONE 1407293-F
  misc_feature (80)..(80): Xaa is any aa, unknown, or other
  misc_feature (92)..(92): Xaa is any aa, unknown, or other
MRHLKRGRGGFDPGDAVVLDVVGLGEFARLSLPEPPPDELGLSAAYDDASGTHYGFYLRVTLSLPPPPEPRGRPRGCRCXPVGLSRGYGHEXCALHARMAIGDR

SEQ ID NO: 31156 - DNA, 682 bp, Zea mays
  misc_feature: Ceres CLONE 1407295-F
  misc_feature: Encodes the peptide sequence at SEQ ID NO. 31157
aaagctggagctccccgcggtggcggccgctctagaactagtggatcccccgggctgcaggaattcgcacgagaccattacctagaacatcctaatcgaaaagatttcttcttcccatctcccgatccatcgtaacccaaaccctactccaggcagatctccgtctccgccgacgctgccggcgtgagcacagcatcagatccgctgtgatggcgttccgccgcatcctatccaccgcggtgcgccgccgctcggccgtggccgccgcggcggccgggaacgcgcgcgaggcctccacggccgtcgctgcggcgccaggtgtgctcgcccccgatgcgaccgcggtgcgcgctcccgtgatgccgtatgaccgcatcgccgaggccgtcaacgccaggctccggcggctcgagcacccagacccgcgcttcctccgctacgccagccccgtgccgtcccacgcggaccacatggccatccttgcggcgccagagacccgggtcaccacactgcccaacggcctgcgcatcgtcacggagtcttccctcgccgcgcgcacggctacggtcggcgtgtggatcgatgcgggcagcaggtacgagaacgaggagggggtcggcgtcccgcattttgtcgagcacatgctgttcaaggacaaggggaaacgcatcgccgcggcacg

SEQ ID NO: 31157 - protein, 157 aa, Zea mays
  misc_feature: Ceres CLONE 1407295-F
  misc_feature: SWISSPROT Homolog: EC 3.4.24.64 Mitochondrial processing peptidase
MAFRRILSTAVRRRSAVAAAAAGNAREASTAVAAAPGVLAPDATAVRAPVMPYDRIAEAVNARLRRLEHPDPRFLRYASPVPSHADHMAILAAPETRVTTLPNGLRIVTESSLAARTATVGVWIDAGSRYENEEGVGVPHFVEHMLFKDKGKRIAAA

SEQ ID NO: 31158 - DNA, 689 bp, Zea mays
  misc_feature: Ceres CLONE 1407296-F
  misc_feature: Encodes the peptide sequence at SEQ ID NO. 31159
  misc_feature (222)..(222): n is a, c, t, g, unknown, or other
  misc_feature (437)..(437): n is a, c, t, g, unknown, or other
aaagctggagctccccgcggtggcggccgctctagaactagtggatcccccgggctgcaggaattcgcacgagaccattacctagaacatcctaatcgaaaaatggcatctgcattgcagttgcagccacgccaacaactgggcagcggcgacatctgcatctcccacctcgtctccctcccgtatctgcaagccttgatcccgccgccagccatccatccnagggagccatgtctccatccggcgagctgctggcttccatctcctccgtcttcactgtcgccttcgtcctcctcgcctgcgtcgagctcggcgacgccgccgccgccgccgtcggcgtctaccgcctcatccagtacgacctcgccggcgctccgctcggctcccgcgccgcggtcctcaaccaccacgctgccgcgctcccgctccccgccggngcagacctctcccgctccgccctcgtcgcgccgctccttgacctcccgctctctttcctcagagagtacctggtggagaaaaacatctggggggattactcattctgctcccgacaaataatgacagtgtggatgacaaggggcaattcaaaggtgtactgactgaacttggagaagttgcttctgcatgaaacagtttcatatccgggggactttgcttttgatgacgacaatcttgataacctgctggca

SEQ ID NO: 31159 - protein, 122 aa, Zea mays
  misc_feature: Ceres CLONE 1407296-F
MSPSGELLASISSVFTVAFVLLACVELGDAAAAAVGVYRLIQYDLAGAPLGSRAAVLNHHAAALPLPAGADLSRSALVAPLLDLPLSFLREYLVEKNIWGDYSFCSRQIMTVWMTRGNSKVY

SEQ ID NO: 31160 - DNA, 742 bp, Zea mays
  misc_feature: Ceres CLONE 1407298-F
  misc_feature: Encodes the peptide sequence at SEQ ID NO. 31161
  misc_feature (377)..(377): n is a, c, t, g, unknown, or other
  misc_feature (378)..(378): n is a, c, t, g, unknown, or other
  misc_feature (470)..(470): n is a, c, t, g, unknown, or other
  misc_feature (510)..(510): n is a, c, t, g, unknown, or other
  misc_feature (526)..(526): n is a, c, t, g, unknown, or other
  misc_feature (552)..(552): n is a, c, t, g, unknown, or other
  misc_feature (717)..(717): n is a, c, t, g, unknown, or other
  misc_feature (724)..(724): n is a, c, t, g, unknown, or other
  misc_feature (725)..(725): n is a, c, t, g, unknown, or other
  misc_feature (738)..(738): n is a, c, t, g, unknown, or other
aaagctggagctccccgcggtggcggccgctctagaactagtggatcccccgggctgcaggaattcgcacgagaccattacctagaacatcctaatcaaaaacttcccgttccccaattcgaaatcgagtcgggtactcgggtcggtcttgccgtgcgtgcgtggctgcgcgaaccagcccacgctcccactccccgcccgccaccgccgggtccctctagggttttgccgcgatgtcgctccggccgagcgagcgggagcagatgcggaagggcaactacaagcagacggtggacgccgaggagagccgccgccgccgcgagggccagatggtcgacatccgcaaggccaagcgagaggaaagcctccagaagaanncgccgcgatgggtcccccgccggccggcgccgttggcccgccgatgggccactccaccgcactccagagaaaagctcgatggcttggccggngatgggtacagggccgttcactccaacgaccccactgtgncagcttgagccccacnaacgcagttttcaggaagctgctctnccaatagagcgtagtcccccaaatttgaaagaggtgaccagcaaccaggagtcgtgccccgaattcattgagttcccttacacgtgaggaccatccacaactccccgtttgagggctgcatgggcgctcaccaacattgcatcaggcactcaagaaacttaaaangtgtggnnttaaaaaaagtgnggct

SEQ ID NO: 31161 - protein, 94 aa, Zea mays
  misc_feature: Ceres CLONE 1407298-F
  misc_feature (4)..(90): Pfam Name: IBB Pfam Description: Importin beta binding domain
  misc_feature (48)..(48): Xaa is any aa, unknown, or other
  misc_feature (49)..(49): Xaa is any aa, unknown, or other
  misc_feature (93)..(93): Xaa is any aa, unknown, or other
MSLRPSEREQMRKGNYKQTVDAEESRRRREGQMVDIRKAKREESLQKXXPRWVPRRPAPLARRWATPPHSREKLDGLAGDGYRAVHSNDPTVXA

SEQ ID NO: 31162 - DNA, 699 bp, Zea mays
  misc_feature: Ceres CLONE 1407302-F
  misc_feature: Encodes the peptide sequence at SEQ ID NO. 31163
  misc_feature (580)..(580): n is a, c, t, g, unknown, or other
aaagctggagctccccgcggtggcggccgctctagaactagtggatcccccgggctgcaggaattcgcacgagaccattacctagaacatcagctcaacagccaccggagagcacggaggaaaagcatctccaaaaaccctagctcccatcccctcgctgggaagtctcgtcggcggcggcggcggagatgggcaaggcgaaggggaagcagcgtcaggacaagttctaccacctcgccaaggagcaagggtaccggagtcgcgcggcgttcaagctgctccagctcgacgcgcggttccgcttcctcccgacggcgcgctcggtgcttgacctctgcgccgcgccgggagggtgggtccaggtggccgtcaaccatgctcccgtgggtgccttcgttgtcggcgttgacctcgttcccatacgccccatccgcggggcccactcgctcaccgaggacatcaccgccaccaagtgccgcgccgcggtgcggaggctcatggactcccacggcgtctccgcttttcgacgtcgtgctccacgacgggtcgcccaacgtcggtggtgcctgggcgcaggagnctacatcgcagtcggcgctcgtcatagacgcactgcgcctcgctaccatggtcctcgctcccagggcgctttcatcacgaaaggttttttagtctcaagatacaacgttattatgactg

SEQ ID NO: 31163 - protein, 170 aa, Zea mays
  misc_feature: Ceres CLONE 1407302-F
  misc_feature (22)..(162): Pfam Name: FtsJ Pfam Description: FtsJ-like methyltransferase
  misc_feature (131)..(131): Xaa is any aa, unknown, or other
MGKAKGKQRQDKFYHLAKEQGYRSRAAFKLLQLDARFRFLPTARSVLDLCAAPGGWVQVAVNHAPVGAFVVGVDLVPIRPIRGAHSLTEDITATKCRAAVRRLMDSHGVSAFRRRAPRRVAQRRWCLGAGXYIAVGARHRRTAPRYHGPRSQGAFITKGFLVSRYNVIMT

SEQ ID NO: 31164 - DNA, 708 bp, Zea mays
  misc_feature: Ceres CLONE 1407304-F
  misc_feature: Encodes the peptide sequence at SEQ ID NO. 31165
aaagctggagctccccgcggtggcggccgctctagaactagtggatcccccgggctgcaggaattcgcacgagaccattacctagaacatcctaatcgaaaaaatcacgagaagggcgccgatctgggaaggcattgtcttgttgtactttcccttccggcagtggcctcgattcgcatccccttttcccgtccatgcgcgcgccggcgggcggtgccagtgccaccgcgctcgcggcggccatgaacattaagcagccgctgcacggcgcatcgacgctgttcgcgctgctctctctctcgctgctcctcctccgcctgctcctccgcctccgcctggccgccttccgcgacgcggcgctgtcgctccacctgctggcgcgcctccgcctccgccccgtcctcctctgcctcccggcagcctgccacgacggcggcgccggcgccggcgccaccacgctgcgcgtctggtgccccgccaccccatcctccaagccgccgctgctcctcctccacggcttcggcggggacgccaagtggacgtgggcgcgcaacctcccgcgcctgtcccgccactttcacgtgtacgcgtcggacctcgtggtctttcgcgcgcagtcccggtccgcgtcgctgctgcgcctcgtgggcgtaccagcccgctgcgacgccgaggccatgcgccctctcggcgtggcccgctacgacg

SEQ ID NO: 31165 - protein, 171 aa, Zea mays
  misc_feature: Ceres CLONE 1407304-F
MRAPAGGASATALAAAMNIKQPLHGASTLFALLSLSLLLLRLLLRLRLAAFRDAALSLHLLARLRLRPVLLCLPAACHDGGAGAGATTLRVWCPATPSSKPPLLLLHGFGGDAKWTWARNLPRLSRHFHVYASDLVVFRAQSRSASLLRLVGVPARCDAEAMRPLGVARYD

SEQ ID NO: 31166 - DNA, 642 bp, Zea mays
  misc_feature: Ceres CLONE 1407308-F
  misc_feature: Encodes the peptide sequence at SEQ ID NO. 31167
  misc_feature (546)..(546): n is a, c, t, g, unknown, or other
  misc_feature (636)..(636): n is a, c, t, g, unknown, or other
tggagctccaccgcggtggcggccgctctagaactagtggatcccccgggctgcaggaattcgcacgagaccattacctagaacatcctaatcgaaaagtttttcctgatctcgcctcccgagccacacacgttgccgccgtgagccgccgcccacaaggctaagcaccaaccatggccttcggagctctcgtcacgtcgaggctggccaggtccggccgcacccttgcatctgccgttgcccagggtcccgttgcccagcggatagcacctcctctgctctccaggcttggagcagtagctcgtcttctcagcacaaagccagccgcaacagatgtcatcggtatcgatctaggcactacgaattcctgcgtctccgtcatggaaggaaagacaccacgggtgattgaaaatgcagaaggcgcgaggacgacaccctccattgttgccaagaatcagaatggtgacctgttgattggtatcacagcgagccggcaggcagtaaccaatgcccagaacacaatccgtggggtcaaagcgtcttatncggtaggacttttgatgaccacagaccagaaagagatgaagatggtgcctttacagatgtcaagggcgcgaatgggtgatgctgggtccnaaatgg

SEQ ID NO: 31167 - protein, 156 aa, Zea mays
  misc_feature: Ceres CLONE 1407308-F
  misc_feature (125)..(125): Xaa is any aa, unknown, or other
  misc_feature (155)..(155): Xaa is any aa, unknown, or other
MAFGALVTSRLARSGRTLASAVAQGPVAQRIAPPLLSRLGAVARLLSTKPAATDVIGIDLGTTNSCVSVMEGKTPRVIENAEGARTTPSIVAKNQNGDLLIGITASRQAVTNAQNTIRGVKASYXVGLLMTTDQKEMKMVPLQMSRARMGDAGSXM

SEQ ID NO: 31168 - DNA, 687 bp, Zea mays
  misc_feature: Ceres CLONE 1407314-F
aaagctggagctccccgcggtggcggccgctctataatagtggatcccccgggctgcaggaattcgcacgagaccattacctagaacatcctaatcgaaaagttttctcagtctcctccttctccacgcacgtcatctcctaactccccagccgctccctctagccctcatctcgtcggacctggctgctggtcgtcgtcgggcgcgagctctccaacacaggccggcttcctcttcctcccctgcccaagctctccactcgacgcctaggtatccatggcgtctcctccccttcctttactctgccatggacgcgagttccaagctcctgctcgtccaggcccccttcccaggcgcccctgcagagcccctggccgagcttccccatggtgtctcccccaactatggcgccctctgctcctccaagccggtgacccctcctctctggttctgcgcagggaactccctccatggctggcgtccctgtgctcgcgcccttgatccccatgcccgagctcctctccatcgtctttagctcgccatgggacagcgccactgtcaaatccggtctccagctcaccagcaacttcccccttccttgcccttgcacacctctggtgcagccctttccctggtgctcgatgaaatggccatggggagctttttattgggggagccccttctgca

SEQ ID NO: 31169 - DNA, 750 bp, Zea mays
  misc_feature: Ceres CLONE 1407317-F
  misc_feature: Encodes the peptide sequence at SEQ ID NO. 31170
  misc_feature (407)..(407): n is a, c, t, g, unknown, or other
  misc_feature (501)..(501): n is a, c, t, g, unknown, or other
aaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcgggtgtcgacggcctcccgccggggcctccgggttggcccggtggtgggggacctggttccaggtgatcctgcagcgacggcccttcattgtacgntggtgcgcgacctcccgggaggaaggacgggccccatcttcaccatgtcgggatgggggcagccacccctccttcgtggtcacccttcggcggnagctcatccaccgagggcgcttggtggaagcaaaggcccccatgggtcgcgaggcgggccccgaagaacaggcccaccccgcctccttctttagggggcggaaagttgcaacggtcaacttcggcgcctacgggcccccctgtggggggggttctgggccgcaacttcgtcgcccgagaattgtgtgccccggaccggggtcaagggcttctcctggaatatcggggaaggggcccccgggaacccccc

SEQ ID NO: 31170 - protein, 173 aa, Zea mays
  misc_feature: Ceres CLONE 1407317-F
  misc_feature (91)..(91): Xaa is any aa, unknown, or other
MDVNDVLLVVLAAALAAMWWRRCSKTGGCRRPPAGASGLARWWGTWFQVILQRRPFIVRWCATSREEGRAPSSPCRDGGSHPSFVVTLRRXLIHRGRLVEAKAPMGREAGPEEQAHPASFFRGRKVATVNFGAYGPPCGGGSGPQLRRPRIVCPGPGSRASPGISGKGPPGTP

SEQ ID NO: 31171 - DNA, 705 bp, Zea mays
  misc_feature: Ceres CLONE 1407318-F
  misc_feature: Encodes the peptide sequence at SEQ ID NO. 31172
  misc_feature (585)..(585): n is a, c, t, g, unknown, or other
aaagctggagctccccgcggtggcggccgctctagaactagtggatcccccgggctgcaggaattcgcacgagaccattacctagaacatcctaatcaaaaaaccacgcctgttctcagtcacgctagtagtaggaaatcctagcgcgtcgctgcttccattaccgcctccgcaaccagcccgccgcgcccccgagcgtttcgttccgggagcggcaagactgtgacacgccagccctttatttcgagctttctgcgtgcgggaggggggttgacaggcgatggcggccgagggcgaggcgggggcgctggagttcacaccgacgtggatcgtcgcggcggtctgctctctcatcgtgctcctctcgctcgtcggcgagcgatgcctccactacctcggcaagacgctcaagaggaagaaccagaagccgctcttcgaggcgctgctcaaggtcaaagaagagttgatggcttctggggttcatctccctgctgctgacggtgttccagggggatgatccggaggacgtgcatccctgaacgctggacattccacatgctgccatgcgagaagccagatgagaanggccgctgaggccgccaccatggagcattttgtaggtacgcttggcaggatcggtaggcgtctggtgcatcaaggcactggctggggctgagcaatgcgaaaaaaaggaaaagttcccat

SEQ ID NO: 31172 - protein, 78 aa, Zea mays
  misc_feature: Ceres CLONE 1407318-F
MAAEGEAGALEFTPTWIVAAVCSLIVLLSLVGERCLHYLGKTLKRKNQKPLFEALLKVKEELMASGVHLPAADGVPGG

SEQ ID NO: 31173 - DNA, 680 bp, Zea mays
  misc_feature: Ceres CLONE 1407320-R
  misc_feature (680)..(680): n is a, c, t, g, unknown, or other
cgattgggtaccgggccccccctcgaggtcgacttctcaataagcttttttttttttttttttaacatgataaacaaaatcaacaatcatatggacatgttaagtcatccaagagctgcagcgaacatctcataggtttatttgcagcactggctgcttagaatttacaaagaccgcagtgacatggcttaacttagagtaagcaatgcgaaggaaaaaagaattaggataagaatcgatcctacgttcctctaaccatttatgtgcccaccaggtaactcttgaaattcctgctctatcgagaagctcattccacctcaaggacaaaaattatcaaatactgcacaaaacaatcagaaataggaaaatcttctacggttctacttttgtaaaagatttacatgaattctaagcctttcctttccttttagcatctagagcctttttctgaaaagttctcatgactaatacgattagatcacgtaacctaacatcgtaatcctcattgtttggctctgatattccctgtgtgttaaatggaagagttgtacccgcagttattaaaacaaactgagttgtgcgcccatttggaatttttgtctgtagactttgtgagtacttctcgtcaattacaacattaccggtctgtttgaacttaatctgataattaggtcgtgtgn

SEQ ID NO: 31174 - DNA, 820 bp, Zea mays
  misc_feature: Ceres CLONE 1407320-R3
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
nnnnnngggcgggtgagatatcacaatcatatggacatgttaagtcatccaagagctgcagcgaacatctcataggtttatttgcagcactggctgcttagaatttacaaagaccgcagtgacatggcttaacttagagtaagcaatgcgaaggaaaaaagaattaggataagaatcgatcctacgttcctctaaccatttatgtgcccaccaggtaactcttgaaattcctgctctatcgagaagctcattccacctcaaggacaaaaattatcaaatactgcacaaaacaatcagaaataggaaaatcttctacggttctacttttgtaaaagatttacatgaattctaagcctttcctttccttttagcatctagagcctttttctgaaaagttctcatgactaatacgattagatcacgtaacctaacatcgtaatcctcattgtttggctctgatattccctgtgtgttaaatggaagagttgtacccgcagttattaaaacaaactgagttgtgcgcccatttggaatttttgtctgtagactttgtgagtacttctcgtcaattacaacattaccggtctgtttgaacttaatctgataattaggtcgtgtgagcaccaatgtagccagttcccattcctcaggagaataagcctgcaggacaaaaacttcaaattcagctctccctttagaaatacatgcatcgatatgactctgcatctctggatcacatgttatcttattcccattattagcaaattctgtcaccaaatcaccctggcggccattgtcatccataggcgtacagtctacc

SEQ ID NO: 31175 - DNA, 825 bp, Zea mays
  misc_feature: Ceres CLONE 1407320-R2
gggttttttccgattgggtaccgggccccccctcgaggtcgacggtatcgataagcttttttttttttttttttaacatgataaacaaaatcaacaatcatatggacatgttaagtcatccaagagctgcagcgaacatctcataggtttatttgcagcactggctgcttagaatttacaaagaccgcagtgacatggcttaacttagagtaagcaatgcgaaggaaaaaagaattaggataagaatcgatcctacgttcctctaaccatttatgtgcccaccaggtaactcttgaaattcctgctctatcgagaagctcattccacctcaaggacaaaaattatcaaatactgcacaaaacaatcagaaataggaaaatcttctacggttctacttttgtaaaagatttacatgaattctaagcctttcctttccttttagcatctagagcctttttctgaaaagttctcatgactaatacgattagatcacgtaacctaacatcgtaatcctcattgtttggctctgatattccctgtgtgttaaatggaagagttgtacccgcagttattaaaacaaactgagttgtgcgcccatttggaatttttgtctgtagactttgtgagtacttctcgtcaattacaacattaccggtctgtttgaacttaatctgataattaggtcgtgtgagcaccaatgtagccagttcccattcctcaggagaataagcctgcaggacaaaaacttcaaattcagctctccctttagaaaatacatgcatcgatatgactctggcatctctgggatcacatgtttatcttata

SEQ ID NO: 31176 - DNA, 708 bp, Zea mays
  misc_feature: Ceres CLONE 1407322-F
  misc_feature: Encodes the peptide sequence at SEQ ID NO. 31177
  misc_feature (708)..(708): n is a, c, t, g, unknown, or other
aagctggagctccccgcggtggcggccgctctagaactagtggatcccccgggctgcaggaattcgcacgagaccattacctagaacatcctaatccaaaaactagccaccgcatcgtcgccctcaaattctttccgtccaggcgaggaagaaatcgagcagcccaggagaggagaagatggctcgtacgaagcagaccgcccgcaagtccaccggaggcaaggccccgcgcaagcagctcgccaccaaggtggcgaggaagtctgcgccgactaccggcggcgtgaagaagccccacaggtacagggccgggacggtggctctgcgcgatatccgcgagtaccagaagagcacggagctgctgatccggaagttgcccttccagcgcctgggccgtgagatcgctcaggacttcaagacggatctgcggttccagagccacgccgtcctggccctccaggaagccgccgaggactacctcgtcggcctgttcgaggacaccaatctctgcgtcatccacgccaagcgtgtcatcgtcatgcccatagacatcaggctcgtccggcgcatccgtgatgagtgcgcgtaggcgtatctcgcgcccggtgctagtggtgatgaagtcatgcaggagttgcatttgtaaccttatgctgattgttcgctaatagacggcgagcaggacaactattgtatgatcggctatan

SEQ ID NO: 31177 - protein, 136 aa, Zea mays
  misc_feature: Ceres CLONE 1407322-F
  misc_feature (58)..(132): Pfam Name: Histone Pfam Description: Core histone H2A/H2B/H3/H4
MARTKQTARKSTGGKAPRKQLATKVARKSAPTTGGVKKPHRYRAGTVALRDIREYQKSTELLIRKLPFQRLGREIAQDFKTDLRFQSHAVLALQEAAEDYLVGLFEDTNLCVIHAKRVIVMPIDIRLVRRIRDECA

SEQ ID NO: 31178 - DNA, 756 bp, Zea mays
  misc_feature: Ceres CLONE 1407323-F
caagctggagctcaccgcggtggcggccgctctagaactagtggatcccccgggctgcaggtattcgcacgagaccattacctagaacatcctaatcgaaaagaaattttaacttgttgcttctctccctcttctgttctgtctcgtccccttcacgaatcacgacagtattgaagcaattcctgattgctgatcctccacaatttctcccgtggattggagcgatctgaattggatccgtttactgctgacatgacgctaactgaccgtctctatcttgaaatcggaaggtcctaccagaagcccatgaacggaacaaactccaccaactccccttgcccgagacataatctggagcatttttctcccaacctactccccacacccccagggtatcatcacccatcgatacgcagtctacctccaacaaaaaattagccactcaccatccatcattactacccccccccaaccctcaatgacggctcccgctctcttatccgccaccccacgcccccccgcctcttcttcagatgctccacccaatcccccctaacacccattttcaatcatccctctctaatataggccctcatatcaactccccccctccgcctctcatttctttctctccttttcccgtctcccatcacaaaaccccacccccttttacttatatccccatccctttgtttccaaccctcatatcctcacccaaaattattactcgcacgctcaacccatataacaaccccc

SEQ ID NO: 31179 - DNA, 716 bp, Zea mays
  misc_feature: Ceres CLONE 1407324-F
  misc_feature: Encodes the peptide sequence at SEQ ID NO. 31180
  misc_feature (352)..(352): n is a, c, t, g, unknown, or other
  misc_feature (497)..(497): n is a, c, t, g, unknown, or other
  misc_feature (540)..(540): n is a, c, t, g, unknown, or other
  misc_feature (564)..(564): n is a, c, t, g, unknown, or other
  misc_feature (608)..(608): n is a, c, t, g, unknown, or other
  misc_feature (663)..(663): n is a, c, t, g, unknown, or other
  misc_feature (698)..(698): n is a, c, t, g, unknown, or other
aaagctggagctccccgcggtggcggccgctctagaactagtggatcccccgggctgcaggaattcgcacgagaccattacctagaacatcctaatcaaaaaaagaagagccgccctacctattccttctcccagccgtcgagctgcccaacccagagcaccagcagccctcaccttcttcctctcggccggtccttcaaacgagcccgctcgtcttggagccgccgccggtctcgttctggacgaacgttcaaggagattgcatttgtggatgctctaatggagtcgaaaggtggcaagaagtctagtagtagtagtagtaatttcatgtacgaagctccccttggctacnagatcgaggacgttcgcccagccggaggaatcaagaagttccagactgctgcttattccaactgcgtccgccagccatcctgatatcgcctcacatgcaattcgcggtagagtaggattttaattcagttttcctcttgtgtcgntagtttttccgttggctctggctgccttcctctgcttctgagnatccaacttgtcttgcccatctcntcttttcctctctcatcctctctttcttgcacacgtctccccangggccgatgtcttcagcaggattcttgtgtctcttctcctgcctcccctattggnctttgagggctatgagaggcgcctcgagatcacgntctctgacgcgcctgtct

SEQ ID NO: 31180 - protein, 51 aa, Zea mays; identical to SEQ ID NO: 25716
  misc_feature: Ceres CLONE 1407324-F
  misc_feature (1)..(51): Pfam Name: AdoMetDC_leader Pfam Description: S-adenosyl-l-methionine decarboxylase leader peptide
  misc_feature (25)..(25): Xaa is any aa, unknown, or other

SEQ ID NO: 31181 - DNA, 710 bp, Zea mays
  misc_feature: Ceres CLONE 1407325-F
  misc_feature: Encodes the peptide sequence at SEQ ID NO. 31182
  misc_feature (481)..(481): n is a, c, t, g, unknown, or other
  misc_feature (486)..(486): n is a, c, t, g, unknown, or other
  misc_feature (487)..(487): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (510)..(510): n is a, c, t, g, unknown, or other
  misc_feature (699)..(699): n is a, c, t, g, unknown, or other
tggagctccccgcggtggcggccgctctagaactagtggatcccccgggctgcaggaattcgcacgagaccattacctaaaacatcctaatcgaaaaatcacaagcaatcgatagagctagcatggcggtgaaggtgtgggtgttcgccgtggctctgatgatgtgcgctggtgtacggcttggagctgacgacgacggcggcagccgccttattagccgctgtcgtctgagctcgcccaactaccgcggcgccctggcaaaggccatcctcttcttcgaggggcagcggtcggggcggctgccggcaaaccagagagtcaggtggcgcggggactcggcgctcaccgacggccaacccgaaaacgtgaacttgacgggtggctactacgacgccggagacaacgtcaagttcggtttcccgatggcgttcagcgtcaccctcctgagctggagcgccgtcgagtaccgcgacgaggtggnggcgnngnnncagttccgccacctccggnccgccatccaggggggcgccgacttccttctccgggccccaccacggccgacaccctctacactcagggtggcgccggcaacgccgaccaccaatgctggaagcggccacaggccatggacccgccggggaacgctgtaaaaattccccggaagctcccccgcaccgaaggcccccgcgccgcggcccntccatccctcg

SEQ ID NO: 31182 - protein, 175 aa, Zea mays
  misc_feature: Ceres CLONE 1407325-F
  misc_feature (40)..(176): Pfam Name: Glyco_hydro_9 Pfam Description: Glycosyl hydrolase family 9
  misc_feature: SWISSPROT Homolog: EC 3.2.1.4 Cellulase
  misc_feature (120)..(120): Xaa is any aa, unknown, or other
  misc_feature (122)..(122): Xaa is any aa, unknown, or other
  misc_feature (123)..(123): Xaa is any aa, unknown, or other
  misc_feature (130)..(130): Xaa is any aa, unknown, or other
MAVKVWVFAVALMMCAGVRLGADDDGGSRLISRCRLSSPNYRGALAKAILFFEGQRSGRLPANQRVRWRGDSALTDGQPENVNLTGGYYDAGDNVKFGFPMAFSVTLLSWSAVEYRDEVXAXXQFRHLRXAIQGGADFLLRAPPRPTPSTLRVAPATPTTNAGSGHRPWTRRGTL

SEQ ID NO: 31183 - DNA, 639 bp, Zea mays
  misc_feature: Ceres CLONE 1407334-F
aaagctggagctccccgcggtggcggccgctctagaactagtggatcccccgggctgcaggaattcgcacgagaccattacctagaacatcctaatcgaaaagagcagatttttacctattgccatctctagtcgcgcctggggtctccggtctccgctcgccacgcccacgcccacgcccactaaccacgaccacgaccacgcccactacccacgccgccgacggttccgcccctgcgtactctaggtatcccgtgtccaacggtccacccccaccgcaaccgccgtccgtccgtccgtccgcccgccgccgcaccctgctagggtttcggccaggccggatccgccgccgcctgtagattctcctatccgaccgcggcgcctcgagccgcaccggcaacctcggacctgaatacctgatacactgcacttcttcagtccgcaggaccacagcacgcacaattgttcttcaatctgcaggactgcagccgcgcacaagccgtagctgggaaagaagataaaagtttctccctcccaggctaagaacaggctatttattgggaatgtaccccatgactggacacatgatgatttcaaaactgcagtggaagaagttggtcctggagttttaaaagttga

SEQ ID NO: 31184 - DNA, 635 bp, Zea mays
  misc_feature: Ceres CLONE 1407343-F
  misc_feature: Encodes the peptide sequence at SEQ ID NO. 31185
  misc_feature (498)..(498): n is a, c, t, g, unknown, or other
  misc_feature (511)..(511): n is a, c, t, g, unknown, or other
aagctggagctccccgcggtggcggccgctctagaactagtggatcccccgggctgcaggaattcgcacgagaccattacctagaacatcctaatcgaaaaaaagatcttatctcgagttctccgccgccgtcgccgctatgcctccctccccatcctccggcgcgggctccgcctcgccgtccggctccgcgtccgcctcggcctctgacccaaccccgtcctggtgggagtccgtctcgcaggcgcgctcccgcatcctggcgctctcctccatcctgccggccccggcctcccacgacgtcgcggcgctggccgacgccgaccgcccggcgcgcgcgcttctccgctcacccgctgcctacgcggcgctctctgacgcactgcgggcgggtggcggcgccgatgaccctgcctgccactggctctacgacacgctcctctccgccgaccccgacctccgcctcgccgcgctcgcgttcctgcccctgttggcggngctctacctccgncacctcccgcccgagctcccctcctcgctttcgggcttcgaggcccgtctcctcgccgtctactcctcccgagccaagaatcgtcaggggaagccggtcctcgtccagatgcccgacctctctg

SEQ ID NO: 31185 - protein, 165 aa, Zea mays
  misc_feature: Ceres CLONE 1407343-F
  misc_feature (120)..(120): Xaa is any aa, unknown, or other
MPPSPSSGAGSASPSGSASASASDPTPSWWESVSQARSRILALSSILPAPASHDVAALADADRPARALLRSPAAYAALSDALRAGGGADDPACHWLYDTLLSADPDLRLAALAFLPLLAXLYLRHLPPELPSSLSGFEARLLAVYSSRAKNRQGKPVLVQMPDLS

SEQ ID NO: 31186 - DNA, 642 bp, Zea mays
  misc_feature: Ceres CLONE 1407349-F
  misc_feature: Encodes the peptide sequence at SEQ ID NO. 31187
caaagctggagctccccgcggtggcggccgctctagaactagtggatcccccgggctgcaggaattcgcacgagaccattacctagaacatcctaatcgaaaaaaagcaccacgcacgatcgccttcgccaaccgcgccgctctctctctctttctctctcgcacgagccgcgccggcgccgccaccacgcgcgcgggagacagagaccacagccgcagccaccgacgggcggaataggaatggtggcgccggggggaggagcaggaggaggtccgttgcggtggccggcggcggaggagcttgacactgtacggaagaaggtggtggagattagtggaagggatgaacaagaggttatggttgctgcttgcccctacagaatttgccctttgggggctcatattgatcatcagggtggagtagtcacagctatgaccataaattatggagtactccttggtttcgttccctctaatggttctgagcaacctttatttttctttcaggttttacttcattctggtcagtttgaaggtgctataagattcagagttgatgacttgcaaaagcctattgataaacctgagaacataaactggggaagttatgcaaaaggtgctgttagtgcactgcagaatagt

SEQ ID NO: 31187 - protein, 134 aa, Zea mays
  misc_feature: Ceres CLONE 1407349-F
  misc_feature: SWISSPROT Homolog: EC 2.7.1.6 Galactokinase
MVAPGGGAGGGPLRWPAAEELDTVRKKVVEISGRDEQEVMVAACPYRICPLGAHIDHQGGVVTAMTINYGVLLGFVPSNGSEQPLFFFQVLLHSGQFEGAIRFRVDDLQKPIDKPENINWGSYAKGAVSALQNS

SEQ ID NO: 31188 - DNA, 760 bp, Zea mays
  misc_feature: Ceres CLONE 1407352-R
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
gggggtggtccctttttctgnnnntcaacgggttccccaacacttggtttttggtttcgaattgagtacgggccccccctcgaggtcgacggtatcgataagcttttttttttttttttttcagtgaatgaatgctttaaacatttgcattaataattcaataaggagtacttcgcacccactacaatcctggctttctcgacccccaacttaccacctgtgatcagccagtggccaggtgcatcttgggggcccttcaatgtttctgtcatgtcaataatcttcagaagtttagaattatcactcgaggacgatgaacattcatctgctttatgaattgaagaacttgatgggctgtggtcccacactgatcttctaattgtgcacccaggaaccctggaaaacaaaagtttgaagaggagaaaaatatttgaaacaaaaacccacactcccaactgtgcacccgttaggatataaacacccaaaagggaccaaagatttgtttcagtgtaatctatgggtgctgtgctaacatgaaaaaaggtcttacactagattggctcccaaccatcaggtgtccatgttcctcagggaactttgccaattttggaggtccaaaagtgcaactctgacaagaccacaatgaaagttaggaaatatttttttgcgcaaacgcagaactaaaggtacctcctaatatgtaaatagtcccaaatcttattaccctgctgtaaagcatctcttttccaagaaaaacatg

SEQ ID NO: 31189 - DNA, 650 bp, Zea mays
  misc_feature: Ceres CLONE 1407382-F
  misc_feature: Encodes the peptide sequence at SEQ ID NO. 31190
  misc_feature (584)..(584): n is a, c, t, g, unknown, or other
aagctggagctccccgcggtggcggccgctctagaactagtggatcccccgggctgcaggaattcgcacgagaccattacctagaacatcctatcgaaaaaacgacagcccctcgatccgcttcccatctgatgttcgcgttccaccgcgtctccttcctcctctcgtggccctccgctcgagtaccgctcgtaaaacctctgcctgctcctaggcccgccccaaaccctatgcccgacagcgcgtgagttcgtggttatcgccgtgctacgcccgccgagcgcacgccgcgagcaacgatgagacgcgaggcgttccgctctgctgctaccaacacgctggagtgccggctcttcttcatgacctctgtcaagatctagggtgtcgccagcgagatctacgattacagaaccctaggtctgcgctgtcagagctaacgtgctctcattctggcgaccgcattttgtattggaggaacggatgcttgagcttgactgtccatgtgtgacgccagaagttgtcttgaaagcctctggacatgtggataatgttacagatgtactgggtaaagatgatagaccggnaaactgctaccgtgcgcatcattttgctgaaggacttctgtaaggattaggttggatgaagatcac

SEQ ID NO: 31190 - protein, 48 aa, Zea mays
  misc_feature: Ceres CLONE 1407382-F
  misc_feature: SWISSPROT Homolog: EC 6.1.1.14 Glycine--tRNA ligase
  misc_feature (35)..(35): Xaa is any aa, unknown, or other
MLELDCPCVTPEVVLKASGHVDNVTDVLGKDDRPXNCYRAHHFAEGLL

SEQ ID NO: 31191 - DNA, 759 bp, Zea mays
  misc_feature: Ceres CLONE 1407388-F
  misc_feature: Encodes the peptide sequence at SEQ ID NO. 31192
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (87)..(87): n is a, c, t, g, unknown, or other
  misc_feature (88)..(88): n is a, c, t, g, unknown, or other
  misc_feature (358)..(358): n is a, c, t, g, unknown, or other
tgtggccgtggcctctttccgtagccccacccccgagcgcccccccgccttattaccgctggtttgtttttatgggnnnaagaaaannccaaactggagctcaccgcggtggcggccgctctagaatagtggatcccccgggctgcaggaattcgcacgagaccatctacctagaacatcctaatcaaaaattcccttctccatccacaactgtcctccacacacatccacacacgcgacactgaggagccctgagccctccgcccttaaaccctagcgagcgagccagcgagaggtctcatccccaccaacaccacccatggagctccgcctctaccacctcgcgctgctgctcggnctcgtcgcctgggcggcggctgctgccacgggagccgaggcgcagccggggggcgacccctccatcatcgccacccagatcgcgctccttctggatgccggaaatggcccacgggggccttgctggcaaccgatcatcgccttccgtccacccccgggggggcggtccccttggctctggccgggggcgccggacaaaccggcaaaacaaaaacactctcaccccccggggcccgaagcgggggccgggggggggcacccccccagccgggggtggggcccccccccccacagagccgggggactccggcgatgtaccgcaaacgcacgctggccctctctgctcttaacacggtacctgcctgcgggttggcgcgcatgcccctggacaccacgccgccc

SEQ ID NO: 31192 - protein, 30 aa, Zea mays
  misc_feature: Ceres CLONE 1407388-F
MYRKRTLALSALNTVPACGLARMPLDTTPP

SEQ ID NO: 31193 - DNA, 748 bp, Zea mays
  misc_feature: Ceres CLONE 1407392-F
  misc_feature (73)..(73): n is a, c, t, g, unknown, or other
  misc_feature (74)..(74): n is a, c, t, g, unknown, or other
  misc_feature (81)..(81): n is a, c, t, g, unknown, or other
  misc_feature (82)..(82): n is a, c, t, g, unknown, or other
tttcgcgcccggggggacgggggtggggtgtcagggggcggggggcggatgggggagttgagggtgaaggccnnctgcccnnaccaaagctggagctccaccgcggtgccggccgctctagaactagtggatcccccgggctgcaggaattcgcacgagaccattacctagaacatcctaatcgaaaaagagcttgcaaacaccaccagcgaaaacgtcgtggccagccatcccggtgtcgtcccgcgttctacagccaccgctgtcgtcgccgtcctagactcctagatccgtcagcttaacgagctccattccttcgaggccagccatcccggtgtctcagcagcggcggcggcggcgtcgagctcttgctttctgtgggaggacgcatggcgatgtctgcggggcgtgagctcttggtcctcttcttctctggcgccgaaggggttgagctcgcctctgccgcgaacgggccctttcctggtcgatagcggcttccagccgaagcgcgggatctacagggaggagcttggtggaagtccaacaaaaattggccctgggaaatttgggggtcccaagacttacacgattcttgcacaggcaagggggcaaagggaccttaaaattttctcaacccgggcccaagggtgggggccccccactaaaggggaatttccccgggggccccctttttgaaaaaaaattacccctctcatgggaggggaagtgccgtaatgataaatgggcg

SEQ ID NO: 31194 - DNA, 798 bp, Zea mays
  misc_feature: Ceres CLONE 1407396-F
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (81)..(81): n is a, c, t, g, unknown, or other
aaagggggtcgccatccacaaagggccgaagagggcgcgcgcggaccgcgagaggatgagaggtgaaaccccccannnntncatactgggactccccgcggtggcggccgctctagaatagtggatcccccggcctgcaggaaggcgcacgagaccattacctagaacatcctaatcgaggaaagcgcagatcacaacagctccctctgcatctccgcctcgtcgccgtcgtctgcctgcacaaccttcttcttcatctctctctcttcttccgctgccaccctcccagcaccgatggaaggtaagtccacccaggaatctccgtcccgctcccggccgccgtcccttctcataagcgcatccgatgtggatggggttttcagtaaggaccagaaaacgccctaggtaaatgcacaaagatgtccttggacggcgaaaaagctactttgacgagggacttcggcggggaaaaggggccccagacggcttcagggctctggcaaccccccccacgactttcgtaaggttcggggagcaccccgctatcttgccgcctcccaagcatttccgaacaaatggatgcccccaacgttggccggcctccacgcccgggctgctttagaatccaccctgcctcccgccccgaaaacacattgggcaagcccttccacaacccctcctcccacactcctcttggcggggccccgagatttggtttgttttaacgggccccgggcggagacgcgcaggctgacccccccgtgggcggggagaagccggcgcccaggccctgccggg

SEQ ID NO: 31195 - DNA, 623 bp, Zea mays
  misc_feature: Ceres CLONE 1407400-F
  misc_feature: Encodes the peptide sequence at SEQ ID NO. 31196
tggagctccccgcggtggcggccgctctagaactagtggatcccccgggctgcaggaattcgcacgagaccattacctagaacatcctaatcgaaaagcatcttcgcctccgctcaacgctcgcccagcccgccgcccccccaccgatccacgagaaaccttctcgcctccgcgggacgattcgccagggagagcaaaggtagcagaggcgccatggacgctgccaagtcggtgacgccgggcgccgtgtcctacatcctggcgcacccgtctacgggctccgatggcgccgtgtcggatctcgtcgttcaggtcctcgatctcaagtccatcggcatgggcagccggttcagtttcacggcaaccgatgggaacgacaaaatcaaggcgatgctccccacttactttgcgtcggaggtccactccggcaatctgaagaatttcggtctcatccgcatcctcgactacacttggcaactccgtcaaaggggaaaagctgacaaaggcctgattggctcaaaagcgaaaatggggggaaacgctcaacccccaattcaccgggaggcaaaaaaagggcctccccatggggtgaacccaaaagaaaaggtcatccggggttagaa

SEQ ID NO: 31196 - protein, 135 aa, Zea mays
  misc_feature: Ceres CLONE 1407400-F
  misc_feature (6)..(102): Pfam Name: Rep-A_N Pfam Description: Replication factor-A protein 1, N-terminal domain
MDAAKSVTPGAVSYILAHPSTGSDGAVSDLVVQVLDLKSIGMGSRFSFTATDGNDKIKAMLPTYFASEVHSGNLKNFGLIRILDYTWQLRQRGKADKGLIGSKAKMGGNAQPPIHREAKKGPPHGVNPKEKVIRG

SEQ ID NO: 31197 - DNA, 798 bp, Zea mays
  misc_feature: Ceres CLONE 1407404-F
  misc_feature (20)..(20): n is a, c, t, g, unknown, or other
  misc_feature (21)..(21): n is a, c, t, g, unknown, or other
  misc_feature (63)..(63): n is a, c, t, g, unknown, or other
  misc_feature (79)..(79): n is a, c, t, g, unknown, or other
cggaaattgggaacaagaannccgcgaacgcggcccccccgtaccccgccggtgcgcgaaaanaacccccctgcccccnacaaaactggcactcaccgcggggggggccgctctagaatagtggatcccccgggctgcaggaattcgcacgagaccattacctagaacatcctaatcgaaaaactatgaaagaactagacacgagagtccaccccaaatctcaatatcccaaccctccgatccccatttccatccactccgacaccaatcctccgctccgaccaccgccggagaaatggggcggcgccgccggcccccgctgctgcaggatgacgacggattacgaagaagaagggcccactaattccaagccctgggggggcgcctacattcttcggatggggaggccaggggagccccccgccgcccccggaagccaatccgccgtaacccctcggatgcccgcccacgcaggacatgcaaggaaagcggaaactccccccccccccgggaggcccgcacccctaaagggatcccccagggccaatggcgccgcggcccccgcggaagagaagcccccccctccccccaggccgagagggcccgaaacccaaaaaaaatactctccgcccaccagagcaccgggtaaaatagggcccggggttggcaccccccgcggtcctgcccacatcgaataatgcccccgggacgctcacacagcgggcgcaaacgcggcgaccgtaccccggcaggagagacagaaaatccagcgacgagcatgctccccccccaccccgg

SEQ ID NO: 31198 - DNA, 652 bp, Zea mays
  misc_feature: Ceres CLONE 1407405-F
  misc_feature (484)..(484): n is a, c, t, g, unknown, or other
  misc_feature (485)..(485): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (505)..(505): n is a, c, t, g, unknown, or other
  misc_feature (532)..(532): n is a, c, t, g, unknown, or other
  misc_feature (533)..(533): n is a, c, t, g, unknown, or other
  misc_feature (555)..(555): n is a, c, t, g, unknown, or other
  misc_feature (563)..(563): n is a, c, t, g, unknown, or other
  misc_feature (591)..(591): n is a, c, t, g, unknown, or other
  misc_feature (592)..(592): n is a, c, t, g, unknown, or other
aagctggagctccccgcggtggcggccgctctagaactattggatcccccgggctgcaggaattcgcacgagaccattacctagaacatcctaatcgaaaacttcccctctctcgcccctcctccctccgtctcgtctcccaggtcatggcaaaagctggagcaccgggaaaaataacaagtgggagataaacaggaagagctaggtgaatacttggagaaaaaggtcccccacaccccccacgcaggtgaatactacaagtagcagtacaaggaagagagccaatctgcccgtgactgccagtgagttgctcgggtgtggtggttagttgaggtcacgatgatgggaggcgggctgatgatggatcagagcgctgttccctggcgtccacaacttcgtggatctcctgcagcagaacggcgacaagaacctgggcttcgcctcactcatgccgcagacgtcctccggcgaccagtgcggatgnngnnnnannnggtgatctccntggacccaccgccagacagcttcccgnngacgccgtggaggacgacgccnattgaccnacgttgagggacattcgagggagctggnnagcgccgcatggtggcgcgaccggcatgaaagctgaaaagcggcttcagggaagcttgca

SEQ ID NO: 31199 - DNA, 802 bp, Zea mays
  misc_feature: Ceres CLONE 1407408-F
  misc_feature: Encodes the peptide sequence at SEQ ID NO. 31200
  misc_feature (22)..(22): n is a, c, t, g, unknown, or other
  misc_feature (34)..(34): n is a, c, t, g, unknown, or other
  misc_feature (802)..(802): n is a, c, t, g, unknown, or other
tttgggtggcggggggggggcnggcgggaggggnaaatagcaaaacgcaacccccgcgggcgagatgatagaaaaatggacccagggggccccagggagaggtggcccctcccggggggggcgctcggctctagaagtagcgcatccccctgggctgcaggaattcgcacgataccattacctacaacatcctaatcgaaaagccaactcggacgcaggagcaccacgtctctcctctgggtgtggggccgagacacctagcacgtactaccagcaagatggtggggtctcccagactcgagcccatcgaggagggctgctcggagggtggcccggagcacaggggggccgacgacctgaacggcccggtggtcatctccgggagcgcgctccccgactaagctccctcgggggtctcgagggcgcccgggggctccgcgccgcgcgggcgctcctgtccgggggccggccggccccgccagccgaagggctgcggccgccgaggctgctggccctcgcccaccccttgttaccccgacccccgggggccgggggatcgaacggtggcggcacggaccccgttacccggacgagggccccagggtatcccccagtgtctttgcgcctgggcggcccgcgccaggggggaaacaggctgctacgggggaggcgaggaatgagtcgcggagtggggtaggtgagcggccagcctcaggggagcgcgggtcctggcggcctggggggtccgagggggcattctggcgccccaggggtcacctctcaccccagggggtcggccccn

SEQ ID NO: 31200 - protein, 40 aa, Zea mays
  misc_feature: Ceres CLONE 1407408-F
MVGSPRLEPIEEGCSEGGPEHRGADDLNGPVVISGSALPD

SEQ ID NO: 31201 - DNA, 780 bp, Zea mays
  misc_feature: Ceres CLONE 1407409-F
  misc_feature: Encodes the peptide sequence at SEQ ID NO. 31202
  misc_feature (79)..(79): n is a, c, t, g, unknown, or other
  misc_feature (82)..(82): n is a, c, t, g, unknown, or other
gggcggggggggccgggtgcgcgcgcgcggggttcgggggggagggggggggggggggcgggggggggccccaccaaanttnaaagctggagctccaccgcggtggcggccgctctagaatagtggatcccccgggctgcaggaattcgcacgagaccattacctagaacatcctaatcgaaaagcccaacacccaattgaagacgtcccaatcccgaccctactcccgtgcctccccctaatgacatcgcctggcggcgtcttctccgccgcgctcgtcgccgaggacttcccttggctggacatggaggaggagatggtcatggccccggacatgtaccgcgaggtgttcgacctcgcgcagcgcggcacacgagcctttcgcgaccgcctcttcgacgagccaatatcctgttacactaaagctcagaatttgagacccgatccaattatcccttggcaatcgagagggtgacgttctgcgcgttagagtaaattgttggagccagacatcagcgcccgaattctggatagtcaggcgctgggatggcctggaggcgtaacaatccgcgcgcaagttagcctctggaggggtcgcggagcaaagaggtatgcgaggcagcaggaaagtgcgcgtgagaggcgctgtgagtggtcgagggaagatggggggtggtttcgtggtggggggcaatgaaggcgggagcgccgcggggcaggaaccgcttgctcgggggggggcctttgcaggactggaatccgcccctcgaatccaagtgg

SEQ ID NO: 31202 - protein, 77 aa, Zea mays
  misc_feature: Ceres CLONE 1407409-F
MTSPGGVFSAALVAEDFPWLDMEEEMVMAPDMYREVFDLAQRGTRAFRDRLFDEPISCYTKAQNLRPDPIIPWQSRG

SEQ ID NO: 31203 - DNA, 647 bp, Zea mays
  misc_feature: Ceres CLONE 1407418-F
  misc_feature: Encodes the peptide sequence at SEQ ID NO. 31204
aagctggagctccccgcggtggcggccgctctagaactagtggatcccccgggctgcaggaattcgcacgagaccattacctagaacatcctaatcgaaaaatttccacaagacccttgcgtgctctctctctctcctcttggcgacgactgggtggcaggtgcccaggtcttcttgggacccttcgccggcgacaagcaccaccagcttgcaggtttcaagatggaagtggtaaaaactacacatgctgggcatgcaaaatctcttgtatcaactattgattttagtacctgtcctgatggtattgtatgtgtgggtggtgatgggattgtaaatgaggtcctcaatggtcttctatgcagagatgatcaaaatatgtctgcctctgtaccaataggtataatacctgctgggtctgataactcacttatttggacagtcttgggtgtcaaggatccaatttctgcagcattgtcaattggtcaggggaggtcttaaacctattgatgttttttctgttgaatggattcaaagtgggactatgcattatggtacaccgatcactatttttggttttggttagcgatgttcttgagctctcagagaagatcaaaaagcattttggtctttacgaactttgggaagct

SEQ ID NO: 31204 - protein, 91 aa, Zea mays
  misc_feature: Ceres CLONE 1407418-F
  misc_feature (1)..(92): Pfam Name: DAGK_cat Pfam Description: Diacylglycerol kinase catalytic domain (presumed)
  misc_feature: SWISSPROT Homolog: EC 2.7.1.91 Sphinganine kinase
MEVVKTTHAGHAKSLVSTIDFSTCPDGIVCVGGDGIVNEVLNGLLCRDDQNMSASVPIGIIPAGSDNSLIWTVLGVKDPISAALSIGQGRS

SEQ ID NO: 31205 - DNA, 634 bp, Zea mays
  misc_feature: Ceres CLONE 1407430-F
  misc_feature (296)..(296): n is a, c, t, g, unknown, or other
  misc_feature (297)..(297): n is a, c, t, g, unknown, or other
  misc_feature (465)..(465): n is a, c, t, g, unknown, or other
aagctggagctccccgcggtggcggccgctctagaactagtggatcccccgggctgcaggaattcgcacgagacctttacctagaacatcctaatcaaaaagacgtccacagtgcgccgtgttctgccgcgcctgcgttcccaccgcgtgtccgcaactctgccccacctcacatccgcgtccgcaatccgcgcctccgccgccgcagcccttcctccgcgcagcgtccgtccatccatggctctccctacacgcagtgtcgtgccgctttccgcaatccgtgcctcaatcccctnntccttcgcgcagtgcccttccatccatggctcgcttccagaaatcccctacctacggcgcagcgtcgcagtcaggaatccgcccccaaaatcactacccgctctgcggcgatggaagggaatcaatccgtcaatggaaggaacacgtgcttccccccttccatcctcnggcgcttgcgcggaattgcggaatggcaatgggccaatcgttttccccgccccccaaatctcgctcaaataaaaaagagaaaagcggggggtttttttccccccccttttttttttattccccccgggggggggggggggggaaaatttgggaaaaaaagtttggtggg

SEQ ID NO: 31206 - DNA, 753 bp, Zea mays
  misc_feature: Ceres CLONE 1407432-F
  misc_feature: Translation starting site: 331
  misc_feature: SWISSPROT Homolog: EC 2.6.1.2 Alanine transaminase
  misc_feature (634)..(634): n is a, c, t, g, unknown, or other
  misc_feature (652)..(652): n is a, c, t, g, unknown, or other
  misc_feature (700)..(700): n is a, c, t, g, unknown, or other
  misc_feature (737)..(737): n is a, c, t, g, unknown, or other
aagctggagctccccgcggtggcggccgctctagaactagtggatcccccgggctgcaggaattcgcacgagaccattacctagaacatcctaatcgaaaacactcgctttccggcgggcgactggcctaaaatcgcctcttgtttgtttgcttccgtcgtcccctctccacgtagagcacgcccccggaccaccttttataagcaccaaccatctggccttgccgcgccgattcgccacgaagccgcactgtgagagagggacgcggcctgttgtcccggcttttagacgcaacttccatcgctgcgaagctatccattcgtgttcgtcatggccgccagcgtcaccgtggaaaacctcaaccccaaggtcttaaaatgtgagtatgcagtccgtggggagattgtcatccatgctcagcgcctgcagcaacaactacaaacacaaccagggtctcttccttttgatgagatcctctattgcaacattgggaatccccaatctcttggtcagcaacctgtgacattcttcagggaggttcttgctctttgtgatcatccgtgcctcttggaaaaagaggaaccaaatcattgttcagtgctgatgcaatttctcgagcaaagcagattcttgncactattcctgggagggncacaggtgcatatagtcacagtcaggttatcaaaggactgcgtgatgncattgctgctggaatcatgtcacgtgatggattcccntgcaatgcagatgact

SEQ ID NO: 31207 - DNA, 624 bp, Zea mays
  misc_feature: Ceres CLONE 1407435-F
  misc_feature (84)..(84): n is a, c, t, g, unknown, or other
  misc_feature (624)..(624): n is a, c, t, g, unknown, or other
aagctggagctccccgcggtggcggccgctctagaactagtggatcccccgggctgcaggaattcgcacgagaccattacctangaacatcctaaaaaaaatcttatttcactggccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaacagccccggcagccacgcgtacacttctgccgcaaagctaaacgcgccacctccggggaaggttgctctggtggtccccacagccaccggaacgaagtgccatggccgattgcaacgaatttcaaacccggggggggggaaaccctattttgggtttgggggtaattgacccgggggggggcccccggaaaaaggcaaccggggtttttcccccctttgggggcttttgggggcccaaagggggagaaatcccaaggtgggttggtcctcaaaaattttttaaaacattggggggaaaaccgcccccgtttttttttcccaccaccccccgtn

SEQ ID NO: 31208 - DNA, 852 bp, Zea mays
  misc_feature: Ceres CLONE 1407436-R
ttgggtaccgggccccccctcgaggtcgacggtatcgataagcttttttttttttttttttgtacataatggcaggagctctgcctctcaattaagaagaatagaattgatccagttttaaggaaaaccggacccaatgtctacactgggcgcacggtagaaaaaccggtgaaggcccttacaaaccacctagacaacagcagcctcacacacacgaacacatctagagtcattgttgccaagctcaaacacaagggacgagcagctccgactccccaagacgagccgcacactgcctaagcaactcgacgacgcctaaatccagacaccgacgcaaggaataagatcacggcgcgccatcgttgccaagcctcgcacaccccatcacgaggcagctccgattcttcgccacgagcaaagatccacaacgcctaactccgggagaaaacagacgcctaaagcgacaatggccccgagaccaccgagccaagcggagtgacaaagagcctccacaacgccgacgaacacacaaactagaggtcttctgggctgtgccttcaagaaggagaaacgaagtcgaaaagtcgtcgccgcccgcctggtaccaatcaagcaaagtttcctccgaagacctcctgtcgtccgccgacccaccaacccagcaacgccaaccttcttagccccaacatcggacgagcaccagcgaaatcccccaagaaggccgaggcgagggttcccgcattgtggtgagaggtcaaggacagcaccctcataggggaaggggtggcgccctcgggcgtcaccgctgtccgcccgaaagcggggcatggctttcaacagaagcccctccac

SEQ ID NO: 31209 - DNA, 624 bp, Zea mays
  misc_feature: Ceres CLONE 1407438-F
  misc_feature: Translation starting site: 237
  misc_feature (356)..(356): n is a, c, t, g, unknown, or other
  misc_feature (421)..(421): n is a, c, t, g, unknown, or other
aaagctggagctccccgcggtggcggccgctctagaactaagtggatcccccgggctgcaggaattcgcacgagaccatttaacctaagaacattcctaatcgaaaaaccctcccccaccgccattgctcagcagcagtagtaaagccacgcctgacagacagctggttcattttctggttgctgccttgctggtggtagccctcggcgcaggcagccaagaacagagagagcgagatggatgtgaacgacgtgctgctagtggtgctggcggcggcgctggctgccatgtggtggcgtcggtgctcaagaacggctgtgtcgacggcctcccgacggggcctccgggttggccgntgatggggaatctgttccagtgatctgcagcgacggccttcatgtacgtgtgcgcgacttcgggnagagtacgggcccatctcaccatggcggatgggcagcgcaccctcatcgggtcacctcgggggagttattcacaagggcttggtggaaccagggtcccatgtttcggagcccggcccaagaagagcccccccccgcttctttttttaagggtgggaaaaggggacccgttaaatttggggcctaaagggcccccccttggggg

SEQ ID NO: 31210 - DNA, 729 bp, Zea mays
  misc_feature: Ceres CLONE 1407439-F
  misc_feature: Encodes the peptide sequence at SEQ ID NO. 31211
  misc_feature (523)..(523): n is a, c, t, g, unknown, or other
  misc_feature (559)..(559): n is a, c, t, g, unknown, or other
  misc_feature (602)..(602): n is a, c, t, g, unknown, or other
  misc_feature (609)..(609): n is a, c, t, g, unknown, or other
  misc_feature (663)..(663): n is a, c, t, g, unknown, or other
  misc_feature (729)..(729): n is a, c, t, g, unknown, or other
ggagctccccgcggtggcggccgctctagaactagtggatcccccgggctgcaggaattcgcacgagaccattacctagaacatcctaatcgaaaagctgaactgctgacgcttcgcgcgggtccgaggtcaggcggcagcagcacggagtagcaccagggcgaccgcccaggttatcgtcggccgccggcgacctgtaccccggcgagaagatgcatctgagcgcgaacgaggggatcgagggtctgcgattcgcggtgacgggcgggcagggcttcgtcggagctgccctcagcctcgagctgctccgccgcggtgcccgcgaggtccggtccctcgatctccgcgcctcctcctcctggtcccagcagctcctcgacgccggcgtccgaatcatccaaggggacataagaaagaaggatgatgtgcggaaggctttccgtggagtggactgtgttttccaccttgcttcttatggcatgtcagggaaggagatggtgcagactgggagatctgatgaggntaatataaatgggacctgcaatgtactggacgcttngcatgagcaagatgtcagaaagcttgtgtatgtaagcacatancatgtgntattcggagaaaagcgattttgtcacgaaatgaggcgttgccttattttcgatngaagaccatgttgatgcttatgggcgcagcaaatcagttgctggacagctggtactgaagagtacn

SEQ ID NO: 31211 - protein, 154 aa, Zea mays
  misc_feature: Ceres CLONE 1407439-F
  misc_feature (15)..(155): Pfam Name: 3Beta_HSD Pfam Description: 3-beta hydroxysteroid dehydrogenase/isomerase family
  misc_feature: SWISSPROT Homolog: EC 5.1.3.2 UDP-glucose 4-epimerase
  misc_feature (104)..(104): Xaa is any aa, unknown, or other
  misc_feature (116)..(116): Xaa is any aa, unknown, or other
  misc_feature (130)..(130): Xaa is any aa, unknown, or other
  misc_feature (133)..(133): Xaa is any aa, unknown, or other
  misc_feature (151)..(151): Xaa is any aa, unknown, or other
MHLSANEGIEGLRFAVTGGQGFVGAALSLELLRRGAREVRSLDLRASSSWSQQLLDAGVRIIQGDIRKKDDVRKAFRGVDCVFHLASYGMSGKEMVQTGRSDEXNINGTCNVLDAXHEQDVRKLVYVSTXHVXFGEKRFCHEMRRCLIFDXRPC

SEQ ID NO: 31212 - DNA, 658 bp, Zea mays
  misc_feature: Ceres CLONE 1407441-F
  misc_feature: Encodes the peptide sequence at SEQ ID NO. 31213
  misc_feature (658)..(658): n is a, c, t, g, unknown, or other
tggagctccccgcggtggcggccgctctagaactagtggatcccccgggctgcaggaattcgcacgagaccattacctagaacatcctaatcgaaaaatatttcgatcgtggtgtgagtctccgctttcccacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggtttagtggggtttaattcggatgataataaccttcagcttgaggccaccacacagttccgcaaattgctctctatagagaggagtccccccatcgaagaagttatcaaaacaggtgtagttccaagatttgtgcagtctctcacn

SEQ ID NO: 31213 - protein, 75 aa, Zea mays
  misc_feature: Ceres CLONE 1407441-F
  misc_feature (4)..(76): Pfam Name: IBB Pfam Description: Importin beta binding domain
MSLRPSERVEVRRNRYKVAVDAEEGRRRREDNMVEIRKSRREESLLKRRREGLQAQVPAPPSGVEKKLESLPAMV

SEQ ID NO: 31214 - DNA, 720 bp, Zea mays
  misc_feature: Ceres CLONE 1407443-F
  misc_feature (415)..(415): n is a, c, t, g, unknown, or other
  misc_feature (544)..(544): n is a, c, t, g, unknown, or other
  misc_feature (556)..(556): n is a, c, t, g, unknown, or other
  misc_feature (564)..(564): n is a, c, t, g, unknown, or other
  misc_feature (565)..(565): n is a, c, t, g, unknown, or other
  misc_feature (625)..(625): n is a, c, t, g, unknown, or other
  misc_feature (678)..(678): n is a, c, t, g, unknown, or other
gctctagaactagtggatcccccgggctgcaggaattcgcacgagaccattacctagaacatcctaaccaaaaaaacgagaaggaagccaccgctccccaatcgcctgcttgccttcccatcctcctcgtagatctccggcaccgggcaccatgagctcctactccggcgaccgctcctcctcctcctccttgcgccccaccaacacctccttcgactcctacaagttcgacttcggcatcaactcctcccgctcctccggctctcgccccctccgcgaccagcggccgggcgcggctaccaaccctccaacgaggcccgccaccggcgccacgtggatgcaccagcccgccagcgccaagccgtcgtggacccaccagccttcccccgccgcggcgtcggcgcccaccatggcngggcctggatccgggccaacctccatggtcggcgacatctttggccggagctggtcctccgccgcgccctcctctgggttcggcatccctcaggccaacaaccccggcctcttcagcgatctcctcggntccgcgctcggntcctcccnngctccagtcaacgcgccgctcagatccgccgccgcgccacaggcatccaggccagccggntgagaagcccatggtcacgctagcagctctcccttctcgatggcgggcatgcncggcgcgctcccgaaactacgggagcaccgatgggctccggg

SEQ ID NO: 31215 - DNA, 725 bp, Zea mays
  misc_feature: Ceres CLONE 1407456-F
  misc_feature (261)..(261): n is a, c, t, g, unknown, or other
  misc_feature (262)..(262): n is a, c, t, g, unknown, or other
  misc_feature (329)..(329): n is a, c, t, g, unknown, or other
  misc_feature (339)..(339): n is a, c, t, g, unknown, or other
  misc_feature (471)..(471): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (538)..(538): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (555)..(555): n is a, c, t, g, unknown, or other
  misc_feature (556)..(556): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (569)..(569): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (661)..(661): n is a, c, t, g, unknown, or other
  misc_feature (672)..(672): n is a, c, t, g, unknown, or other
  misc_feature (673)..(673): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
aaagctggagctccccgcggtggcggccgctctagaactagtggatcccccgggctgcaggaattcgcacgagaccattacctagaacatcctaatcaaaaaattcgaacggaggtccttttcttctttctcgtctgcttcctccttccctcgtcgtcctcgcgtcgcctccttcggccctccctattaatacctgcctcctcacaaccaggtcctgtcctcggggagccgaatccacacggaccacaccagaggacgcgnnggacgccccggattctttcgattcaggatggacctacccagaaatagcactatgggtcctgcctcantgcatgtggnccactgacagaatactacattcctggatactactgaaccccgcctataacccggcccctggtaaaaagggcccatttttccccgggaactctcctccccccccaaaaatccccccttttttaaaattttttnaaaaaatcccctaacctttttattggggnnnnnnnnnnnnnnnnnnnnnnnnnnnnnnnnnnnnncncnnncnnnnnnnnnncnncnnnnnnnnnncncnnnnnnnnnnnnnnnnnnnnnnnnnnnnnnnnnnnnnnnnnnnnnnnnnnnnnnnnnnnnnnnccgcccccccccctcccccccccccccncccgggggggnnctcctnnnnnnnnnnnnnnnnnnnnntnnnnnnnggggggggggggggaggg

SEQ ID NO: 31216 - DNA, 730 bp, Zea mays
  misc_feature: Ceres CLONE 1407458-F
  misc_feature: Encodes the peptide sequence at SEQ ID NO. 31217
  misc_feature (579)..(579): n is a, c, t, g, unknown, or other
ggagctccccgcggtggcggccgctctagaactagtggatcccccgggctgcaggaattcgcacgagaccattacctagaacatcctaaaaaaaatcgatcagtcgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccacccccacgtcgtgcagctgcacgaggtgatggccagcaagagcaagatatacttcgccatggagtacgtcgcggggcggngagttttttcgcccgcgtcgcccgcggccggcttcagggaggacgcggcgaaagggtacttcaccaggttcgcgggggcggtcgactttctgcacaggccggggggtctaaccacggacctcaagccccgaaaaccttcctcggtgaggag

SEQ ID NO: 31217 - protein, 145 aa, Zea mays
  misc_feature: Ceres CLONE 1407458-F
  misc_feature (12)..(144): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature (96)..(96): Xaa is any aa, unknown, or other
MEKKPTILMNRYELGRTLGQGTFAKVYHGRNLASGESVAIKVIDKEKVMRVGMIDQIKREISVMRLVRHPHVVQLHEVMASKSKIYFAMEYVAGRXVFSPASPAAGFREDAAKGYFTRFAGAVDFLHRPGGLTTDLKPRKPSSVR

SEQ ID NO: 31218 - DNA, 700 bp, Zea mays
  misc_feature: Ceres CLONE 1407462-F
  misc_feature (351)..(351): n is a, c, t, g, unknown, or other
  misc_feature (469)..(469): n is a, c, t, g, unknown, or other
  misc_feature (474)..(474): n is a, c, t, g, unknown, or other
  misc_feature (482)..(482): n is a, c, t, g, unknown, or other
  misc_feature (491)..(491): n is a, c, t, g, unknown, or other
  misc_feature (498)..(498): n is a, c, t, g, unknown, or other
  misc_feature (508)..(508): n is a, c, t, g, unknown, or other
  misc_feature (530)..(530): n is a, c, t, g, unknown, or other
  misc_feature (531)..(531): n is a, c, t, g, unknown, or other
  misc_feature (538)..(538): n is a, c, t, g, unknown, or other
  misc_feature (539)..(539): n is a, c, t, g, unknown, or other
  misc_feature (548)..(548): n is a, c, t, g, unknown, or other
  misc_feature (564)..(564): n is a, c, t, g, unknown, or other
  misc_feature (589)..(589): n is a, c, t, g, unknown, or other
cgcgctggagctcaccgcggtggcggccgctctatactagtggatcccccgggctgcaggaattcgcacgagaccattacctagaacatcctaatcgaaaaatttcttccccccttctctcgtcacgtccaataaaaaggggggaaaacttctctctctttttttccctcccccgcccgaatctgatgcttaaaccctcgccgggaggaggattccaatcccgacgcaccagcccgcgcccgccacctacagccgcgcccggatctccgccatggccgccgcgccgcaccaggcccagggccccgcagatagtgtgattccgctgccgcccgacactgcgcttgataatantccctcctcgagtgcaaacgctagggaccagattctttttggtacgtagaatgcggctactggccatgcacgcccccccccgccccttgcaatctcccaacgccccgcccgagacggnccgcnttgccggncggcctggngaaaggnattgttcttngctccgccccgcgggtgacgcnncccctcnnccccgccanctctgcgcccctgcgngcccccttttgcatcttggccggcnccccccccttcccgcgcgtgggacggaccattcttctgccatctgcccggcaaccgcaacgcatccgtagtttcttaatcaaagaagacggcccctttttttacatacccc

SEQ ID NO: 31219 - DNA, 715 bp, Zea mays
  misc_feature: Ceres CLONE 1407463-F
  misc_feature (423)..(423): n is a, c, t, g, unknown, or other
  misc_feature (476)..(476): n is a, c, t, g, unknown, or other
  misc_feature (477)..(477): n is a, c, t, g, unknown, or other
  misc_feature (479)..(479): n is a, c, t, g, unknown, or other
  misc_feature (480)..(480): n is a, c, t, g, unknown, or other
  misc_feature (485)..(485): n is a, c, t, g, unknown, or other
  misc_feature (503)..(503): n is a, c, t, g, unknown, or other
  misc_feature (504)..(504): n is a, c, t, g, unknown, or other
  misc_feature (535)..(535): n is a, c, t, g, unknown, or other
  misc_feature (542)..(542): n is a, c, t, g, unknown, or other
  misc_feature (639)..(639): n is a, c, t, g, unknown, or other
  misc_feature (651)..(651): n is a, c, t, g, unknown, or other
  misc_feature (655)..(655): n is a, c, t, g, unknown, or other
aaagctggagctcaccgcggtggcggccgctctagaactagtggatcccccgggctgcaggaattcgcacgagaccattacctagaacatcctaatcgaaaagttccataaaccctaacctcgttggattcgcggcaaaaatcctcccaattcggaaccctccgatgttccagctacctgcgggagctgagccgtgctcggtttggcgaaatttcgcacccctcttgtgctaggaccacccggttcaagctgttcctcggaagggtcaggtcttcaccggtgttctccggcgccggatccaggtttgttccggcgagaggtcggtctcttggcggcggccagcccagcttcgagcccaatttgccgggctgagatggaatcgcgactgtggtgccgttgttttttgtatgtgccgcccccaanatgtaagattactgcccctggcggggttcagactttcctgcccccccccgggnncnnttccncctcccgtccggtcctanncgtctgattcgtgttgtgtcgccgggttcanatcatcnccacttcttctccagggagtcccgctccaactgcttttcggttgttttttttggcctccgccttccgccccgccctctgacagtagttttttttttnctaccccgccantgtnggcctcacccccggccttctgtctcctgacggccacggggaggtttggctaaccggtgcc

SEQ ID NO: 31220 - DNA, 599 bp, Zea mays
  misc_feature: Ceres CLONE 1407466-F
  misc_feature: Encodes the peptide sequence at SEQ ID NO. 31221
  misc_feature (395)..(395): n is a, c, t, g, unknown, or other
  misc_feature (490)..(490): n is a, c, t, g, unknown, or other
tggagctccccgcggtggcggccgctctagaactagtggatcccccgggctgcaggaattcgcacgagaccattacctagaacatcctaatcaaaaagagagctaccgcaaccagctattgagctactgcctctgaccaagtcccaagctgcgctgcgcctgctatgtcgtcgtcctcgcccgtatcggcggtctcatcagccactgcgccgcacgtcgtggagactgcctcggatcgtgcagcttcttacgatggcacgtgacgcgctcgcggactactccgacatcctctcctgggcgagtgccgtccacctgcccgtccagtggaaggacgtcgtctacgaccccgcgcacgcgctccgcctccgcatgtacatgcccaccgacaccgacgncggcaggacgaccaacaacaagctgccggtgctagtctacttccacggggcggcttctgcatctgcagcttccagatgccccatttcacgccggngggcttcgcctcgccgccaagctcccggggttggggtttcgccgaataccgctggggccggaaaaccgctcccccggggcaccccgaaccccaagccctcccgtcctgg

SEQ ID NO: 31221 - protein, 115 aa, Zea mays
  misc_feature: Ceres CLONE 1407466-F
  misc_feature (48)..(48): Xaa is any aa, unknown, or other
  misc_feature (80)..(80): Xaa is any aa, unknown, or other
MARDALADYSDILSWASAVHLPVQWKDVVYDPAHALRLRMYMPTDTDXGRTTNNKLPVLVYFHGAASASAASRCPISRRXASPRRQAPGVGVSPNTAGAGKPLPRGTPNPKPSRP

SEQ ID NO: 31222 - DNA, 724 bp, Zea mays
  misc_feature: Ceres CLONE 1407468-F
  misc_feature: Encodes the peptide sequence at SEQ ID NO. 31223
aagctggagctccccgcggtggcggccgctctatactagtggatcccccgggctgcaggaattcgcacgagaccattacctagaacatcctaatcaaaaaaatccccatcaaacccccggacatttctggtcgcaccctcctccggccctcccagccgctaagccctctggaaccttcgagagctcgatcggatcggagcccctgccatggccgacgaggcgaaggcgaagggtaatgcggcgttctcagccggccgcttcgaggaggcggcgcggcacttcacggacgccatcgcgctcgccccgggcaaccacgtcctctactccaaccggtcggcggcgctcgcctcactccaccgctactccgacgctctcgccgacgcgcagaagaccgtcgagctcaagcctgactgggccaagggctactcccgcctcggcgcggcgcacctcggcctcggcgacgccgccagcgccgtcgccgcacacgagaggggccttgcgctcgaccccagcaacgaaggtctcaaggcggggctcgaggacgccaagaaggccgccgccgccccgccgcgtcgcgggccgtccggccccgacgccatcggccagaatgtccaggcccccgaactgtggagcaggatcgcgtccgaccccaccacaggcgcctaccttaacgagcccgactttatgcagatgctgcgccgaggcgcaaggaaccccagcagca

SEQ ID NO: 31223 - protein, 172 aa, Zea mays
  misc_feature: Ceres CLONE 1407468-F
  misc_feature (2)..(35): Pfam Name: TPR_2 Pfam Description: Tetratricopeptide repeat
  misc_feature (70)..(103): Pfam Name: TPR_2 Pfam Description: Tetratricopeptide repeat
  misc_feature: SWISSPROT Homolog: EC 3.1.3.16 Phosphoprotein phosphatase
MADEAKAKGNAAFSAGRFEEAARHFTDAIALAPGNHVLYSNRSAALASLHRYSDALADAQKTVELKPDWAKGYSRLGAAHLGLGDAASAVAAHERGLALDPSNEGLKAGLEDAKKAAAAPPRRGPSGPDAIGQNVQAPELWSRIASDPTTGAYLNEPDFMQMLRRGARNPSS

SEQ ID NO: 31224 - DNA, 702 bp, Zea mays
  misc_feature: Ceres CLONE 1407475-F
  misc_feature: Encodes the peptide sequence at SEQ ID NO. 31225
  misc_feature (373)..(373): n is a, c, t, g, unknown, or other
  misc_feature (552)..(552): n is a, c, t, g, unknown, or other
tggagctccccgcggtggcggccgctctagaactagtggatcccccgggctgcaggaattcgcacgagaccattacctagaacatcctaatcgaaaaattggtgattgattgatcctccccggctcactcctttgactcctcgcctcgtgctcgctcgctcccctcgccctggcgaggagggcagcataaaccctagcgcctcacgccgggcggaggttagatgctcctaggctcgagagggaagggtaggttagtggagcgccatcgactatgggctgcgtcttcggccgggcggctgcgtcgatcctctgcagcgccgaagaagaagtgcggcaaggggggagggcatccccggagatcgaatgggcccgncgctccgacagcgccgggactctacgctgactcccggccgcgcgagacggtcggcctccgcatcgcgaggagaccacgggcagcgtcgtcgttcggtcgatcggcgcgcggctgtctgtggttccgcggtgaggacggcgactctgatcgatcatcgctgaggcgcgcgtctcctgcgnatggcgcggctcctgcgcgttcagttcggtacacactataggaattacgagggaggtcttgagtctgggcggccgagccatagttgtgcagcgatcgaccttgtggcgcagttactgtaaacgcctatgtgccagcttaggacctgaggg

SEQ ID NO: 31225 - protein, 43 aa, Zea mays
  misc_feature: Ceres CLONE 1407475-F
MGCVFGRAAASILCSAEEEVRQGGRASPEIEWARRSDSAGTLR

SEQ ID NO: 31226 - DNA, 709 bp, Zea mays
  misc_feature: Ceres CLONE 1407476-F
  misc_feature: Encodes the peptide sequence at SEQ ID NO. 31227
  misc_feature (406)..(406): n is a, c, t, g, unknown, or other
cgctctagaactagtggatcccccgggctgcaggaattcgcacgagaccattacctagaacatcctaatcgaaaaaggcctagggtttccttcctcctccagtgctgtcatcgccgccgccgccgccccggtttccttcgtaagcccgccgtcctccgtccgcgactctgcgcgagaagcgagagtatggacacccaagtgaagcttgctgttgtggtgaaggtgatgggaaggaccggctccaggggtcaggttacccaggtcagagtgaagttcttggatgaccagaaccgtctcatcatgaggaacgtcaagggacctgttcgcgagggagacatcctcacactgctcgagtctgagagggagggctagaggctgcgttgaggcgggatactgtcttggtagntttcgtatggagttggatgtcatctaattgtgctatgtttgtcaaactttgggatgacctttaaaaccactggcttgtatggatatttgtgagcctggtggtaagattgcagtttggtttttatgatccgttgaggggaatggttggcaccaatatttatccaaatctgggttttacaaaacaatacttggaaatgggcatcccaaaaaaaaaaaaaaaaggttattgataccggcgaccctcaaggggggggccggggaaccaaattgccctaaaaggggggcgtattaccggggccccggg

SEQ ID NO: 31227 - protein, 61 aa, Zea mays
  misc_feature: Ceres CLONE 1407476-F
  misc_feature (1)..(61): Pfam Name: Ribosomal_S28e Pfam Description: Ribosomal protein S28e
MDTQVKLAVVVKVMGRTGSRGQVTQVRVKFLDDQNRLIMRNVKGPVREGDILTLLESEREG

SEQ ID NO: 31228 - DNA, 750 bp, Zea mays
  misc_feature: Ceres CLONE 1407480-F
  misc_feature: Encodes the peptide sequence at SEQ ID NO. 31229
  misc_feature (750)..(750): n is a, c, t, g, unknown, or other
acagctggagctccccgcggtggcggccgctctacaactagtggatcccccgggctgcaggaattcgcacgagaccattacctacaacatcctaatcgaaaaacaaaatctcatttgagcgtgcaagctccttcgcctcgaaccctctcgcgcttggctttctttcactctccagggctccactcccatctcgccgccgcagccatggcgatcacagcgccaactcccgacatcctcggcgagcgccaatccggccaggacgtccgcacgcagaacgtgatggcttgcggggcggtggccaacatcgtcaaatcctcgttcggccccgtcggccccgacaagatgctagtggacgatattggtgatgctacaaccgcgggtgatggagcctccatttttaacaagaaggccccccatacacacccgaacccccaccccacctacaccttaaccccccccgcccccagacccccgcctccttcccgtcccgccttctccttcgctctcctcctggtctccacccctaccccaacacccacccccgcaacccccgccgcctccacgcgcgcgacctaccgaccgtaggtttcaatttcccccccccaccgcaatacccacccgcccgccacacaatccgcctttccttcatcccaacgaccgcctacgcgtacccactcgaatgccccgcaagcgctactcaaacctaggcgggagcgacacaccctcccatagacgcacacagctcccccn

SEQ ID NO: 31229 - protein, 126 aa, Zea mays
  misc_feature: Ceres CLONE 1407480-F
MAITAPTPDILGERQSGQDVRTQNVMACGAVANIVKSSFGPVGPDKMLVDDIGDATTAGDGASIFNKKAPHTHPNPHPTYTLTPPAPRPPPPSRPAFSFALLLVSTPTPTPTPATPAASTRATYRP

SEQ ID NO: 31230 - DNA, 763 bp, Zea mays
  misc_feature: Ceres CLONE 1407481-F
  misc_feature: Encodes the peptide sequence at SEQ ID NO. 31231
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (41)..(41): n is a, c, t, g, unknown, or other
  misc_feature (51)..(51): n is a, c, t, g, unknown, or other
  misc_feature (480)..(480): n is a, c, t, g, unknown, or other
nnnnccccccccccccnnncccccccccccccccgccttantgggcgggcncccaaagctggagctccccgcggtggcggccgctctagaactagtggatcccccgggctgcaggaattcgcacgagaccattacctagaacatcctaatcgaaaatcagatctagcagaactctctcgacctcatcggcgttggcggagcgcgtgttgaccggagatggcgccgagcgggtggaggaggagcgcggcggcgcgggtcgcctggcgcccggccacggtttgcctgtggctcgcgctcgccgccgccgcactgacgctcgcccaggctaagaaggacctgacggaggttacccacaaggtctacttcgacatcgagatcgacggcaagcccgcaggccggattgtcatggggctttttgggaagactgttcctaagacggcagagaacttccgagctctttgcacaggagagaaagggggntgggaagagtggcaaagccctccactacaaggggaagtaaggttccacagaatcatccccagcttcatgctcccagggaggtgacttccctctcggggaccgggagggggtggtgaatcctatctccggcttggaaagtttggcggatgagaaactttcaggatccaagcaacactgggacccgggccctttctggcccatgggcccaatggccgggaagaagaatacaaagcggggatccgcaggtttttccattccccccccggggaacacaccgggggtg

SEQ ID NO: 31231 - protein, 115 aa, Zea mays
  misc_feature: Ceres CLONE 1407481-F
  misc_feature (47)..(112): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MAPSGWRRSAAARVAWRPATVCLWLALAAAALTLAQAKKDLTEVTHKVYFDIEIDGKPAGRIVMGLFGKTVPKTAENFRALCTGEKGGWEEWQSPPLQGEVRFHRIIPSFMLPGR

SEQ ID NO: 31232 - DNA, 696 bp, Zea mays
  misc_feature: Ceres CLONE 1407482-F
  misc_feature: Encodes the peptide sequence at SEQ ID NO. 31233
aagctggagctccccgcggtggcggccgctctagaactagtggatcccccgggctgcaggaattcgcacgagaccattacctagaacatcctaatcgaaaaaaactaccgaagtctacttccattccttcctttctcctttcatatacccgcgtcgcccacgagcccgccgtgccgacagaggtgtggacctcgccggagcagaggctatggggccaccgcagccagccaggcccggcgtcatcaacatcgaggcctgcgcgcggccgatcgccgtcgaccaccgcatcagccttccctactacttccgcatcgcgggcagcctcctccgacaggctaatatatatcggaacgagagtaacttcctcgacctatatgtcgtccttctgagatactccagcttgctgggtgaaacaattccgaggcatcgtgattaccatgccttcaagttaagagaaaaggcattctttgataaacttgctgatgttatcaaagaacttgagaccttgaagcccgctgcgcagcgccagattgcccctcctaatagaggcggcgctgcggaaattagtctgaatatgttacccgggaacaagggttagattcataggaaacaggaggcaactcgcggcgcctagaatcaaaagcatttcgaaggacccccgatggaagttccccaaaaccctttcctggtggggag

SEQ ID NO: 31233 - protein, 129 aa, Zea mays
  misc_feature: Ceres CLONE 1407482-F
MGPPQPARPGVINIEACARPIAVDHRISLPYYFRIAGSLLRQANIYRNESNFLDLYVVLLRYSSLLGETIPRHRDYHAFKLREKAFFDKLADVIKELETLKPAAQRQIAPPNRGGAAEISLNMLPGNKG

SEQ ID NO: 31234 - DNA, 696 bp, Zea mays
  misc_feature: Ceres CLONE 1407484-F
  misc_feature: Encodes the peptide sequence at SEQ ID NO. 31235
aaagctggagctccccgcggtggcggccgctctagaactagtggatcccccgggctgcaggaattcgcacgagaccattacctagaacatcctaatcgaaaaaaccttcgcctctcctcccgttgtcagccgccgtgcctgttctctctgcctttctaaaagtgcggcgactggttgggctgccgccgactgccggggccttcgccgacctcttcgccggcgaagaggtcccatcaggagaaggagtagatcgtcgacccagaaccctcgctgatggcgactttcgcgaaacctgagaacgcgctgaagagagccgaagaattaatccatgttggtcaaaagcagtcagccctgcaggctttacatgatctcattacctcgaaaaggtacaggtcatggcagaagcctctcgaaaagatcatgatgaagtatgtagaactctgtgttgacctgaggaaaggcagatttgcaaaagatggtcttattcagtataggattgtctgccagcaagtaaacgtgtcatccttggaggatgtcataaagcacttcatgcagctttcacatgagaaagctgaacaagctaagagtcaggttgaagcactggaagatgctctggaagccaatatcttgaactcgaccatggtcacgaggacctctgctaagttttgccagcgccgaaaaacgaaaagaccaacg

SEQ ID NO: 31235 - protein, 141 aa, Zea mays
  misc_feature: Ceres CLONE 1407484-F
MATFAKPENALKRAEELIHVGQKQSALQALHDLITSKRYRSWQKPLEKIMMKYVELCVDLRKGRFAKDGLIQYRIVCQQVNVSSLEDVIKHFMQLSHEKAEQAKSQVEALEDALEANILNSTMVTRTSAKFCQRRKTKRPT

SEQ ID NO: 31236 - DNA, 666 bp, Zea mays
  misc_feature: Ceres CLONE 1407485-F
  misc_feature (482)..(482): n is a, c, t, g, unknown, or other
  misc_feature (659)..(659): n is a, c, t, g, unknown, or other
  misc_feature (660)..(660): n is a, c, t, g, unknown, or other
aaagctggagctccccgcggtggcggccgctctagaactagtggatcccccgggctgcaggaattcgcacgagaccattacctagaacatcctaatcgaaaaagtgtttcgcactttgctattcagcttcgttcttcaccggttcaccctagccgccaccccaacccccagcgacagggaccttcgccgccaggccgcccccaatccctagcgactgcgagcaccgtcgccaggcgccgtgcagcgagcgtcgccgcctggcgaagtcgcgcgactcgtgccctgcagcgagcgccgctgtcccgcacccaccgtcgaacggctgccgatgcccaacgccctgcagcgagttgcgccgtcgtccgcttcctctcgctggtaacctcgtgtttcgatttggacagattgctcgtgacttggtgttgcgccgccgaccgagcctccttcccctaagtccctaaccgtaagtcctaaatcttggntgagttctgttcatgtgcatttgagcttacgcatctatgatacgcgccttaagggattgtgatctgtgatttaagggttgtgaaattgagatgccattttagggattggtggaagtgtgaactgtgccttactgaaatcgagatgccatttgagcaagttttcaactattttgttgnnattggc

SEQ ID NO: 31237 - DNA, 679 bp, Zea mays
  misc_feature: Ceres CLONE 1407486-F
  misc_feature: Encodes the peptide sequence at SEQ ID NO. 31238
  misc_feature (336)..(336): n is a, c, t, g, unknown, or other
  misc_feature (630)..(630): n is a, c, t, g, unknown, or other
  misc_feature (631)..(631): n is a, c, t, g, unknown, or other
aagctggagctccccgcggtggcggccgctctagaactagtggatcccccgggctgcaggaattcgcacgagaccattacctagaacatcctaatcgaaaaatccgctccccgccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcacctccacgagcccgaccaacaatcaggtcatcgcagaggtcgtggaggcgtccgtgcacgactacnaggagggcatgcgcgcctgcttcgatgccgccaagacatggatggcgattcctgctccaaagcgaggagagatcgttaggcaaatcggtgatgcactgagagcaaagctccatcaccttggcaggcttgtgtcacttgagatggggaaaattcttcctgaagggatcggtgaggttcaggaaatcatcgacatgtgtgattatgctgtggggctaagtcgccaactaaatggatccattataccatctgaacgaccaaaccatatgatggatggaggtgtgggatccccttggnnagttgtgggtgttataacggcattttatttcccctggtgctgtgcttg

SEQ ID NO: 31238 - protein, 173 aa, Zea mays
  misc_feature: Ceres CLONE 1407486-F
  misc_feature: SWISSPROT Homolog: EC 1.2.1.3 Aldehyde dehydrogenase (NAD(+))
  misc_feature (60)..(60): Xaa is any aa, unknown, or other
  misc_feature (158)..(158): Xaa is any aa, unknown, or other
MGAFAKEEHQFLAELGLAQRNPGAFACGAWGGSGPTVTSTSPTNNQVIAEVVEASVHDYXEGMRACFDAAKTWMAIPAPKRGEIVRQIGDALRAKLHHLGRLVSLEMGKILPEGIGEVQEIIDMCDYAVGLSRQLNGSIIPSERPNHMMDGGVGSPWXVVGVITAFYFPWCCA

SEQ ID NO: 31239 - DNA, 660 bp, Zea mays
  misc_feature: Ceres CLONE 1407488-F
  misc_feature: Encodes the peptide sequence at SEQ ID NO. 31240
  misc_feature (334)..(334): n is a, c, t, g, unknown, or other
  misc_feature (337)..(337): n is a, c, t, g, unknown, or other
  misc_feature (340)..(340): n is a, c, t, g, unknown, or other
  misc_feature (342)..(342): n is a, c, t, g, unknown, or other
  misc_feature (343)..(343): n is a, c, t, g, unknown, or other
  misc_feature (345)..(345): n is a, c, t, g, unknown, or other
  misc_feature (346)..(346): n is a, c, t, g, unknown, or other
  misc_feature (348)..(348): n is a, c, t, g, unknown, or other
  misc_feature (660)..(660): n is a, c, t, g, unknown, or other
tggagctccccgcggtggcggccgctctagaactagtggatcccccgggctgcaggaattcgcacgagaccattacctagaacatcctaatcgaaaaagcaggagaagagagacgacacagcagctttttgggtttccccttccctttccccgcgcggtgatcgcagggttctccgcgagcgaggcagagcactgcgcgtcctccgtgacttcctggtgatcgctgggggttctggacgttggtgtttcatttggttggttggtgggtggcagcagccgtggcgagatggacctgatgatgccggtgacgggaagagagtggcccccgcggagnagnagnannannangacgtggacgcggacgcggacgctccgcggccgatggaggggctgcacgaggtcgggccaccgccgttcctgaccaagacgttcgacctggtggccgacccggccaccgacgaggtcatctcctggggccgcgccggcaacagtttcgtggtctgggatccccacgtgttcgccgccgtgctgctccccaggttctttaagcacaacaacttctccagctttgtgcgccagctgaacacctatctagatggaccaggacaagggatgaacgaagctactacagcctacaagaaagaaacaaactgcttgttn

SEQ ID NO: 31240 - protein, 92 aa, Zea mays
  misc_feature: Ceres CLONE 1407488-F
  misc_feature (10)..(92): Pfam Name: HSF_DNA-bind Pfam Description: HSF-type DNA-binding
MEGLHEVGPPPFLTKTFDLVADPATDEVISWGRAGNSFVVWDPHVFAAVLLPRFFKHNNFSSFVRQLNTYLDGPGQGMNEATTAYKKETNCL

SEQ ID NO: 31241 - DNA, 680 bp, Zea mays
  misc_feature: Ceres CLONE 1407489-F
  misc_feature: Encodes the peptide sequence at SEQ ID NO. 31242
aaagctggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggccaagggcggtgagggggaatcggtgaaggaggaggtgagggagtatgagagcgacatgaggaagctggaggagctgctttctaagctgaacccctcggcggaggagttcgtgccgcagtcccgccgccgcgtggacggcggcgctccccgcctttcggacgacgcgcccgtgttcgtgtcgccggcgatcgactactacgcgcgccaccaccagctcccgccgccgcagcttctgcagcagcagcagccgatgcacgtggctgcaggtttgtgggtggcgtcagggggggttggaatggttggggcccggcgggatggactccagcacccacggatccgcca

SEQ ID NO: 31242 - protein, 146 aa, Zea mays
  misc_feature: Ceres CLONE 1407489-F
  misc_feature (57)..(74): Pfam Name: PAM2 Pfam Description: Ataxin-2 C-terminal region
MVAVAVDGLIRGADAVPAAEREAVRAAAAEAAAKGGEGESVKEEVREYESDMRKLEELLSKLNPSAEEFVPQSRRRVDGGAPRLSDDAPVFVSPAIDYYARHHQLPPPQLLQQQQPMHVAAGLWVASGGVGMVGARRDGLQHPRIR

SEQ ID NO: 31243 - DNA, 648 bp, Zea mays
  misc_feature: Ceres CLONE 1407490-F
  misc_feature: Encodes the peptide sequence at SEQ ID NO. 31244
  misc_feature (371)..(371): n is a, c, t, g, unknown, or other
  misc_feature (372)..(372): n is a, c, t, g, unknown, or other
aagctggagctccccgcggtggcggccgctctagaactagtggatcccccgggctgcaggaattcgcacgagaccattacctagaacatcctaatcgaaaaattttttcgactttcgagcgcagaaacgagagggccggagcagccgcagtcccggcgatcccgccgccggtcgccctcatacttcctcgtcactgccttcgtttctctttccacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgnncaagctgatggcaccagtcagattgctgctgggggttaccaggcaaaacaattactaccacaggggccgacgggcaaaaacacgggaaactttcttaacggaccggtctttgaacaaggtcccccgcttggtcctgggggggggttccttcccggggaaaacctggtttgggggaaaatgggggccgtttaacaaagttttacccccccaattgggcgccccagggttttttttgaaaccgggaaaacccgtttgcatttttatggggacaccaaa

SEQ ID NO: 31244 - protein, 113 aa, Zea mays
  misc_feature: Ceres CLONE 1407490-F
  misc_feature (50)..(50): Xaa is any aa, unknown, or other
MSRGGSAGGGQSSLGYLFGSGEPPKPAVAPAVSAPPAAAGAPPAEKPPAXQADGTSQIAAGGYQAKQLLPQGPTGKNTGNFLNGPVFEQGPPLGPGGGFLPGENLVWGKMGAV

SEQ ID NO: 31245 - DNA, 830 bp, Zea mays
  misc_feature: Ceres CLONE 1407491-F
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (50)..(50): n is a, c, t, g, unknown, or other
tgtagaggaatgagagggagaaaaggttggaaaaaaannnccacgcgccncggcaaaagtggagctccccgcggtggcgcccgctctataactactggatcccccgggctgcaggaattcgcacgagaccattacctagaacatcctaatcgaaaaaccagatgcggtccggcgtatgccggacccgatccccaatcacgccacccgacaccgggctccgtgtattccctacggggcgctgcgcgcccgacgtagaagaacggaggcgatggcggcgaagttgtcctcgtgtacgttgaaatgggaaacgaagcctcccttggcgctcggtgcaatcgcctccccctcgcaccacctgcccccgcgctcccctgcggcccccgcgccggggttcctccattcggtacgtctgtccgaggagatgcacggtcacatgccatgagaaatactacacccgggtccggccctcgtaagaaacagcatcgacaattaatggcgttgctctattttgaaagagaagtttccaggccagtacgaagaaccccttccttgggtcgaaaagaaatccaaatcacgaatcgcgcagaacaggactaaatgacatggggagggcatgcctgggggggttaaaatcacagggggggaaaccaaccccggaagatcccaagacattagcccccctgcgctgcatcccccgctatcctccaccacggagggagcacttaagttatgggccacgaaggcgagcgcccgctaatgaacaactctcccgggcgcgaagacgcccaactaaacggctttggcccctgcccacggtttaacagacggga

SEQ ID NO: 31246 - DNA, 662 bp, Zea mays
  misc_feature: Ceres CLONE 1407492-F
  misc_feature: Encodes the peptide sequence at SEQ ID NO. 31247
  misc_feature (662)..(662): n is a, c, t, g, unknown, or other
aagctggagctccccgcggtggcggccgctctagaactagtggatcccccgggctgcaggaattcgcacgagaccattacctagaacatcctaatcgaaaacgaaaaattcgaaagatccctccaggaaagatttttcttccctcctccgacgccccagcccaccaacacactctataaagcagccctcagtcacacacagaacgcacaagcgcaagccgggcaagaaaactccgtaggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctggcgagcccggaggcggcgcggttcgtgctggtgacgcaggcgcacctgttcaagccgacctacccgcggagcaaggagcgcatgatcgggccgtcggctctcttcttccaccagggcgactaccacctccgccn

SEQ ID NO: 31247 - protein, 135 aa, Zea mays; identical to SEQ ID NO: 23696
  misc_feature: Ceres CLONE 1407492-F
  misc_feature: SWISSPROT Homolog: EC 1.14.13.93 (+)-abscisic acid 8'-hydroxylase

SEQ ID NO: 31248 - DNA, 733 bp, Zea mays
  misc_feature: Ceres CLONE 1407495-F
  misc_feature: Encodes the peptide sequence at SEQ ID NO. 31249
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
ggggggggggnnnnntnnnttatattgtttttttttttttatctatgcgactccaaaactggagctccccgcggtggcggccgctctagaactagtggatcccccgggctgcaggaattcgcacgagaccattacctagaacatcctaatcgaaaaattaaacacatcacaggcaacacgcaaacaacacggtgttctcagacgcgatatcagccccaagtattccagcccggcttcagcagtaagaagagttggttgggattcagcaaaaacccgagatcgcaccccttcgcgtggcgatgcgtggaggagacgtaacagcagcggaggcagggtccccgcgctcgccggacctctacgatctctccgacgactccgactacgccgccgccgcttctgaccaaacggcgatgcggaccgatcccgcggacagagcctcaaaggagactgcgagggtggatgtggtatatgagaaggagcgtgtgaccatccacccgtcgcagtatggttccagtcgtatcaacgggaagctgcgtctgtttctgcagcagggatcattgttcctgagttgggagccaaacgaaggagccggctctttgtcaaccagttcaggtcggggtggaagtagaaaaatatagaaaatctggaccactatcaagggccttgccctttaaagtggatgaaccgcttcaatccggttaaggaacacccccaaacggtttggaactgggaa

SEQ ID NO: 31249 - protein, 112 aa, Zea mays
  misc_feature: Ceres CLONE 1407495-F
MRGGDVTAAEAGSPRSPDLYDLSDDSDYAAAASDQTAMRTDPADRASKETARVDVVYEKERVTIHPSQYGSSRINGKLRLFLQQGSLFLSWEPNEGAGSLSTSSGRGGSRKI

SEQ ID NO: 31250 - DNA, 670 bp, Zea mays
  misc_feature: Ceres CLONE 1407503-F
  misc_feature: Translation starting site: 489
  misc_feature: SWISSPROT Homolog: EC 2.3.1.170 6'-deoxychalcone synthase
aaagctggagctccccgcggtggcggccgctctagaactagtggatcccccgggctgcaggaattcgcacgagaccattacctagaacatcctaatcgaaaaaagtcaagtcggagcccgcaggtgtcgacaccgcgcgccgggagccggaagaagggtggggggtgagctgtggaccatgagcgcgaccgggcgagccccgtgcggcctgccgcgcatcggcctgggcacggcggtgcagggcccgcggccggaccccgtccgcgccgcggtgctgcgcgccatccagctcggctaccgccacttcgacacggccgcgcactacgccaccgaggcgccccatcggggaggccgccgccgaggccgtgcgcacggggctcgtcgcctcccgcgaggacctcttcgtcacgtcccaagggtctggtgcgccgacgcgcaccggggacagggtgctcccggccctccgccggacgctcagcaatctccagatggaatacgtggacctgtacatggtgcactggcccgtgaccatgaaggggcgggaaggttcacggcccccttcacgccccgagaacttcgagccgttcgacatggggggcccgtgtgggaggcccatgggaggaagtgccaaccgccctgggtcctgggcccagggcccattcgggggtgg

SEQ ID NO: 31251 - DNA, 709 bp, Zea mays
  misc_feature: Ceres CLONE 1407504-F
  misc_feature: Translation starting site: 216
  misc_feature (494)..(494): n is a, c, t, g, unknown, or other
  misc_feature (496)..(496): n is a, c, t, g, unknown, or other
  misc_feature (511)..(511): n is a, c, t, g, unknown, or other
ggagctccccgcggtggcggccgctctagaactagtggatcccccgggctgcaggaattcgcacgagaccattacctagaacatcctaatcgaaaaaaacgaatacgacctagctaggcacaagagcgctagacgccgcagcgcaacacgcaccacccaccgagcggcggcggatgtagggcaatccgcatggatcatagggcgctcgcgcaggcatgggcgcgccggagcacggcggcctcgacttgttcctcctgctctcgtggtgggggcaggggcggcccccgagtataggacgccgtaggaacgcacattgccagacacgggctccggggttaccgacgagccggagggcggggtcaagtgcaactcccggctggtgggggggctgcgattcgagtacacctagatgaaggagctgcgggaaaaagctttgctcctgcaggagttggaaggaggggacgggaacgcaaggggaacatccttcgagccgngnaacaaggggagggancgggacctgggaacccgggtttgaacgggttcctgctggggcccgcccccaccccaagaaacttaagggggactgccggctggaacacagggactcgcggcctgggcttcggtgccaccgaaacccctgggacccgggaaatagtcccagtaaaccaggttttggtgcgggaaaggcgcagtccccaaggtgtggggg

SEQ ID NO: 31252 - DNA, 691 bp, Zea mays
  misc_feature: Ceres CLONE 1407507-F
  misc_feature: Encodes the peptide sequence at SEQ ID NO. 31253
gctctagaactagtggatcccccgggctgcaggaattcgcacgagaccattacctagaacatcctaatcgaaaactcctccattcctctccctctctctctcgtcggtgggaccgtgggatacgctgacggacggacgggctgaggcaaggccgcctgcgggcgggaggaagaaaagcgaagctgctgcgccctcccctcccccatctccgccccccgcctcacccaccagacgagagagcgagcgcagttcggccgccggtcgcgtccgactccagcaaagccgagcgcccaccccctcaccctattaccttcctctcgggtccaattcggtgcctggctgactccgcacgttttccccccttttccctccctcgaccgacgaccgtccgtccaccacgggatccaggagcgaccctccctcgtgctcgtcgacgatcgaccggccgccgatcgtccaggaaggatgtcgagcctcgaggaggcgctgggtctcggagacctgcccaggttgagtataacaagactcggccgggtcgtgtccctgggccgctcgggagggcacgggccgacgacgacgaccccaggactgggaaaaacgggaagaaggtccctggaaaaagggggggccctcccaagggaatttccttcagggagggaattccctcctattccggggacccgggaggggc

SEQ ID NO: 31253 - protein, 75 aa, Zea mays
  misc_feature: Ceres CLONE 1407507-F
MSSLEEALGLGDLPRLSITRLGRVVSLGRSGGHGPTTTTPGLGKTGRRSLEKGGALPREFPSGREFPPIPGTREG

SEQ ID NO: 31254 - DNA, 675 bp, Zea mays
  misc_feature: Ceres CLONE 1407508-F
  misc_feature: Translation starting site: 184
  misc_feature: SWISSPROT Homolog: EC 3.4.23.12 Nepenthesin
tccccgcggtggcggccgctctagaactagtggatcccccgggctgcaggaattcgcacgagaccattacctagaacatcctaatcgaaaagtcatagagagccacaggccacaggcaagacaggcaggaggatcggacgagtcggcgaggaagctgcctgcttttcagatagagttattaagatggcgttgcttcggctgcttgccctgatctccctgctcttcgcagaggccactcctgtcagggacatcgcccacgatgcctgctcggcagaagtgaaggatttccagcacctgaacaacagctcggggctccacctgacgctgcaccacccgcagagcccctgctccccggcgccgctgcccgccgacctccccttctccgcggtgtcggccccacgacggcgcgcgcatcgcgtcgctcgccgcgcgcctcggcaagacgccgtcctctcgggccaccttgcttgacgagagccgcgcggggacgtcgtcgtcgtcccccgatgacgagtccctcgcgaccgtgccgctcggcccaggcacgtccgtcggcgagggcaactacgtcacccgcatgggcctcggcacgccggccgagtcttacgtcatggtcgtggacacgtggtccacggtcacctgggttccgtgctccccctgcgtcgtgacgggcca

SEQ ID NO: 31255 - DNA, 779 bp, Zea mays
  misc_feature: Ceres CLONE 1407512-F
  misc_feature: Encodes the peptide sequence at SEQ ID NO. 31256
  misc_feature (692)..(692): n is a, c, t, g, unknown, or other
aaagctggagctccccgcggtggcggccgctctagaactagtggatcccccgggctgcaggaattcgcacgagaccattacctagaacatcctaatcgaaaaaaaatccccacaaaccgctctctccctctcgcctcccgcccctaattcccatcccccacctccaaatcccacatcactcaaaaccctcgccgcgcccctgctgcgcgcccccccgatggcagccgtcgcgtcctcggaggaggccgtcaaggcggcgaaggtgctgatggtcggagcgggtggcatcgtctgcgagctgctcaagacgttcgctctctccggcaccggcgacatacaccccccttgacttggacacaagggaaggtacccataccgaacaaacctacctatgccttgaccgggcccacgttttccccaatttactagcccccgaatcccccggtatagcgggagctacaaatcagggccgggccgataagccatcgggaacacaaacaaatgcggacaccgactagaaaccctaccccccacatgtgggccccgcggacacccgccgaataaaatgccaaacgtaaagtcaccagcgccgggaaaacatccggaaaaccccccccctagaagtccaccccgctctgacgggtacgccaatctgagaagtatatcccctaccgccatattcgccaaagaangggggtaataattgaatccgatacgttccaccccgccgcaccgatcccccgctccccacgaattcgtcccgccccacatcactaccc

SEQ ID NO: 31256 - protein, 43 aa, Zea mays
  misc_feature: Ceres CLONE 1407512-F
MAAVASSEEAVKAAKVLMVGAGGIVCELLKTFALSGTGDIHPP

SEQ ID NO: 31257 - DNA, 724 bp, Zea mays
  misc_feature: Ceres CLONE 1407513-F
aaagctggagctccccgcggtggcggccgctctagaactagtggatcccccgggctgcaggaattcgcacgagaccattacctagaacatcctaatccaaaaagggcctagcaacaaatccgtatcccgagtccggcgacggcagtatccgagctcgcactcgcgcacccgtccatcggatcgcatttgtcctcccatcccctcagcgccaccgaaccgcaatcacacgcgcgccacccgcgatgacgccggcggcggcgatctccggctacagcagacacgctgtcgtctcctgcgcccgcctaaggcagccggtcacggtccctccgcgaaccggttgcccaatcggccgacgccgcctcgcccgtgacacggcgaggaggccgaggtcgccccccgggcgagccccgttgtgacccccccccgcggaggaaggagtgccaaacggggtcctaaaggatgcccttcaaaacccttggcttttggaaaggatacaaaaacggaaaatcttaaatcgaggcatcgaagggtagggcattggacaaaagtcgggggacaaaaaatttccaccggtccaaaagggaaaaaaaagggcccggggtttttgggaaaccaaagagagggaggacccccgtgcccctttgaaaaggcggaattttttttacatgggggggggggggggctttttttatgggggcccacagaggatatttcaggtgggggg

SEQ ID NO: 31258 - DNA, 706 bp, Zea mays
  misc_feature: Ceres CLONE 1407514-F
  misc_feature: Encodes the peptide sequence at SEQ ID NO. 31259
aaagctggagctccccgcggtggcggccgctctagaactagtggatcccccgggctgcaggaattcgcacgagaccattacctagaacatcctaatcgaaaaatcgaccaattcatccaatagtggatactttgtctccaagtctcaaaacccaattcgacccacttggaaccggccttgttccccgttggatccagcctaataaaattccccattccaacacacacagatctcgcatcccggcagtggcgacgaatctcgcggggcggaggtggtggcgcgacagaggcggtgtcgactccgacgaactcgcagccaccggtggatacgcaccagcagcaccggcgcactccaccgacgttcatatttaaggacttggtttggatagttctactcgtcaacaaaagtgattaaaaatggcggttcttgcagcttcaatcgtctcaaagtcggggaaagcacttgttttcagacagcttgttgacatgtctcgcataacaactgaaggaatacttgttgcgctccctaacctggtcgccaacgcgaaacagaccccttatgttcgaaccggaatggggtgttaggctccccccccatcggagggacttttttcccgactttccccccgccgccccgccccattctctgagtaccgcgccccctcggtgtttcttcccaagcccgcgcggcgacaattgccgtttta

SEQ ID NO: 31259 - protein, 55 aa, Zea mays
  misc_feature: Ceres CLONE 1407514-F
MAVLAASIVSKSGKALVFRQLVDMSRITTEGILVALPNLVANAKQTPYVRTGMGC

SEQ ID NO: 31260 - DNA, 669 bp, Zea mays
  misc_feature: Ceres CLONE 1407515-F
  misc_feature: Encodes the peptide sequence at SEQ ID NO. 31261
aaagctggagctccccgcggtggcggccgctctagaactagtggatcccccgggctgcaggaattcgcacgagaccattacctagaacatcctaatcgaaaaagacaaccaaacgaaccctcccggagcaggaaagcataggtgctcgagcgctccctcccgagctcctccgcctcacggtcacgcctcgtgtccccccaccccctcctcctcctcctcggacggacgcctcacgccgtcacctccgctcggcgagtctcggctccgaccgctgccgccacgtgcgacctcccctactcctgagagatctgcggagctcggcatggggtgaccatatcgggccgctgctcggcggtttccagctgaattttgcccgcagctcgtgtcggatgcagcgaagatggcggaggccggcgtggcacgcgcctcagggagcgctgtcgatgctttgttcaaggaactctggcatgcttgtgctgggccgttgatcacagtgcctcgccaaggcgagctggtttattacttcccccagagacatatggaacagctcgaatcgtctacagatcaacaacttgatcagcacttggctttgattaatctaccgcacaagatcctctgcaaggtgctcaatgtacaacttagagctgaaactgattctgatgaagctta

SEQ ID NO: 31261 - protein, 89 aa, Zea mays
  misc_feature: Ceres CLONE 1407515-F
MAEAGVARASGSAVDALFKELWHACAGPLITVPRQGELVYYFPQRHMEQLESSTDQQLDQHLALINLPHKILCKVLNVQLRAETDSDEA

SEQ ID NO: 31262 - DNA, 774 bp, Zea mays
  misc_feature: Ceres CLONE 1407517-F
  misc_feature (774)..(774): n is a, c, t, g, unknown, or other
ttgtttgggtggtgttttaggaggggagagaccgggagagaggccccaccaccccaaagctggagctccccgcggtggcggccgctctagaatagtggatcccccgggctgcaggaattcgcacgagaccattacctagaacatcctaatcgaaaagcgtttctttaccctaagcttttagctggtccaacgaaaggcacacagcccgacagccgccgctgtttcttcatcttcctcgcagcgccggcgctccttcttccgctccctctccgattcgcgctcggcacgcaggcgacggcggcggcgctcgtgctcggactctcagcgacggcgggcagtcccagactcggtgtcggcgtcagcgagtccccccttccgcctgttcaccaaatcgcctcgcgccctcgcctcccggtcctccgcaacaccgaccggcgccccctgcgtgcacgccctcccgctccccctcctggccttccgggtgggaaccggccgacggatgctcgggacccggaaggctgcacctgctgcgccgcgtggcgacccggtcgtgccaaacaggtcaagccaggcacccccgcgccccgcttttgggtaagacggcttaattacccccccaaaatggaaaccccttttaaccgggcccccctttaagcttcccttccaggcggccggttgtaaaacccgtggccgccttttaaggcggcccggatttttcttggcaaaaccccttggaattgtgtttggaaccggcgtctcttgcgaccaatacan

SEQ ID NO: 31263 - DNA, 600 bp, Zea mays
  misc_feature: Ceres CLONE 1407518-F
aaagctggagctccccgcggtggcggccgctctagaactagtggatcccccgggctgcaggaattcgcacgagaccattacctagaacatcctaatcgaaaaagaaatccatcccgatcctatcgtccccaatttcttctgctccacctaaatagatccgcacccgtagcctaggcgcgcacattgcatgaaagcatcgagcgaaaggtcgatagcacgcgcatagatgtaggtgtgagggcacggccggcagcgcttgacgggcgacgagtagaccctaacgctttgattgcggccggcgtcgtctgacccagacacgagtcgatacgctgacatgtctgtaaatcatcctccgccacatgctgggtcgtcgtcttttgcctgcggagggggtacagctgacttcccgctccctttccacctggaagaagaaccacccgccgcccgccgaaaggggccggccccttatgggggccgaggaggctatcttccattattaagcaaacagggggcatccggccccaatccgcttctttccaagggggaaccggaaaacccataaaccccccaaaaacggggtcaaaaggtaaagggggttgc

SEQ ID NO: 31264 - DNA, 653 bp, Zea mays
  misc_feature: Ceres CLONE 1407519-F
  misc_feature: Encodes the peptide sequence at SEQ ID NO. 31265
  misc_feature (387)..(387): n is a, c, t, g, unknown, or other
cgctctagaactagtggatcccccgggctgcaggaattcgcacgagaccattacctagaacatcctaatcgaaaaagtttcgacagtcgtcgtcccctctactctcccggcttccgcagaatcccagcttctctggccctctcactccaaacatcgggctccaggccgtctcccgccaacccaaattcgcttcccgccgctccccattaaacccgcttgaaaggtcgcgccctcgagcagagcaacccctgaccacaaatccgatccgtagccgccgtgcctcgatttcgtctcttcccctctgctcgagtacgagcggctactcccggcggcggcggcggcggcggcgatgagcgcggtgagctcgaccatatcaaggagctgatncagtggggaacagactacatcctcaaaaccttcattcatctgctgacacgatagacagattgtcgctcaggtgggtgtaggtgacacctctaaggcagcagtcagcctaatgaccattactgctggatgaagacagaggactcgactacaaaaggccagcaccgaggggcactcttgctcaaactaacggctgaaatggctgctgccctggctgcacttccataagggtcaaggacagaaaacctactccgacaaggtcggaaagg

SEQ ID NO: 31265 - protein, 32 aa, Zea mays
  misc_feature: Ceres CLONE 1407519-F
MKTEDSTTKGQHRGALLLKLTAEMAAALAALP

SEQ ID NO: 31266 - DNA, 681 bp, Zea mays
  misc_feature: Ceres CLONE 1407521-F
  misc_feature: Encodes the peptide sequence at SEQ ID NO. 31267
aaagctggagctccccgcggtggcggccgctctagaactagtggatcccccgggctgcaggaattcgcacgagaccattacctagaacatcctaatcaaaaaaaacaacacacgaacaccgcaccgcaacgtacccggctaggggaagagctctttccttcagctgtgccgagaacaacgcacggcacgctggttaggattgcatcgcccccgacaagaaagacgctgccgtgagcgggctgagcggacgggaaacaacaccaggcggtcgacatgacgagcgacagagcgctctccggctcggcgaacctcaagtgacgtcaagctggggtaccagcacctggggaaccacttcctgacgctgctgctggcgccgtcgatgaccgccacgacgctgaagctggcgcgcctcggacccggcgagctgctctcgctgtggggctcgctggagctggacctggaccacatcctctgctcggcgttcctggtcttcttcgtcggcaccgtgtacgtgatgtcgcggcccaggccggtgtacctggtggactacgcctgctacagctcccccgccagatgccgcgtgcccttcgccaccttcatggagcacacgcgcctcatcagcgacgacgacgagagcgtgcgcttccagaccaggatcctggagcgctcggggctcggcga

SEQ ID NO: 31267 - protein, 100 aa, Zea mays
  misc_feature: Ceres CLONE 1407521-F
  misc_feature: SWISSPROT Homolog: EC 2.3.1.119 Icosanoyl-CoA synthase
MTATTLKLARLGPGELLSLWGSLELDLDHILCSAFLVFFVGTVYVMSRPRPVYLVDYACYSSPARCRVPFATFMEHTRLISDDDESVRFQTRILERSGLG

SEQ ID NO: 31268 - DNA, 796 bp, Zea mays
  misc_feature: Ceres CLONE 1407525-F
atagagatggttaaaaaaaataagaagaaggagggttagagatttctttccaatgctggagctcaccgcggtggcgggcgctctataactagtggatcccccgggctgcaggaattcgcacgagaccattacctagaacatcctaatcgaaaatcgcagccagcaggacaccactcatcttcgtctcccccgcctcgtttccatcgccgccacccgcttcgcctgcggtcctccccagtaccactcccacccccctcgtctccgcctccactggagctgccgtcatggagagcctcctcctgcccaccgctgtcgtggccccggtggcgtctgcgtgcgcaaggcggaatctcccgcgacgcctctccgtgcgcgcctccgcgacggtggtagcggcaccgcggtgggagacggatcccaagaagagcgtgcggagcacgacgcatgggactggtcctctgctttccgcaacgatgtagacgtttacctagcgaccgcccgcctatccgcggagaggggcatcgggtccaatacgaccgttcggaacaattaaaaccctcccccacccacgctttgccggggataaatcccgggtcctcccccaacccgagggaagacacccggtctggcatagagacaacccccccgtcccatgaacggactggcacccccggattgcgggctatccctcaaggcgccaaaataaaggggccagaccgagaggccttcaggagatggctggccctatctgggggttccattgccccattcggtaataatggagtgggggcccggg

SEQ ID NO: 31269 - DNA, 668 bp, Zea mays
  misc_feature: Ceres CLONE 1407526-F
  misc_feature: Encodes the peptide sequence at SEQ ID NO. 31270
atagctggagctccccgcggtggcggccgctctagaactagtggatcccccgggctgcaggaattcgcacgagaccattacctagaacatcctaatcgaaaaattccccttccacctcgctctctctctctctcctcccactgctcgccctctctctcttacgcgcgcgtgacaacctccctccctccactgcgcgcggtgcgggagcagcagcggcagcacccaccgactgatcgccggtggacggggcgggggcgatctgatgcgggcgcggaggtgatggcagcgccatccggagatgggggcggcggtgcggaaaagggctcctcctcggccgccgcagctgcgacgatcggggtccacggtagcggaccaagttgcagaggcgatgtggcagatgaatttggaagaagccatggaactggggccatacccagagcgtgctggggagccacactgtatgtattacatgaggactggcatgtgcacgcttgggattacctgtaaatttaatcacccagaatacagaaagctggctgttgctgctgcaagaatgaagggagaatatcctcaaagaattgggcagcctgaatgacaatactatctgaagactggcacgtgcaagtatggagctacttgcaagtttcatcatccccgagaaaaggctg

SEQ ID NO: 31270 - protein, 98 aa, Zea mays
  misc_feature: Ceres CLONE 1407526-F
  misc_feature (49)..(75): Pfam Name: zf-CCCH Pfam Description: Zinc finger C-x8-C-x5-C-x3-H type (and similar)
MGAAVRKRAPPRPPQLRRSGSTVADQVAEAMWQMNLEEAMELGPYPERAGEPHCMYYMRTGMCTLGITCKFNHPEYRKLAVAAARMKGEYPQRIGQPE

SEQ ID NO: 31271 - DNA, 706 bp, Zea mays
  misc_feature: Ceres CLONE 1407527-F
  misc_feature (246)..(246): n is a, c, t, g, unknown, or other
  misc_feature (247)..(247): n is a, c, t, g, unknown, or other
caaagctggagctccccgcggtggcggccgctctagaactagtggatcccccgggctgcaggaattcgcacgagaccattaacctaagaacatcctaatcgaaaatccacgagcccaaccggctagcttcttcttcgtccgctgttacccacaccgcgagaagcctccatgcgatcccctgtgcggtgcctaccagcgccggcgcgggtcgtcgcgggtgccctcctcctcgtagatatcacgggnngagccgttggcgtccatgcgtacgtcggccgaatgagttgtacatgaaccaccaggccctgcagatggtatgactcaagttgcacggggtttatcccttccgtcttcggttcttcgccgttactaaacctttcttctggcgaatcttttggtggtgcggcccgggaatgggcatacccccgtttggctcaaagaaggtgtggaaaagccaaaaacccaagttcttctaattttgacgaggtttccgaaatgtaaattttttttagggaaacccctaggaggggggacctttttttttttgggagggggcaaattggcaaatttttgagaacccctttgggctggggtaaggaggttggccaatttgggggggtacaaaaaaaccccggggcaaggggcgccccaagtttccacgggccccggggggtgtgggaaaattgtggggggcctttttgacttt

SEQ ID NO: 31272 - DNA, 708 bp, Zea mays
  misc_feature: Ceres CLONE 1407530-F
  misc_feature: Encodes the peptide sequence at SEQ ID NO. 31273
  misc_feature (366)..(366): n is a, c, t, g, unknown, or other
  misc_feature (374)..(374): n is a, c, t, g, unknown, or other
  misc_feature (377)..(377): n is a, c, t, g, unknown, or other
  misc_feature (499)..(499): n is a, c, t, g, unknown, or other
  misc_feature (521)..(521): n is a, c, t, g, unknown, or other
cgctctagaactagtggatcccccgggctgcaggaattcgcacgagaccattacctagaacatcctaatcaaaaaaattgcgacgccgccgccgtcactgtcgccgcaggagtgcgaaccacgctgccgcccgctcccgccgcccaaacagctttatccgagccccgattcgccggatcacatgctgcggccacctctcaaatgacctctcaactccagagcactttgctcctgctcccgctcttcgccgccgctgctttgggccgcggcggcgacgcctcgactgcgccgtcgctggagttccaccatcggttctccgcaccgctgcggcggtgggtggaggcccgagggcgcgcgctccctggncgggtggncgnctcccggcagcgccgcgtacgtcgccgcccttggcgggcacgatcgccaccgggcggtgtcggcagcagggggtagtaagcagcgacgcaccaccgctcacttttcgcgaggggaatgccancccctcaggtcagcaacctcgnattttttgactatgcttcttgggaccggtgggacaccgggccaaaacgtcatggtgggcgctggaaacagggaagggatcccttccggctgcctttggcagggggacggttgcaccccctccagccatggggggccttggagaaaataacatttaaactcccgtggaaggcgcgaaataaaaaaaaa

SEQ ID NO: 31273 - protein, 83 aa, Zea mays
  misc_feature: Ceres CLONE 1407530-F
  misc_feature (58)..(58): Xaa is any aa, unknown, or other
  misc_feature (59)..(59): Xaa is any aa, unknown, or other
MTSQLQSTLLLLPLFAAAALGRGGDASTAPSLEFHHRFSAPLRRWVEARGRALPGRVXXSRQRRVRRRPWRARSPPGGVGSRG

SEQ ID NO: 31274 - DNA, 690 bp, Zea mays
  misc_feature: Ceres CLONE 1407532-F
  misc_feature: Encodes the peptide sequence at SEQ ID NO. 31275
  misc_feature (405)..(405): n is a, c, t, g, unknown, or other
  misc_feature (489)..(489): n is a, c, t, g, unknown, or other
  misc_feature (666)..(666): n is a, c, t, g, unknown, or other
  misc_feature (667)..(667): n is a, c, t, g, unknown, or other
  misc_feature (674)..(674): n is a, c, t, g, unknown, or other
caaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatggnagagcgagtgccgcgagcggcaccagcaagctgacgcgggcgaggacggcgacagcggcgtggacgcctacgtctccgctcggnaaaggggcgagtgccggcgccagtgcctgcgccgccacgagggccagccgtgggagaccccagagtgcatgaggcggtgccgccgccgcggactgggcgtcgacatggagcaagagtacggtcgcggcagccagagcgcgggcagtgccccggagaagtgcgagcgccacaccgcgnngactggntgggagagcagcgctg

SEQ ID NO: 31275 - protein, 158 aa, Zea mays
  misc_feature: Ceres CLONE 1407532-F
  misc_feature (64)..(64): Xaa is any aa, unknown, or other
  misc_feature (92)..(92): Xaa is any aa, unknown, or other
  misc_feature (151)..(151): Xaa is any aa, unknown, or other
MGKGSVGASWWAFLLLAGVLLVVAATAGAEDGVVERDRKEDLRWCKQACEWQYGKDTPRKREWXSECRERHQQADAGEDGDSGVDAYVSARXRGECRRQCLRRHEGQPWETPECMRRCRRRGLGVDMEQEYGRGSQSAGSAPEKCERHTAXTGWESSA

SEQ ID NO: 31276 - DNA, 712 bp, Zea mays
  misc_feature: Ceres CLONE 1407533-F
  misc_feature: Encodes the peptide sequence at SEQ ID NO. 31277
  misc_feature (410)..(410): n is a, c, t, g, unknown, or other
  misc_feature (576)..(576): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
gctctagaactagtggatcccccgggctgcaggaattcgcacgagaccattacctagaacatcctaatcaaaaaggacccttgtttgcctatacgctgccaggctgccttttctaagttcttcttccatcgctccacccccacccccttctctctcgtagcaacgtttggggcgccgtcgctgccgctctactcgggtgcccaggtcttgttcgggcccttcgccggcgagccaggggacactttctttggtatgagaggatcaatgtccaattattatgatgattacgacgacattgatgagattgaggatgactatcatatggatgatcctgctgatgacatggtagacgagcagcgaggggttagggattctgatgcggaggataatgattatggacaacgaatgancagatcccagatacttcatcagcagatgcaggaaatggaagggacattcaagggataccctgcgagcagctacacataacccgtaaaaaatatagactgtcagattacacagtacaaaattataatgactatcgaagactatagtgacacagaggagcatgtaaantttagnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31277 - protein, 74 aa, Zea mays
  misc_feature: Ceres CLONE 1407533-F
  misc_feature (49)..(49): Xaa is any aa, unknown, or other
MSNYYDDYDDIDEIEDDYHMDDPADDMVDEQRGVRDSDAEDNDYGQRMXRSQILHQQMQEMEGTFKGYPASSYT

SEQ ID NO: 31278 - DNA, 647 bp, Zea mays
  misc_feature: Ceres CLONE 1407534-F
  misc_feature: Encodes the peptide sequence at SEQ ID NO. 31279
  misc_feature (389)..(389): n is a, c, t, g, unknown, or other
  misc_feature (469)..(469): n is a, c, t, g, unknown, or other
aagctggagctccccgcggtggcggccgctctagaactagtggatcccccgggctgcaggaattcgcacgagaccattacctagaacatcctaatcgaaaactaattgagcatcgcagagataggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattggggggaggtgatgatgctttcaacaccttcttcagtgagactggntgctggaagcacgtgccccgtgctgttttttgtgaccttgacccactgtcatcgatgaggtgagaactggcacctaccgncagctcttccaccctgagcagctcatcagtgggaaggaggatgcagccaacaacttttgccgtggtcactacaccattggcaagggagatgtgacctgtgccttgatcgcatcaggaagcttgccgacaactggactgggctccagggctttctcggcctcaaggctggttgggggag

SEQ ID NO: 31279 - protein, 45 aa, Zea mays; identical to SEQ ID NO: 16956
  misc_feature: Ceres CLONE 1407534-F

SEQ ID NO: 31280 - DNA, 721 bp, Zea mays
  misc_feature: Ceres CLONE 1407535-F
  misc_feature: Encodes the peptide sequence at SEQ ID NO. 31281
  misc_feature (10)..(10): n is a, c, t, g, unknown, or other
  misc_feature (22)..(22): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (76)..(76): n is a, c, t, g, unknown, or other
  misc_feature (78)..(78): n is a, c, t, g, unknown, or other
  misc_feature (100)..(100): n is a, c, t, g, unknown, or other
  misc_feature (102)..(102): n is a, c, t, g, unknown, or other
  misc_feature (104)..(104): n is a, c, t, g, unknown, or other
  misc_feature (105)..(105): n is a, c, t, g, unknown, or other
  misc_feature (135)..(135): n is a, c, t, g, unknown, or other
  misc_feature (138)..(138): n is a, c, t, g, unknown, or other
  misc_feature (141)..(141): n is a, c, t, g, unknown, or other
  misc_feature (154)..(154): n is a, c, t, g, unknown, or other
  misc_feature (180)..(180): n is a, c, t, g, unknown, or other
  misc_feature (227)..(227): n is a, c, t, g, unknown, or other
  misc_feature (257)..(257): n is a, c, t, g, unknown, or other
  misc_feature (264)..(264): n is a, c, t, g, unknown, or other
  misc_feature (266)..(266): n is a, c, t, g, unknown, or other
  misc_feature (272)..(272): n is a, c, t, g, unknown, or other
  misc_feature (274)..(274): n is a, c, t, g, unknown, or other
  misc_feature (276)..(276): n is a, c, t, g, unknown, or other
  misc_feature (285)..(285): n is a, c, t, g, unknown, or other
  misc_feature (318)..(318): n is a, c, t, g, unknown, or other
  misc_feature (334)..(334): n is a, c, t, g, unknown, or other
  misc_feature (390)..(390): n is a, c, t, g, unknown, or other
  misc_feature (455)..(455): n is a, c, t, g, unknown, or other
  misc_feature (501)..(501): n is a, c, t, g, unknown, or other
aagaagacancggcgggccccnccnnnnaggggnnnnngggggtgnncccaaagtggaggttccttggaggaggangnggcttcataacgggcccccggncngnnggtatcaaacaacgcggttaccgggaacanccnaancgaaaaagaggcnaaacccccgtttaaccctgctgccgngccgcttgccactactccgcttcgttctccgccgcctccccggacgnccggaaacttctagattgaagggggatagncattggngncaacgngngngatggaggncaggggactggggcagctcctggcggcgctggncgcggagatcttcgtncgcgccatcgagggaacaggacccgccctccttccgccggcggaggacacggaggncgacgaggccgacgcgtaggctggcgagggaggaggaggaggagtgccgcccgtgaccatccggngggctcgcatcacctgcgcactgaagaacaagcgcggggaagtggnaaggtttctggtgtcaaatgtgtcacgggaggcgaaaccggggaggctgcttgcactaatggggccatcgggctctggcaaaacaactttgctcaatgtgctagcagggcagctcgccgcatcgccttccttgcacctttccgggattccgaatatcaaaggacggcctatctcgaagggcggatataagattgcttttgccaggccaggaagacccggt

SEQ ID NO: 31281 - protein, 43 aa, Zea mays
  misc_feature: Ceres CLONE 1407535-F
  misc_feature (3)..(3): Xaa is any aa, unknown, or other
  misc_feature (14)..(14): Xaa is any aa, unknown, or other
  misc_feature (38)..(38): Xaa is any aa, unknown, or other
MEXRGLGQLLAALXAEIFVRAIEGTGPALLPPAEDTEXDEADA

SEQ ID NO: 31282 - DNA, 731 bp, Zea mays
  misc_feature: Ceres CLONE 1407536-F
  misc_feature: Encodes the peptide sequence at SEQ ID NO. 31283
  misc_feature (425)..(425): n is a, c, t, g, unknown, or other
  misc_feature (427)..(427): n is a, c, t, g, unknown, or other
  misc_feature (625)..(625): n is a, c, t, g, unknown, or other
  misc_feature (636)..(636): n is a, c, t, g, unknown, or other
  misc_feature (691)..(691): n is a, c, t, g, unknown, or other
  misc_feature (692)..(692): n is a, c, t, g, unknown, or other
  misc_feature (715)..(715): n is a, c, t, g, unknown, or other
caaagctggagctccccgcggtggcggccgctctagaactagtggatcccccgggctgcaggaattcgcacgagaccattacctagaacatcctaatcgaaaaaggtcgacgcatcttcgcctccgctcaacgctcgcccacgcccgccgcccccccaccgatccacgagaaaccttctcgcctccgcgggacgattcgccagggagagcaaaggtagcagaggcgccatggacgctgccaagtcggtgacgccgggcgccgtgtcctacatcctggcgcacccgtctacgggctccaatggcgccgtgtcggatctcgtcgttcaggtcctcgatctcaagtccatcggcatgggcaggccggttcagtttcacggcaagccgatgggaacgacaaaatcaaggcgatgctccccacttacttngncgtcggaggtccactccggcaatctgaaaagaaatttcggtctcatccgcatcctcgactacacttggcaactccgtcaaaggcaacgctgacaaaagtcctgattgtcgtcaaatggcgagactgtgtgcgaagcgctcggacgccgagatcaacggcgaggccaaagaaagaggatccctccattgtgctgaagcntaaagacgaanggctccagtcgtggctgaggaaacaaattctcccccactcgtgatgaagctaagnnaaagaggtgaagtcgcggtccanaatcgtgacttgagca

SEQ ID NO: 31283 - protein, 96 aa, Zea mays
  misc_feature: Ceres CLONE 1407536-F
  misc_feature (66)..(66): Xaa is any aa, unknown, or other
  misc_feature (67)..(67): Xaa is any aa, unknown, or other
MDAAKSVTPGAVSYILAHPSTGSNGAVSDLVVQVLDLKSIGMGRPVQFHGKPMGTTKSRRCSPLTXXSEVHSGNLKRNFGLIRILDYTWQLRQRQR

SEQ ID NO: 31284 - DNA, 707 bp, Zea mays
  misc_feature: Ceres CLONE 1407540-F
  misc_feature: Encodes the peptide sequence at SEQ ID NO. 31285
aaagctggagctcaccgcggtggcggccgctctagaactagtggatcccccgggctgcaggaattcgcacgagaccattacctaaaccatcctaatcgaaaatctccccacgcgtttgcttcttcaagcattgaccccttccgccccgaccgtcatcttccccacctctctccgcactgcaggagcttgcgggcgtggcggcggccgagaccggcgctggagatcttggacgcgcgcgacatcctggtctccgctctgtgcctctggtctccgaaggcgccgccaccctatttttttttaaaaaaaatcctaagatagtttcttcagtccgacaccgcttctagcttcccctcggcgatctgtgaagctatgaagccacctctcgagaggaacccgactaagaagcgccactcgtggtggtgggacagtcacattagccctaagaactcgaaatggctcgtcgaaaatctcgaagaaatggactagcaagtgaaggaaatgctccagctgatcgaggaggacggcgactccttcgctaagaagcgcaaatgtattaccagaggcggtcgatgctcgtcacccacgtcgagaacttctacgtatgtatcgtgttctagccgagggctatacaagggaccggggagctggcaagacatccttacagggtgggaaaaacgggattttaacaggtcaaaagaaggttgggg

SEQ ID NO: 31285 - protein, 38 aa, Zea mays
  misc_feature: Ceres CLONE 1407540-F
MKPPLERNPTKKRHSWWWDSHISPKNSKWLVENLEEMD

SEQ ID NO: 31286 - DNA, 659 bp, Zea mays
  misc_feature: Ceres CLONE 1407544-F
  misc_feature: Encodes the peptide sequence at SEQ ID NO. 31287
  misc_feature (639)..(639): n is a, c, t, g, unknown, or other
ggagctccccgcggtggcggccgctctagaactagtggatcccccgggctgcaggaattcgctcgagaccattacctagaacatcctaatcgaaaaagctgcggcgccaccctcggcctcgggccgtccgccgtcggcggccacgaccctggtgtaatctgctccatacgtggcggcgcctgcaaaagccacgctgctgccagtgccagccatggatgcagtggcggccagcgacgccgtactcctccttgctaccgtagctatctccctgctcatcactgccactttctggagcaggcatcgtcgtcagggcgaagcgccgagcccgccgtcgctaccgctgctgggccacctccacctgctcggcaacggcaagccgctgcaccacacgctggcggcgctggccatcgcgcgcggcaccgggggcgccccggcgccgctcctgtcgctgcgcctgggcgcgcggcgcgcgctgctggtgtcgtatcacgccgcggccgaggagtgcttcacggcgcacgacgccgcgctgggcggccggacgcggctgctggtcggtgacaggctcaactacgggtacaccacggtgggctggtcctcgcacggcgaccactggcgcgccctccgccggatcatggnacgtggagctgttcgccgcg

SEQ ID NO: 31287 - protein, 149 aa, Zea mays
  misc_feature: Ceres CLONE 1407544-F
  misc_feature: SWISSPROT Homolog: EC 1.14.13.89 Isoflavone 2'-hydroxylase
  misc_feature (143)..(143): Xaa is any aa, unknown, or other
MDAVAASDAVLLLATVAISLLITATFWSRHRRQGEAPSPPSLPLLGHLHLLGNGKPLHHTLAALAIARGTGGAPAPLLSLRLGARRALLVSYHAAAEECFTAHDAALGGRTRLLVGDRLNYGYTTVGWSSHGDHWRALRRIMXRGAVRR

SEQ ID NO: 31288 - DNA, 648 bp, Zea mays
  misc_feature: Ceres CLONE 1407545-F
  misc_feature: Encodes the peptide sequence at SEQ ID NO. 31289
  misc_feature (382)..(382): n is a, c, t, g, unknown, or other
tggagctccccgcggtggcggccgctctagaactagtggatcccccgggctgcaggaattcgcacgagaccattacctagaacatcctaatcgaaaaattacggctgaagggagtcgctcgccgccgcgttcgaggcgttccctcgtcgcgctcgcgccgtcgaccttcaccgctcgctgtcaggtctgcccgccacgacctcgccggccacactcgcagctcgccctcgctcctacgcctcgccggcgaggccttctgccttttcgcgccctctatctgctgcgatctttggagcatcgttctcttctctcacttgagatccagacccctaaaccctagagctcgccgcttccgctcgctcgctccgcgctggcggcgacnatggaggacgaggagatggagaagaaggtgcagcagtacttgcagcgcaagggtttccgcctcactgagcttgcgctccaggaggagtgcaaccgcctctccacctccgccatctccgacgttgcgcttgcacggtctgacaatgatccagcgagatactacgatggatatagcagattaagaacatgggcatacagttctcttgatcaatataagcacgaattacttcgcgtcctttatccagttttcatccatagcttcatgga

SEQ ID NO: 31289 - protein, 88 aa, Zea mays
  misc_feature: Ceres CLONE 1407545-F
MEDEEMEKKVQQYLQRKGFRLTELALQEECNRLSTSAISDVALARSDNDPARYYDGYSRLRTWAYSSLDQYKHELLRVLYPVFIHSFM

SEQ ID NO: 31290 - DNA, 729 bp, Zea mays
  misc_feature: Ceres CLONE 1407546-F
  misc_feature: Encodes the peptide sequence at SEQ ID NO. 31291
aaagctggagctccccgcggtggcggccgctctagaactagtggatcccccgggctgcaggaattcgcacgagaccattacctagaacatcctaatcgaaaaattacaaccgaccaacgcgctttgcaacgcctccgctgcaatcagcccccgcggcgagattgccctgcccctgagtgctagttctcgccgttacgtaaggcttcttggccttgcgtcctccgtctttcgttgctgatacatcgaggtattaaagaagctgcctggttccgggcagcagaggtcgccgccgcctgcagcaatggccgacttctcctggctcacggtgcttggcttcctattcctcaccttcaactcaggcatggcgatttatcggtccaacggtgacgccggctccgtcgctttcgtcgtggtatcttatctcgacctggtggcccctgttcgcctgcttgcgctactacgagcagttggatcagcagcactccccaaagcgcgcgagggtcaaagcctggggtttggagcctcacgacccctccttactatcatgttcaggttacagggtggttgaaaatattgcccctgccaatcaaacttgttggctggttcaatggcaacccttaccccctggggggggttttaacttttttttcgccccaaagaaaaaaccttgaatgggcccggggggggccccccggcccccccggggcaaagggtgcccccccccaaata

SEQ ID NO: 31291 - protein, 88 aa, Zea mays
  misc_feature: Ceres CLONE 1407546-F
MADFSWLTVLGFLFLTFNSGMAIYRSNGDAGSVAFVVVSYLDLVAPVRLLALLRAVGSAALPKAREGQSLGFGASRPLLTIMFRLQGG

SEQ ID NO: 31292 - DNA, 753 bp, Zea mays
  misc_feature: Ceres CLONE 1407547-F
  misc_feature: Translation starting site: 166
  misc_feature: SWISSPROT Homolog: EC 1.6.99.5 NADH dehydrogenase (quinone)
aaagctggagctccccgcggtggcggccgctctagaactagtggatcccccgggctgcaggaattcgcacgagaccattacctagaacatcctaatcgaaaagatctccccaatccgaccagaccgggaggcaccttcgactcgagcggagcaggcgaggcagagatggcgctgcgacgggcgctcctcagatcggtcaacttctcccccgacagcaaggctgcaattgagtacttttattctttctcaagggcacaggctgcttgttctctcaatggggctggcctttgtcctgctagtagatcatttagcacccaggctgccactacgtcaagcacaccacagactccacctccaccaccccctccagagaagactcactttggtggtctcacagatgaggatcgcattttcaccaacctctatggtctgcatgacccttttctgaaaggcgcggtgaagagaggtgactgccataggaccaaggatttggtgattaaggcggcagactggatagttaatgaactgaagaaatcaggtcttcgaggatcgaggaggcgctggttctccctctggtctgaaatggtcctttatgcccaaggtttctgatggacgcccttcattatctggtgattatgctgatgatagcgagcctggtacttggcaagatagagaaatcatgcgtcgagacccccacagcttctggaaggatgccattatgactgcagtgtatcgaggcatcagctgcttact

SEQ ID NO: 31293 - DNA, 671 bp, Zea mays
  misc_feature: Ceres CLONE 1407555-F
  misc_feature: Encodes the peptide sequence at SEQ ID NO. 31294
  misc_feature (569)..(569): n is a, c, t, g, unknown, or other
aagctggagctcaccgcggtggcggccgctctagaactagtggatcccccgggctgcaggaattcgcacgagaccattacctagaacatcctaatcgaaaagaccctcgcttcacttgtcacggactcgcgtccacaaaccacaaccagctcactcaagaacaaagaacccaacccatggcttctcccaagccgctcctcctgctcgccacctcgttcctgagctgcggcctcctggtggccgccgactacgccccaatgaccctgaccgtggtgaacaactgcccctacccggtgtggccgggcatccaggccaactccgggcacgacgtcctggagggcggcggcttcttcctcccgccgctctcccacaagtccttcccggcgccggcccacccctggtccggccgcatctgggcgcgcacgggctgcgcgggcgccggcgcgcagctccactgcgccacgggcgactgcggcggccggctccagtgcggcgggctcggcggcgcggcgcccgcgacgctggcgcaggtgaccctccaccacggaaacgaccagaactcgtacggngtgaaccgcgggggacggtttcaacgggggccctgtccgggaaccccgaagaaggggccgggaaaactgcccccgtccccgcctggccgaaaaaacctcccg

SEQ ID NO: 31294 - protein, 165 aa, Zea mays
  misc_feature: Ceres CLONE 1407555-F
  misc_feature (34)..(165): Pfam Name: Thaumatin Pfam Description: Thaumatin family
MASPKPLLLLATSFLSCGLLVAADYAPMTLTVVNNCPYPVWPGIQANSGHDVLEGGGFFLPPLSHKSFPAPAHPWSGRIWARTGCAGAGAQLHCATGDCGGRLQCGGLGGAAPATLAQVTLHHGNDQNSYGVNRGGRFQRGPCPGTPKKGPGKLPPSPPGRKNLP

SEQ ID NO: 31295 - DNA, 659 bp, Zea mays
  misc_feature: Ceres CLONE 1407556-F
  misc_feature: Encodes the peptide sequence at SEQ ID NO. 31296
  misc_feature (328)..(328): n is a, c, t, g, unknown, or other
  misc_feature (329)..(329): n is a, c, t, g, unknown, or other
  misc_feature (488)..(488): n is a, c, t, g, unknown, or other
  misc_feature (499)..(499): n is a, c, t, g, unknown, or other
  misc_feature (531)..(531): n is a, c, t, g, unknown, or other
  misc_feature (642)..(642): n is a, c, t, g, unknown, or other
aaagctggagctccccgcggtggcggccgctctagaactagtggatcccccgggctgcaggaattcgcacgagaccattacctagaacatcctaatcgaaaagaccctcgcttcacttgtcacggactcgcgtccacaaaccacaaccagctcactcaagaacaaagaacccaacccatggcttctcccaagccgctcctcctgctcgccacctcgttcctgagctgcggcctcctggtggccgccgactacgccccaatgaccctgaccgtggtgaacaactgcccctacccggtgtggccgggcatccaggccaactccgggacannggtcctggagggcggcggcttcttcctcccgccgctctcccacaagtccttcccggcgccggcccacccctggtccggccgcatctgggcgcgcacgggctgcgcgggcgccggcgcgcagctccactgcgccacgggcgactgcggcgggcggtcccnagtgcggcggnctcggcggcgcggcgcccgcgacgctggcgcnggggaacctccaccacggcgacgaccagacctcggacggcgggagcgggggggacggcttcaacgggggcccgaccgcgaccccgcacgagggccgcgggaaagggcccgncctcccctgccgaaaga

SEQ ID NO: 31296 - protein, 160 aa, Zea mays
  misc_feature: Ceres CLONE 1407556-F
  misc_feature (51)..(51): Xaa is any aa, unknown, or other
  misc_feature (104)..(104): Xaa is any aa, unknown, or other
  misc_feature (108)..(108): Xaa is any aa, unknown, or other
MASPKPLLLLATSFLSCGLLVAADYAPMTLTVVNNCPYPVWPGIQANSGTXVLEGGGFFLPPLSHKSFPAPAHPWSGRIWARTGCAGAGAQLHCATGDCGGRSXVRRXRRRGARDAGAGEPPPRRRPDLGRRERGGRLQRGPDRDPARGPRERARPPLPK

SEQ ID NO: 31297 - DNA, 690 bp, Zea mays
  misc_feature: Ceres CLONE 1407558-F
cgctctgaactagtggatcccccgggctgcaggaattcgcacgagaccattacctagaacatcctaatcgaaaagatccgatggtccgcgacaccgctcgcctcctccccatcttcctcccatggcggagtcctcccccgccctgcctcctccgccggggcttcctaaaccctagcagccccagaacctccgagcgcgtcgacaccctcgttctccctggagacgagcgcttgcccttcccctcgcccccacgcctcccgaaccagctgcgtcctgactacgggagtggcggcggaggcggcgctccctcgaccatcgcggtcatcgtcacctcactcggcggaggccctgcagaggtggtaatcgtgcggaccaccaggccccatgccgtcgcccccaccccagaagagttaactggccagccgagataatggagggtctcattacaaggacggcgtctactcccttagtcacagcacaacaccggctacacccccgaaataaacgcgatttaacccctcgcgaccggcaagacacaaaagcccaccctggttctccccaccaacagcgcagtcccacgaaggcattgccccacgcccactcttccccgaatggcgtaaatttgaatctatagccaccctcgccctccggaccgcccgactggcaaacctcccccgccctgcacgcccc

SEQ ID NO: 31298 - DNA, 596 bp, Zea mays
  misc_feature: Ceres CLONE 1407561-F
  misc_feature (351)..(351): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (394)..(394): n is a, c, t, g, unknown, or other
  misc_feature (403)..(403): n is a, c, t, g, unknown, or other
aagctggagctccccgcggtggcggccgctctagaactagtggatcccccgggctgcaggaattcgcacgagaccattacctagaacatcctaatcgaaaaaataattctagtattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaatcaatttcttcgtccgccttncgccctgcttacgtccccgctactacccnnntagatcatctgncttttctcngttcttatccgactcttcttcggtttatgcctatcagttatgagggtgaacgccctcagaagcttctctactagattagtgaaaaatagagactttggtcgagtttaaccttgggctgaaaaaattagcccccgggcccgggttaaattttgctaaccaataaggcttggaattaaacgaaaaaggattgggg

SEQ ID NO: 31299 - DNA, 754 bp, Zea mays
  misc_feature: Ceres CLONE 1407564-F
  misc_feature: Encodes the peptide sequence at SEQ ID NO. 31300
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (36)..(36): n is a, c, t, g, unknown, or other
  misc_feature (45)..(45): n is a, c, t, g, unknown, or other
  misc_feature (46)..(46): n is a, c, t, g, unknown, or other
  misc_feature (49)..(49): n is a, c, t, g, unknown, or other
  misc_feature (754)..(754): n is a, c, t, g, unknown, or other
nttttnnnnnnnnnnnnntttttcccttctctcccnctccctttnnttntcaaagctggagctccccgcggtggcggccgctctagaactagtggatcccccgggctgcaggaattcgcacgagaccattacctagaacatcctaatcgaaaagggtctccgtgtcgtctctgcgactccacttgctcttttcgctggccctggctacttgcggcaactcccatctccacgcgctctcccatccgagatctcaaccgcctcgccggcgagcgactgacgggcggacggtcccgccggctatggggaactgctgctccgatgaggtgagccacgccggtgctcatcccgtcggctccgccaccgccaaagccgcctccgcagcctccgccgcggccgatcgctttctccgctcccgtggtgccggcgcgtccacgcagatcgagttatctctctctgcatcaaatttgggtgatcaagaatattttcccaagagtaatcccatggtggttgtgtattccaaaaagagagatggtacactagaagaaattgcgcgcagtgaagtaattttaaattcattgaaccccattttggacgacccaaaatcagtgtgccagtacccagtttggaggttctttcaacaattgggggttttcagggcctttgaacatccaaccaggcaagttccgttggatggtcaggtggaaaaggatgccttaaagcttaaaagggaaccaaggaggtttcctttgggagn

SEQ ID NO: 31300 - protein, 151 aa, Zea mays
  misc_feature: Ceres CLONE 1407564-F
MGNCCSDEVSHAGAHPVGSATAKAASAASAAADRFLRSRGAGASTQIELSLSASNLGDQEYFPKSNPMVVVYSKKRDGTLEEIARSEVILNSLNPILDDPKSVCQYPVWRFFQQLGVFRAFEHPTRQVPLDGQVEKDALKLKREPRRFPLG

SEQ ID NO: 31301 - DNA, 729 bp, Zea mays
  misc_feature: Ceres CLONE 1407566-F
  misc_feature: Encodes the peptide sequence at SEQ ID NO. 31302
  misc_feature (385)..(385): n is a, c, t, g, unknown, or other
  misc_feature (414)..(414): n is a, c, t, g, unknown, or other
  misc_feature (415)..(415): n is a, c, t, g, unknown, or other
  misc_feature (713)..(713): n is a, c, t, g, unknown, or other
aaagctggagctccccgcggtggcggccgctctagaactagtggatcccccgggctgcaggaattcgcacgagaccattacctagaacatcctaatcgaaaaacctaccgctgacttgtcaattcctgtctgtgcgcgcgcgcgcgcgtggcgccggccgagcggccgttgacccgatgaccggcgcggcggccgtcgatcccccggcgcctcggccgcggcggctgacggtcctcccgctcatcgcgctcatcttctacgacgtctcgggaggccccttcggcatcgaggactcggtccgcacgggcggcggcgcgctgctcccgatcctcggcttcatcgtcctcccagtcctctggtcgctcccggaggcgctggtcacggncgagctcgcatcggctttcccccacacgnncgggtacgtgggcctgggtgtccgccgctttcggccccgccgtgggtttcctcgtcgggttctccaggggggcgtcggggaggttcgacacgcgttctacccgggggtggttctcgatacctcccgtccggggggggggttggctttgcccccccggtcccgttttcttgggggccccggggtttcgggggggggttccctccctcaataacgggggggtcccaatgggggggctcttgggggtggggttccccgggttttattttcccccgattcccggggataccgggtgttgggncccccaaaaccccgct

SEQ ID NO: 31302 - protein, 149 aa, Zea mays
  misc_feature: Ceres CLONE 1407566-F
  misc_feature (70)..(70): Xaa is any aa, unknown, or other
  misc_feature (80)..(80): Xaa is any aa, unknown, or other
MTGAAAVDPPAPRPRRLTVLPLIALIFYDVSGGPFGIEDSVRTGGGALLPILGFIVLPVLWSLPEALVTXELASAFPHTXGYVGLGVRRFRPRRGFPRRVLQGGVGEVRHAFYPGVVLDTSRPGGGLALPPRSRFLGGPGVSGGGSLPQ

SEQ ID NO: 31303 - DNA, 709 bp, Zea mays
  misc_feature: Ceres CLONE 1407567-F
  misc_feature: Encodes the peptide sequence at SEQ ID NO. 31304
  misc_feature (501)..(501): n is a, c, t, g, unknown, or other
  misc_feature (525)..(525): n is a, c, t, g, unknown, or other
aaagctggagctcaccgcggtggcggccgctctagactagtggatcccccgggctgcaggaattcgcacgagaccattacctagaacatcctaatcgaaacatacactatcacccgaagttgcccgcactcacagcttgcgacgtttacaatgtctggagcgatcaaggcacttcgcaatggccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggggtccgctggtcgccatgctggcggagcgcttccgtgtgctgctgctggatcgcggcaccctcccctaccaaaacgacggcagcgaaacctgttccgttccccgaaaccgctgtggggaaacttcgcgtcctcgcccgcccaccgccccgaggcgcaagtcggtgttccnatctcatgtcccgggtagtctggncgccgcgcccccgaagaatttcggcgtattcacgccgcccccccctcagagtcccgcttccgtaattagcgactttaagggttgcctctttcgtttctccgggcccccgcgccgcggcccgcgatctggaaccttttcctccccccccccgacccaccacccccgaggtccaccgccacgctcc

SEQ ID NO: 31304 - protein, 177 aa, Zea mays
  misc_feature: Ceres CLONE 1407567-F
  misc_feature: SWISSPROT Homolog: EC 4.1.2.10 Mandelonitrile lyase
  misc_feature (108)..(108): Xaa is any aa, unknown, or other
  misc_feature (116)..(116): Xaa is any aa, unknown, or other
MATLLATSFFFVLLCSSLQVRGVNYTFVKDAALAPSVSYYDYIIVGGGTAGGPLVAMLAERFRVLLLDRGTLPYQNDGSETCSVPRNRCGETSRPRPPTAPRRKSVFXSHVPGSLXAAPPKNFGVFTPPPPQSPASVISDFKGCLFRFSGPPRRGPRSGTFSSPPPTHHPRGPPPRS

SEQ ID NO: 31305 - DNA, 741 bp, Zea mays
  misc_feature: Ceres CLONE 1407569-F
  misc_feature: Encodes the peptide sequence at SEQ ID NO. 31306
  misc_feature (568)..(568): n is a, c, t, g, unknown, or other
aagctggagctccccgcggtggcggccgctctagaactagtggatcccccgggctgcaggaattcgcacgagaccattacctagaacatcctaatcgaaaactttccctttctggccgcattccctcgtcctccggcagccgtcgccagcttccgatggtccggaaggagacggccatgaggctgcccccgcagcaccagggcctggaggtcaagatccccagcttcttccgctgccccatctcgctggacgtcatgcgctcgcccgttagcctctgcaccggcgtcacctacgaccgcgcctccatccagcagtggctcgactccggcaacaccacgtgcccggccaccatcctcccgctcccctccaccgacctcgtccccaacctcactctccgcagcctcatcgcccactgggccgcctccgccgcctcctgttcccccaccgccgccggcggcgccggagtcgccgactcctcttcggcacgtacttcttctcccgcgagcctcgtccgccaggtggcttcgtccggcgtggacccctcgccggccctccgcgagctggcagnctatctctccgacgacgacgtcgacgacttcgaaaagacgcgcttgtgggcgcccggcgcgccgccgagaccgtcgcgtcagttcttcggagaaagagcgaggaacccggcgtcgaaggggtggaggcggcacgagagtgctagccttgatcttgggctcgacggatcgacgc

SEQ ID NO: 31306 - protein, 195 aa, Zea mays
  misc_feature: Ceres CLONE 1407569-F
  misc_feature (20)..(94): Pfam Name: U-box Pfam Description: U-box domain
  misc_feature (138)..(138): Xaa is any aa, unknown, or other
MVRKETAMRLPPQHQGLEVKIPSFFRCPISLDVMRSPVSLCTGVTYDRASIQQWLDSGNTTCPATILPLPSTDLVPNLTLRSLIAHWAASAASCSPTAAGGAGVADSSSARTSSPASLVRQVASSGVDPSPALRELAXYLSDDDVDDFEKTRLWAPGAPPRPSRQFFGERARNPASKGWRRHESASLDLGLDGST

SEQ ID NO: 31307 - DNA, 706 bp, Zea mays
  misc_feature: Ceres CLONE 1407570-F
  misc_feature: Encodes the peptide sequence at SEQ ID NO. 31308
  misc_feature (706)..(706): n is a, c, t, g, unknown, or other
aaagctggagctccccgcggtggcggccgctctagaactagtggatcccccgggctgcaggaattcgcacgagaccattacctagaacatcctaatcgaaaagcctctgtatccgagcatactagcggatcctggcccgatccctcttcccacctacctccgcttctctccaagtgaggaaccccaagccctcgccatggcgtcgcggatcctggcccgatccaagtcccttcacctcgtcgccgccctcacccctgccgctgccaaagcagcaacgcctatcgccggagcccgcgcgctctcgtccctgccccgctacccgtctgccccgtcgccccatgggctcggcaaggttctgggatatgaaccaacatctcacctcagtggaccacagttttacctcgttggttttcctctctagcatccaatggatctcaggggcagaagtcacagatctctgagacatacaagtcaggggggtgaaatgaaacagtctgaaacacggaaatcaagtgaggaaccccccaccaaaaggtgtggcggttcagcccgctaaaaaccagctatcgctaaaacctaaaaagtagcccccttgaaaaggggagagttcctaaaggtaagggggatcagaaaatagcaaccccaaggccaccctttttacatggatcccaggccctggctttcttggcctccaagaaaaaggatn

SEQ ID NO: 31308 - protein, 74 aa, Zea mays
  misc_feature: Ceres CLONE 1407570-F
MASRILARSKSLHLVAALTPAAAKAATPIAGARALSSLPRYPSAPSPHGLGKVLGYEPTSHLSGPQFYLVGFPL

SEQ ID NO: 31309 - DNA, 727 bp, Zea mays
  misc_feature: Ceres CLONE 1407571-F
  misc_feature: Encodes the peptide sequence at SEQ ID NO. 31310
  misc_feature (603)..(603): n is a, c, t, g, unknown, or other
  misc_feature (604)..(604): n is a, c, t, g, unknown, or other
  misc_feature (627)..(627): n is a, c, t, g, unknown, or other
  misc_feature (684)..(684): n is a, c, t, g, unknown, or other
  misc_feature (686)..(686): n is a, c, t, g, unknown, or other
  misc_feature (690)..(690): n is a, c, t, g, unknown, or other
  misc_feature (691)..(691): n is a, c, t, g, unknown, or other
  misc_feature (700)..(700): n is a, c, t, g, unknown, or other
ggagctccccgcggtggcggccgctctagaactagtggatcccccgggctgcaggaattcgcacgagaccattacctagaacatcctaatcgaaaaaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcacccggccggacaccttcttcaccgccgccgactccgtgaggtctgtctgcacggaggtggccacggacctgcagatcctcgtggataactgcctctaccatctccacaaggtaattagctcaaggatcgtcagagatcgtgcccaccctttggcctttattcaggaatttgaatctttagttaggatcgttccatacagtgggatcccgtctaggctttgttcggttttcacggattggagacccagaataattcctagccggattacttctctaatttatataaattttgatggagtggaacgaaaccgggtttattccaatagaaacgaacggccccctnnagaatggagaagtcccccccggncgatcttgagattaagactctttctgtttcttgcattgtcccgtctgtgcatgcttngnctgnnacgcgcagntccccctgctctcgaatgcatgctcct

SEQ ID NO: 31310 - protein, 162 aa, Zea mays
  misc_feature: Ceres CLONE 1407571-F
  misc_feature (122)..(122): Xaa is any aa, unknown, or other
  misc_feature (130)..(130): Xaa is any aa, unknown, or other
  misc_feature (149)..(149): Xaa is any aa, unknown, or other
  misc_feature (151)..(151): Xaa is any aa, unknown, or other
  misc_feature (154)..(154): Xaa is any aa, unknown, or other
MKFMRLGTRPDTFFTAADSVRSVCTEVATDLQILVDNCLYHLHKVISSRIVRDRAHPLAFIQEFESLVRIVPYSGIPSRLCSVFTDWRPRIIPSRITSLIYINFDGVERNRVYSNRNERPPXEWRSPPRXILRLRLFLFLALSRLCMLXLXRAXPPALECML

SEQ ID NO: 31311 - DNA, 712 bp, Zea mays
  misc_feature: Ceres CLONE 1407576-F
  misc_feature: Encodes the peptide sequence at SEQ ID NO. 31312
aaagctggagctccccgcggtggcggccgctctagaactagtggatcccccgggctgcaggaattcgcacgagaccattacctagaacatcctaatcgaaaagttagctgtgcctgctcccatttggagggacgaagttttatcctgtggttactgcctgtcgatgtcaagcaatttttatgtactctagagattagtttggctgcatcctccgtatctttaccttgttgaccagggatggagcttgtatacatggaaaggagaaacggatcgtacgacgatggcgcggttccagagttcagtggaaggggggctggaggggatcaggatcaggacccgtccgctgctgcatccgaggtccagtctgactcgcgtcagacaccggacgagaagaagagcaagggctgccaatcatgccgtgacccattctgttcatgcagcggcggcacaccccactcggaactgttccccccacatcctgccaagatgatgatcctggagttcctcgtcgcgagcctcaggcacccgacaagaacccacaacatcagtgatctcgacgacctgagtcgccgacggggtcagcccaagggagcgtggtaaacctcggcccttctgagaaagaaggtgctggaatctctgcacgccatggtaaacgccaagacgaggccgagaagcccgtcgcgtttccatggcgggatctaagctgagggaa

SEQ ID NO: 31312 - protein, 120 aa, Zea mays
  misc_feature: Ceres CLONE 1407576-F
MELVYMERRNGSYDDGAVPEFSGRGAGGDQDQDPSAAASEVQSDSRQTPDEKKSKGCQSCRDPFCSCSGGTPHSELFPPHPAKMMILEFLVASLRHPTRTHNISDLDDLSRRRGQPKGAW

SEQ ID NO: 31313 - DNA, 678 bp, Zea mays
  misc_feature: Ceres CLONE 1407577-F
  misc_feature: Encodes the peptide sequence at SEQ ID NO. 31314
  misc_feature (426)..(426): n is a, c, t, g, unknown, or other
  misc_feature (488)..(488): n is a, c, t, g, unknown, or other
  misc_feature (489)..(489): n is a, c, t, g, unknown, or other
aaagctggagctccccgcggtggcggccgctctagaactagtggatcccccgggctgcaggaattcgcacgagaccattacctagaacatcctaatcgaaaagaccctcgcttcacttgtcacggactcgcgtccacaaaccacaaccagctcactcaagaacaaagaacccaacccatggcttctcccaagccgctcctcctgctcgccacctcgttcctgagctgcggcctcctggtggccgccgactacgccccaatgaccctgaccgtggtgaacaactgcccctacccggtgtggccgggcatccaggccaactccgggcacgacgtcctggagggcggcggcttcttcctcccgccgctctcccacaagtccttcccggcgccggcccacccctggtccggccgcatctgggcgcgcacngggctgcgcgggcgccggcgcgcagctccactgcgccacgggcgactgcggcggcgtcccannagcgggggggcttcgcggcgccgcggcgcccgcgaggctgggcgcaggtgaacctccaccacggtaacgaccagacctcgtacggctgtgaagcgaggtggacggccttcaacgtggggcctggtccgtgaccccgccacggaggcccagcgccaactggccccgtccctcgccctgcccgcaagaacc

SEQ ID NO: 31314 - protein, 120 aa, Zea mays
  misc_feature: Ceres CLONE 1407577-F
  misc_feature (104)..(104): Xaa is any aa, unknown, or other
MASPKPLLLLATSFLSCGLLVAADYAPMTLTVVNNCPYPVWPGIQANSGHDVLEGGGFFLPPLSHKSFPAPAHPWSGRIWARTGLRGRRRAAPLRHGRLRRRPXSGGASRRRGAREAGRR

SEQ ID NO: 31315 - DNA, 567 bp, Zea mays
  misc_feature: Ceres CLONE 1407578-F
  misc_feature (299)..(299): n is a, c, t, g, unknown, or other
  misc_feature (300)..(300): n is a, c, t, g, unknown, or other
  misc_feature (335)..(335): n is a, c, t, g, unknown, or other
ccccgcggtggcggccgctctagaactagtggatcccccgggctgcaggaattcgcacgagaccattacctagaacatcctaatcaaaaagacgggtatgctacagtgttggtggcgttcgctgcagtcttgtccgatcatcaatggataccaccaacccagtagtagctgtgacttgcgacgagtgatggagcgtagcgcggctggagtggacgtacgcccggcttctcgtcttcgtccggggcgagccgagtccccctccctggctccctcctccttgccgcggcaccctggcatcnngcgacgtccgcgaggagacttgggcaggcgcgggnaatccgcgtgtcttggggagtgctctttgtacgcgtgatgctgtaaaagattctcctgtcgggatttgaacaaggccggggtcccaactggggggcccttcaattggggcggaaaaaaagccccgggttatgggggaaaaatggaaaggctacagggaagggtggggtcctccccctcccccaggggagggggatttcccaaattctcggaaaagggccccctgagagcgct

SEQ ID NO: 31316 - DNA, 678 bp, Zea mays
  misc_feature: Ceres CLONE 1407579-F
  misc_feature (420)..(420): n is a, c, t, g, unknown, or other
  misc_feature (438)..(438): n is a, c, t, g, unknown, or other
  misc_feature (443)..(443): n is a, c, t, g, unknown, or other
  misc_feature (449)..(449): n is a, c, t, g, unknown, or other
  misc_feature (458)..(458): n is a, c, t, g, unknown, or other
  misc_feature (512)..(512): n is a, c, t, g, unknown, or other
  misc_feature (524)..(524): n is a, c, t, g, unknown, or other
  misc_feature (528)..(528): n is a, c, t, g, unknown, or other
  misc_feature (535)..(535): n is a, c, t, g, unknown, or other
  misc_feature (541)..(541): n is a, c, t, g, unknown, or other
  misc_feature (542)..(542): n is a, c, t, g, unknown, or other
  misc_feature (592)..(592): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
aaagctggagctccccgcggtggcggccgctctagaactagtggatcccccgggctgcaggaattcgcacgagaccattacctagaacatcctaatcaaaaaactgccccatggcccattgcttacgcataactgcggcggggacacgcgacgctaccgacttcgccgccgcctccttccttccgcccgtcgagtcgaccgatcgattgttcgcggcctccctcctagtcagatccactcaatcccaagaggccaagtccaaaccctacccaccacccttctcaaccagcgatgatggcagcggagcactcgccgtcggttccctccaccgccgctgacgccctggaaaccctcgccctcgactcatcctcgtcgtgcgccgccgctaccggctccacttgccacgaccccctcctcggncactacctcccccgacgncgcgngaggangacctattngcatcgacgacttcgacgaggacgacttctcacgccccgggggccacgtccccngctgcggggggntggnggtgggnatcggnntccccggggtcgcaaaataccggatcggtcccaaaaaacggggagccacnggggggggggcccccccgggttatccccggggcccggaaataatttttactatcccccctttgtgggggggggggggnnnnnnata

SEQ ID NO: 31317 - DNA, 681 bp, Zea mays
  misc_feature: Ceres CLONE 1407580-F
  misc_feature: Encodes the peptide sequence at SEQ ID NO. 31318
  misc_feature (470)..(470): n is a, c, t, g, unknown, or other
  misc_feature (600)..(600): n is a, c, t, g, unknown, or other
  misc_feature (604)..(604): n is a, c, t, g, unknown, or other
  misc_feature (635)..(635): n is a, c, t, g, unknown, or other
tccccgcggtggcggccgctctagaactagtggatcccccgggctgcaggaattcgcacgagaccattacctagaacatcctaatcgaaaaagcagtactgcctccactgcagtcccagctcacagctctcagcggtggcggccggcgaccggcgacatcctccggtatcgactcccgtggagtggagcgttgaaccacgctgcggacctgcattcaccagtccgccgtttccttcgccttcgccttctccgcgtgatccggttgctctggccactgatggccggtgacattacatgcggatccttgctgcaaaaattgcagttgatatgggatgacagtgtcgagagtgatgacgatcgtgacaaggtcctttatcagctggatcaggaatgccttgatgtttacaagaggaaagttgaccaagcaactagctctagggatctcctgatccaggctctggatgactcanagatagaacttgctaggcttctttctggccttgcagcagaagctattgcaagaagccctgatgagatcacaggcactatcaagcagcagctagctgctatagcgccagcacttgagcagttgactacacngaancatgaacgacgaactgaggttgctaatgtancatcacaaattgatcaatatgtggtgaaatcgctggcaccatagaa

SEQ ID NO: 31318 - protein, 133 aa, Zea mays
  misc_feature: Ceres CLONE 1407580-F
  misc_feature (65)..(65): Xaa is any aa, unknown, or other
  misc_feature (108)..(108): Xaa is any aa, unknown, or other
  misc_feature (109)..(109): Xaa is any aa, unknown, or other
  misc_feature (120)..(120): Xaa is any aa, unknown, or other
MAGDITCGSLLQKLQLIWDDSVESDDDRDKVLYQLDQECLDVYKRKVDQATSSRDLLIQALDDSXIELARLLSGLAAEAIARSPDEITGTIKQQLAAIAPALEQLTTXXHERRTEVANVXSQIDQYVVKSLAP

SEQ ID NO: 31319 - DNA, 652 bp, Zea mays
  misc_feature: Ceres CLONE 1407583-F
  misc_feature: Encodes the peptide sequence at SEQ ID NO. 31320
tccccgcggtggcggccgctctagaactagtggatcccccgggctgcaggaattcgcacgagaccattacctagaacatcctaatcaaaagacaaaatagtaaaaaactcgaccaggtgccccacggcggtgccggcgatggcaacccgctactggatcgtctctctccccgtgcagtctcccggcgccaccgcgacctcgctttggtcgcgcctgcaggatggcatctcccgccactccttcgacaccccgctgtaccggttcaacgtcccggacctccgcgtcggcaccctcgactccctcctcgcgctcagcgatgacctcgtcaagtcaaacgtgttcgtcgagggcgtttcgcacaagatccggaggcagatcgaagacctcgagcgcgccggaggcgtcgacagcggggccctcaccgtcgatggcgttcccgtcgacacctacctcaccaggttcgtgtgggatgagggcaagtaccccacaatgtcgtcgctcaaggagatcgtcggcagcatccagtcgcaggtcgccaagatcgaggatgacatgaaggttcgagcagcggaatataacaatgtaaggagccagcttactgcaatcaacagaaagcaaagtgggagcttagcagttcgtgacctttccaatc

SEQ ID NO: 31320 - protein, 171 aa, Zea mays; identical to SEQ ID NO: 24025
  misc_feature: Ceres CLONE 1407583-F
  misc_feature (5)..(171): Pfam Name: V-ATPase_C Pfam Description: V-ATPase subunit C
  misc_feature: SWISSPROT Homolog: EC 3.6.3.14 H(+)-transporting two-sector ATPase

SEQ ID NO: 31321 - DNA, 762 bp, Zea mays
  misc_feature: Ceres CLONE 1407588-F
  misc_feature: Encodes the peptide sequence at SEQ ID NO. 31322
  misc_feature (5)..(5): n is a, c, t, g, unknown, or other
  misc_feature (17)..(17): n is a, c, t, g, unknown, or other
  misc_feature (18)..(18): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (52)..(52): n is a, c, t, g, unknown, or other
ggggncccccccccccnnccccnnncannnnnnnnnnnnnnggggaaggttnacaaagctggagctccccgcggtggcggccgctctagaactagtggatcccccgggctgcaggaattcgcacgagaccattacctagaacatcctaatcgaaaatctagtcatctcgtctcaggttgcggccgaaccagagccccgtcccaactccaccacctctcttctctacggcgcgagcaagggcggcgccggccgcggcgtcggcgggaaccgggcctcgctctccccatctctccgatcacttctgtcctgtgaaaatggcggatgaactacgctcaacgtctgtgggtcagaagttccatgggcagtccgtgctgttgagcagaatctcttcctattccgccatgaacaaccctgtattcaacaatgcctattctgcttacaatgtgccccagaggtcatatcatggggatgaatgcaactgctgaactctcatctggcatggcaccatctcctgtctttgcttctgccccaaaagagaaagggtttttctggatttatgatcgacttttatgaggggggggagtttcctgctggttgtctcccaagacaggttgccagctcccaatttggggcggggacaagggtttttggattccaaaacccaggatggaaattgggccaaaaacttgggcagggcttttttcggaaaccggacacaagggggattttgggggcacacggcttttggggccccggccaaat

SEQ ID NO: 31322 - protein, 56 aa, Zea mays
  misc_feature: Ceres CLONE 1407588-F
MADELRSTSVGQKFHGQSVLLSRISSYSAMNNPVFNNAYSAYNVPQRSYHGDECNC

SEQ ID NO: 31323 - DNA, 721 bp, Zea mays
  misc_feature: Ceres CLONE 1407589-F
  misc_feature: Encodes the peptide sequence at SEQ ID NO. 31324
aaagctggagctccccgcggtggcggccgctctataactagtggatcccccgggctgcaggaattcgcacgagaccattacctagaacatcctaatcgaaaaactgccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggtcatcagcacgctggtgtacatctccgtggcggggctcaaggtgcgcagcatcgagatggtggcgcgctccgtgctccccaggttctacgcgggcgacgtgcacccggagagctggagggtgttcagctccttcggtaggcgctacgtcgtcacggccagccccagggtcatggtcgagcccttcgacagggccttcctaggcgactgacaggtcgtcgggaccgagctggacgtcggcagggacggcacgccacgggcttcatgggcaggacatgcgtgctcgtcggcgacacaagaagaggccgtcgtcagg

SEQ ID NO: 31324 - protein, 144 aa, Zea mays
  misc_feature: Ceres CLONE 1407589-F
  misc_feature: SWISSPROT Homolog: EC 2.3.1.15 Glycerol-3-phosphate O-acyltransferase
MVASPRFKPIEECCSEGRSEQTVAADLDGTLLISRSAFPYYLLVALEAGSVLRAALLLLSVPFVYVTYAFFSESLVISTLVYISVAGLKVRSIEMVARSVLPRFYAGDVHPESWRVFSSFGRRYVVTASPRVMVEPFDRAFLGD

SEQ ID NO: 31325 - DNA, 767 bp, Zea mays
  misc_feature: Ceres CLONE 1407590-F
  misc_feature: Encodes the peptide sequence at SEQ ID NO. 31326
  misc_feature (291)..(291): n is a, c, t, g, unknown, or other
  misc_feature (336)..(336): n is a, c, t, g, unknown, or other
  misc_feature (341)..(341): n is a, c, t, g, unknown, or other
  misc_feature (342)..(342): n is a, c, t, g, unknown, or other
  misc_feature (408)..(408): n is a, c, t, g, unknown, or other
  misc_feature (415)..(415): n is a, c, t, g, unknown, or other
  misc_feature (438)..(438): n is a, c, t, g, unknown, or other
  misc_feature (456)..(456): n is a, c, t, g, unknown, or other
  misc_feature (457)..(457): n is a, c, t, g, unknown, or other
  misc_feature (459)..(459): n is a, c, t, g, unknown, or other
ggagctccccgcggtggcggccgctctagaactagtggatcccccgggctgcaggaattcgcacgagaccattacctagaacatcctaatcaaaagtcactcttgtgtcctcctaaaaccctaaccctccgccgcccctcggacccccaaccagcagctgccgcggccatccgccggcgagatggcgctgtacctgctgttcgagtcggcgtccggctacggtctattccacgcgtacggcatcgatgagatcgggcagagcgtggaggccgttcgctcctccgtgctggnactcgatcgcttcggcaagggcgtcaagctcaccgccttcaaccntttcnntctctgcgtcgatgcactcaatcagtgcaacgctatatccgaaaggatcatgaccgatgaactganggagttncctgaagctgaacctggccaaanccaagggaggggaaaaanngncaaatacagccttcggggtcgtcgaggcccaaggtcggttttcccaatccccgaggtcacgggggattccctggcaaaaaaaaaaaattcccaccgaagttgtcccggggggcccgcctcccatttagagggttttataaaaggttttaagggtttctgactgggaaaaaggccccttttgccgtgggatatatttaccgggggcccagggggagttttctgggcccaaaatttcccccagggggttatattttcctttggtgttctcaaaaactttttatggatctttggggaaaaaagaaaagata

SEQ ID NO: 31326 - protein, 145 aa, Zea mays
  misc_feature: Ceres CLONE 1407590-F
  misc_feature (3)..(69): Pfam Name: NOP5NT Pfam Description: NOP5NT (NUC127) domain
  misc_feature (37)..(37): Xaa is any aa, unknown, or other
  misc_feature (52)..(52): Xaa is any aa, unknown, or other
  misc_feature (54)..(54): Xaa is any aa, unknown, or other
  misc_feature (76)..(76): Xaa is any aa, unknown, or other
  misc_feature (78)..(78): Xaa is any aa, unknown, or other
  misc_feature (86)..(86): Xaa is any aa, unknown, or other
  misc_feature (92)..(92): Xaa is any aa, unknown, or other
  misc_feature (93)..(93): Xaa is any aa, unknown, or other
MALYLLFESASGYGLFHAYGIDEIGQSVEAVRSSVLXLDRFGKGVKLTAFNXFXLCVDALNQCNAISERIMTDELXEXPEAEPGQXQGRGKXXKYSLRGRRGPRSVFPIPEVTGDSLAKKKNSHRSCPGGPASHLEGFIKGFKGF

SEQ ID NO: 31327 - DNA, 718 bp, Zea mays
  misc_feature: Ceres CLONE 1407592-F
  misc_feature: Encodes the peptide sequence at SEQ ID NO. 31328
  misc_feature (615)..(615): n is a, c, t, g, unknown, or other
  misc_feature (700)..(700): n is a, c, t, g, unknown, or other
gctctataactagtggatcccccgggctgcaggaattcgcacgagaccattacctagaacatcctaatcgaaaacccaatctcctctccatcgaaaccctagcacgacgcaattcccgtcttcccacgccgtgtcgccgttgctatgggcaagaagcggaagctcgagcccaaatcggcggcagggttcacgccggttaaggcctccccgaccaccaggtctgccaccgctaaggccgctggtctatccgaggtcctcgcccccgtcgaggctacgatggagaagctgccgcagggggcaggcggcgaggatgtagaggaaatcgaggaggtggaggtcgaggaggaagtggaagtggaagaggaagaagaaggcgagagcgaccaggcttcgatccaggcgctgctggattcgttccccaaggaccagctcgtcgagctgttacgcgacgctgccatcgctcacggcgacgtgctaaccaccatccggcgcgtgggcgacgccgacccggttcaggggaagatcttcgtacacggcccttcggtggggaacccacaaccgacaccctcacccgaggcctttcgggccatacgggggagaaataagggatttcanagggtcttcctcgaaccgcaaacccgggtcaagttggaagggggtgaccgggttttttcccttcttccggtacccggttccgggnggccccgaaatttgcact

SEQ ID NO: 31328 - protein, 191 aa, Zea mays
  misc_feature: Ceres CLONE 1407592-F
  misc_feature (157)..(157): Xaa is any aa, unknown, or other
  misc_feature (186)..(186): Xaa is any aa, unknown, or other
MGKKRKLEPKSAAGFTPVKASPTTRSATAKAAGLSEVLAPVEATMEKLPQGAGGEDVEEIEEVEVEEEVEVEEEEEGESDQASIQALLDSFPKDQLVELLRDAAIAHGDVLTTIRRVGDADPVQGKIFVHGPSVGNPQPTPSPEAFRAIRGRNKGFXRVFLEPQTRVKLEGGDRVFSLLPVPGSGXPRNLH

SEQ ID NO: 31329 - DNA, 737 bp, Zea mays
  misc_feature: Ceres CLONE 1407595-F
  misc_feature: Encodes the peptide sequence at SEQ ID NO. 31330
  misc_feature (403)..(403): n is a, c, t, g, unknown, or other
  misc_feature (548)..(548): n is a, c, t, g, unknown, or other
  misc_feature (585)..(585): n is a, c, t, g, unknown, or other
  misc_feature (587)..(587): n is a, c, t, g, unknown, or other
  misc_feature (594)..(594): n is a, c, t, g, unknown, or other
  misc_feature (595)..(595): n is a, c, t, g, unknown, or other
  misc_feature (625)..(625): n is a, c, t, g, unknown, or other
  misc_feature (634)..(634): n is a, c, t, g, unknown, or other
  misc_feature (635)..(635): n is a, c, t, g, unknown, or other
tggagctccccgcggtggcggccgctctagaactagtggatcccccgggctgcaggaattcgcacgagaccattacctagaacatcctaatcgaaaaaaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagcaaatggtttctggtgcgggtcatggtgggtacggcggcggcgacgacgggcaggccgtcgacttccggggcaacccggcggacaagtcgaggaccggaggctggctgggcgccgggctgatcctgggcacggagctggcggagcgcgtgtgcgtgatggncatctccatgaacctggtgacgtacctcgtcggggagttggacctctccaactccaagcccgccaccgtggggaccaacttcatgggaaggctcaacctggtccgccctcgtcggggggtttccctcccgaagcccaatttgggncggtacctcaacattgccattcttccgccaaatttgncnccagggnngggagactttgttgaacgggggaaaacccnagggccccnnaaatttgtgacccccagggaggccgggcccccccaagtgtcgattctagcccggaccttgtttagagcagtgtgacatataaaatggtctacagtcgtatat

SEQ ID NO: 31330 - protein, 154 aa, Zea mays
  misc_feature: Ceres CLONE 1407595-F
  misc_feature (53)..(53): Xaa is any aa, unknown, or other
  misc_feature (114)..(114): Xaa is any aa, unknown, or other
  misc_feature (117)..(117): Xaa is any aa, unknown, or other
  misc_feature (127)..(127): Xaa is any aa, unknown, or other
  misc_feature (130)..(130): Xaa is any aa, unknown, or other
MVSGAGHGGYGGGDDGQAVDFRGNPADKSRTGGWLGAGLILGTELAERVCVMXISMNLVTYLVGELDLSNSKPATVGTNFMGRLNLVRPRRGVSLPKPNLGRYLNIAILPPNLXPGXGDFVERGKTXGPXKFVTPREAGPPQVSILARTLFRAV

SEQ ID NO: 31331 - DNA, 684 bp, Zea mays
  misc_feature: Ceres CLONE 1407599-F
  misc_feature: Translation starting site: 231
  misc_feature (443)..(443): n is a, c, t, g, unknown, or other
ggagctccccgcggtggcggccgctctagaactagtggatcccccgggctgcaggaattcgcacgagaccattacctagaacatcctaatcgaaaaaacagcgtcctcctcccgcgtgctctccactcccagaccccggggactacaagggcactgggctaggtccgttggcaacagccgccacactgctccgctctgctctctggaggcattgcctgcctcgagttgtcatggcggcagcggggacgcagctgggtcggctccttgttggcggcctctggctcctggccgcgttgctgcagcggggcgctgcggcggcagtggccgccgtggatgggcggcgcgccatcgcagcgactggggagaacttcgtgtgcgcgacattggactggtggccgccggacaagtgcgactatggcacctgcccctggggccgcgccggnctgctcaacctggatctctccaacaaggtcctcctcaacgccgtcagaggacaaggtggtgtacggcaccgcggacctcgggcgggcgtgcgcgccgttcgccaagaacgcgtcggagatgcacggcttcacgcagggctgcctgaccctgcgcaggtgggacgagctcaacgcctttctcagaaatctggggttttagatcagcttgggatgtcagcaaagtatgacacgaagagctacg

SEQ ID NO: 31332 - DNA, 720 bp, Zea mays
  misc_feature: Ceres CLONE 1407601-F
  misc_feature: Encodes the peptide sequence at SEQ ID NO. 31333
aaagctggagctccccgcggtggcggccgctctagaactagtggatcccccgggctgcaggaattcgcacgagaccattacctagaacatcctaatcgaaaaactgattccgagtccatctttccccgccgccggccgtgatccctcctcgccgctgaccgccccgcctgccccggcattctcccgctccagatccagggccctcatagagcctccgctcgatctgccccccggatcggattggccgccgcacatctcatgggtgaggaagctgtccacttcagcgtcgtcgacgccaacgactgcaaacagagtgcctttgaagtcggcgataagacgtatgttatttgtagatcagatgatgaattgaaaacttctgttgtaaaaaatcccgacaagatcactcaacacttgggcctcccccccaaatattcgggagacagtcccttttaacctaagcacaggccggcgattcctggtctggtggcaaagactttacttttccaaaaaggccctccccttaaaagcgcaccccgggcgtccttagaacgactcctcccccttgggccccgacacctaaaagcccgggatacaaaaatccggcctttggctaccctgtcaactgaccccgtccccacccccgcggagatccgcaactttaatgttagtcctccgcgcccccctagcccctcccccgatccttccccccccactcctcca

SEQ ID NO: 31333 - protein, 64 aa, Zea mays
  misc_feature: Ceres CLONE 1407601-F
MGEEAVHFSVVDANDCKQSAFEVGDKTYVICRSDDELKTSVVKNPDKITQHLGLPPKYSGDSPF

SEQ ID NO: 31334 - DNA, 710 bp, Zea mays
  misc_feature: Ceres CLONE 1407603-F
  misc_feature: Encodes the peptide sequence at SEQ ID NO. 31335
aaagctggagctccccgcggtggcggccgctctagaactagtggatcccccgggctgcaggaattcgcacgagaccattacctagaacatcctaatcgaaaactcctttcctggattatcagtgaacgaatcgaaccctaattgaatcgatggactggggtggactccaactcagcgagtactgattatcgagcgaccttcatcgctgcgtgatcggcactttgtccaagcctgcacgaccactgacatccgccctgtgccccatcaatcatatcaactgaatatccaatttgaaggcacgtggagtgtacgtgtaccaccactcgtcttccggccgtccaccgtttccagcacacaggccaaaggcaagtaaacgagcggcgtcacggtctagcccgcaatacaaaatccgcaggaactcccaggaggcgaaaagcatatccgtctcccccgaccggcgatcgctatcgacttgtagcggaagccatgttgtcggcagcgctaatctgcggcacgtagcattggaaggccctccaggcgcacgtcggcgcgattcagaagacgcacctgcgcgacctgatgcccgacgccgaccgatgcaaggcaatgacgggtgaatatgaagggatccttctggactactcaagacagcaggcgactgtcgaacccatgaaaaagccctctacattgggtggcgcttgcgaagttca

SEQ ID NO: 31335 - protein, 43 aa, Zea mays
  misc_feature: Ceres CLONE 1407603-F
  misc_feature: SWISSPROT Homolog: EC 5.3.1.9 Glucose-6-phosphate isomerase
MPDADRCKAMTGEYEGILLDYSRQQATVEPMKKPSTLGGACEV

SEQ ID NO: 31336 - DNA, 718 bp, Zea mays
  misc_feature: Ceres CLONE 1407605-F
  misc_feature: Encodes the peptide sequence at SEQ ID NO. 31337
aaagctggagctccccgcggtggcggccgctctagaactagtggatcccccgggctgcaggaattcgcacgagaccattacctagaacatcctaatcgaaaagaccttggctaccatcgcaaaccccgcttttgtttatcattccttctctccagtcttgacttcccctctccctccctctctctctctcttcccggcggggcggccggaaatctccccctaaattcagctggtttcacgggagagctatcggccggtggagaggaaaggacgagtcttgagctggacttcttggcggattggctgctggcattcgcaggaactgtgtgtccgtgctcaggagcggggagatgagctgcttaccgtgctccggttcctcggggaaggaggacaagagcttggcggcgctctcgccgagcccccggcctgcggccaaggcggcaccagtacgatcaaattcacgtgcttcgagctccaggaaggaagattctgtacctgttcgcagagcaggaaacactgcacatggcccggcacagattttcagtttccgggagttggctgttgccaccaaaaatttcagaagagattgccttgttgggagaaggtggcttttggtcgtgtgtataaaggacatatggaaaatgggcaggtcattgctgtgaagaacttgatagaaatggttttcaaggaaatctgatttccctgtggaggtctcatg

SEQ ID NO: 31337 - protein, 103 aa, Zea mays
  misc_feature: Ceres CLONE 1407605-F
MSCLPCSGSSGKEDKSLAALSPSPRPAAKAAPVRSNSRASSSRKEDSVPVRRAGNTAHGPAQIFSFRELAVATKNFRRDCLVGRRWLLVVCIKDIWKMGRSLL

SEQ ID NO: 31338 - DNA, 695 bp, Zea mays
  misc_feature: Ceres CLONE 1407608-F
  misc_feature: Translation starting site: 233
aaagctggagctccccgcggtggcggccgctctagaactagtggatcccccgggctgcaggaattcgcacgagaccattacctagaacatcctaatcgaaaaattccaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggcgcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtggcacttcttctccgcttgcgaccgccagaccccgaatggctcccggcctacccggcccgcctggccatggtactcggaaggcccccgcctccgcccagtaccgaaggctcgacccgaccccttggccgccccgaagaccctactcttcttactttcccacccccccgtcccgcggcccgcccgatttgccctctggttgagctcccccccgggaatcgctctacccggctgccctgccccacaaaaaacaagaccctttgtccgtttta

SEQ ID NO: 31339 - DNA, 805 bp, Zea mays
  misc_feature: Ceres CLONE 1407609-F
  misc_feature: Encodes the peptide sequence at SEQ ID NO. 31340
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (43)..(43): n is a, c, t, g, unknown, or other
  misc_feature (44)..(44): n is a, c, t, g, unknown, or other
nnnnnncccccccccttcttttctttatttttaaagccagggnntacccaaagctggagctccccgcggtggcggccgctctagaatagtggatcccccgggctgcaggaattcgcacgagaccattacctagaacatcctaatcgaaaagtcacccacgagcccaacaaaccactcccacccggtggctcgtcctcggacgccaagccactccgcgccccaatccggaagcgccgccgccgccgatcgaccggccgtcgacccatgctccgctcggcgctcttccgctcagcccccgggctccgccggtctccggcgacggcccacttatccaccgccgccgccgccgccgcagcgtggctctccaacggccctgcctccgccccgtctagggtgcgcctcctcatcgccgccccagttcgtgaagtcgcgcgccgacgagcaccgtcgacgtcaccaaccccgcgacgcagggaggtggtgtccccggaatccccgctcacccacggcccgatgaagttcaaaagctggccggtgaatggccgcccaggaaacgcccttccccccgggagtggggggaaacaccgccccgcccccgaccccgggaaccggcggccatggttccaaggttcccaggaaagctccttcccggggttaaaaaaggggacaaagctttggcaaaagaaaacatcaccctacgggagcccaggggggaaaaaaccccctaaaaagaattctttggggaaacgacagttggttccccgccgcgcccaaaaaggtggtggggaaaaacatggcctttggg

SEQ ID NO: 31340 - protein, 36 aa, Zea mays
  misc_feature: Ceres CLONE 1407609-F
MVPRFPGKLLPGVKKGDKALAKENITLREPRGEKTP

SEQ ID NO: 31341 - DNA, 668 bp, Zea mays
  misc_feature: Ceres CLONE 1407612-F
aaagctggagctccccgcggtggcggccgctctagaactagtggatcccccgggctgcaggaattcgcacgagaccattacctagaacatcctaatcgaaaaccccaaccccgttcttctccctccgtccgaccgtccctcgacagtgccgaggcgcaacctagcagccgcccacgcggcgcgacatccactggcgcaagcgcaatccgcaagggccccccggcgcgccgccagcctcctggctcggccgcccccgcggctaacccaggggcggaaaggccggccagccgcccacaccccatccggccagccaggcggaaacgaccgtaagagggaagccgcagccggccgctgactccgatcccacctctagtcaaccccaggcagaccgatcctcttcgtctgaccacgacgtccatctcgcacgcctacttccactcaaccacataagtcttttctgccaggcctaacctttcccctgcgccgcctctactggttttgcacagtgccgtgacgtgggaagacgtggagatccaacgaaaattagatttatttcttccttcttcggtccaacaggttcctcagcttgcgtaagatccgtctgggttgtccgccctccattggactacccaaggtgcggcgcatccaccaggtggaagatatctgcg

SEQ ID NO: 31342 - DNA, 736 bp, Zea mays
  misc_feature: Ceres CLONE 1407613-F
  misc_feature (263)..(263): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (672)..(672): n is a, c, t, g, unknown, or other
  misc_feature (673)..(673): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (703)..(703): n is a, c, t, g, unknown, or other
  misc_feature (705)..(705): n is a, c, t, g, unknown, or other
  misc_feature (706)..(706): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (718)..(718): n is a, c, t, g, unknown, or other
acagctggagctccccgcggtggcggccgctctagaactagtggatcccccgggctgcaggaattcgcacgagaccattacctagaacatcctaatcaaaaaattcgaagggaggaccttttcttctttctcgtctgcttcctccttccctcgatcgtcctcgcgtcgcctccttcggccctccctattaatacctgcctcctcacaaccaggtcctgtcctcggggagccgaatccacacggaccacaccagaggacgcggnggacgccccggattcttcggatccaggatgaactacacagaatagcactaatggtcctgcctcgtggatgtgggcactggaggcataaaacatccggaatactaatggaaccggcccatgaaccgacactggggaaaaggcccctgttttcctggggaattttaacccactctaaaagggggcccccctgtaaaaacatagaaaaaaacatcccggctttccacaacacccccccttttttcttaaaaccatcttgttttattaactacgnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnncnnncnnnnnnnnnnnnnnnnnnnnnnnnnngnnnnngnnggnnnacttttnnnnnnnnncccnnncccncnnccccccnnnncncccccgccgggccgggcg

SEQ ID NO: 31343 - DNA, 688 bp, Zea mays
  misc_feature: Ceres CLONE 1407614-F
  misc_feature: Encodes the peptide sequence at SEQ ID NO. 31344
aaagctggagctccccgcggtggcggccgctctagaactagtggatcccccgggctgcaggaattcgcacgagaccattacctagaacatcctaatcgaaaagccgccaccgtcaccgtggcccgccgccatataagtaaaccctcgcctcgtcctcctcccaggctcgccaccctccgcctccgacacatggcccacccgcacctcgtgctcccctccccgaagtccctcctccccgccgccgcaactccatcgcgccgcgccgtcgccatccgcgcggcgctctccaccactttgtctccggccaaggcggcagctggagcagaggcggtgcgatcgatccgcgcgcggcagatcgtgcacagccgcgggaaccccaccgtcgaggcccacttcgtagcaggtgacggacccccccatgtctccataggtgacacgcgccgcgggcacgcgatattaatacaagtctgggaaacccacaaccgggcacacttcacggcccgcagtccccgcgaaaataacagcttgaccgcagctacagccactcctaacgctccccacttactaacccgctaaaatgagcgccctctcctattgcccgaccccgtcccagaaaaatcgcgaaattgtatagaaagtgcctcccccctcatagccacacccacgtatcgtcgcccacccctccccg

SEQ ID NO: 31344 - protein, 128 aa, Zea mays
  misc_feature: Ceres CLONE 1407614-F
MAHPHLVLPSPKSLLPAAATPSRRAVAIRAALSTTLSPAKAAAGAEAVRSIRARQIVHSRGNPTVEAHFVAGDGPPHVSIGDTRRGHAILIQVWETHNRAHFTARSPRENNSLTAATATPNAPHLLTR

SEQ ID NO: 31345 - DNA, 688 bp, Zea mays
  misc_feature: Ceres CLONE 1407616-F
  misc_feature: SWISSPROT Homolog: EC 2.7.11.1 Non-specific serine/threonine protein kinase
  misc_feature (319)..(319): n is a, c, t, g, unknown, or other
  misc_feature (333)..(333): n is a, c, t, g, unknown, or other
  misc_feature (334)..(334): n is a, c, t, g, unknown, or other
  misc_feature (381)..(381): n is a, c, t, g, unknown, or other
  misc_feature (497)..(497): n is a, c, t, g, unknown, or other
  misc_feature (507)..(507): n is a, c, t, g, unknown, or other
tggagctccccgcggtggcggccgctctagaactagtggatcccccgggctgcaggaattcgcacgagaccattacctagaacatcctaatcgaaaaggcgaggcgctggcctgcaagtccatcgccaagggccggctcgtgtcccccgacgacgtgcgcggggtcaggctggagatcgacgtcatggcgcgcctggcgggccaccccaacgtcgtggggctcaaggccgtgtacgaggaccgcgactcggtgcacctcgtcatggagctctgcgccggcggcgagctcttccaccgcctccacgagcgcggctgcttncccgagcgcgaggnncgcgcgctcttccgcccctcatggaggtcgtcgcgcactgcacgccnaggggatcgtgcaccgcgaccctcagcccgagaacatcctcctcggtagcaggtcgcccaagtcgcgatcaaactcgcggattttggactcggcccctaccccagcctggccaaantttgacgggnatggaagcaacccgtttaacttgggcccggaggggtttcccgggggaaaaaagggcccccaaagtttggggggcgggggtcaaaattttaaattctcctaggggatccccccctttttgggggaaaaaaaatcaaaaattctccgggcttgggcctggagggtgggtcccttctgccgcgt

SEQ ID NO: 31346 - DNA, 703 bp, Zea mays
  misc_feature: Ceres CLONE 1407618-F
  misc_feature: Encodes the peptide sequence at SEQ ID NO. 31347
  misc_feature (406)..(406): n is a, c, t, g, unknown, or other
  misc_feature (619)..(619): n is a, c, t, g, unknown, or other
aaagctggagctccccgcggtggcggccgctctagaactagtggatcccccgggctgcaggaattcgcacgagaccatttacctaaaacatcctaatcgaaaaaagactaggaagaggttcccggtaccggcgccgccactatgtcgtcgatgatgaacgcgctgtcaaacttgttgttgaatccgcgccgcaacccgctcgcgcgcctccacatgaacgccgtctcctcacgcctcaagaaatacgggttgaggtacgatgacctgtacgacccctatttcgacctgaacatcaaggaggcgctcggaaggctgcctagggaggtggtcgacgcccgcatccagcgcctcaagcgcgccatggacctctccatgaagcatcaatacctccccgaggacctccagncacagcaggtcccattcagaggatatttgagtgacatgttggctctggtaagaatctttttacttcattccattggcatttcatatgcctttgaattagagtcactccattccgctttttttaatgcgtgcaaggcacctaatctacatgatatgaattcatgcttaggagtgtactgccatatcactcgttgctagatttaatatgggtacnacggacaagtttacagcattgttagttagcatttaagtggcatatacatggaagagtcatgcaaaatgtgcattgctgtatatt

SEQ ID NO: 31347 - protein, 153 aa, Zea mays
  misc_feature: Ceres CLONE 1407618-F
  misc_feature (11)..(114): Pfam Name: UCR_14kD Pfam Description: Ubiquinol-cytochrome C reductase complex 14kD subunit
  misc_feature (89)..(89): Xaa is any aa, unknown, or other
MSSMMNALSNLLLNPRRNPLARLHMNAVSSRLKKYGLRYDDLYDPYFDLNIKEALGRLPREVVDARIQRLKRAMDLSMKHQYLPEDLQXQQVPFRGYLSDMLALVRIFLLHSIGISYAFELESLHSAFFNACKAPNLHDMNSCLGVYCHITRC

SEQ ID NO: 31348 - DNA, 626 bp, Zea mays
  misc_feature: Ceres CLONE 1407619-F
  misc_feature: Encodes the peptide sequence at SEQ ID NO. 31349
  misc_feature (124)..(124): n is a, c, t, g, unknown, or other
  misc_feature (361)..(361): n is a, c, t, g, unknown, or other
  misc_feature (399)..(399): n is a, c, t, g, unknown, or other
  misc_feature (467)..(467): n is a, c, t, g, unknown, or other
tggagctccccgcggtggcggccgctctagaactagtggatcccccgggctgcaggaattcgcacgagaccattacctagaacatcctaatcgaaaagccgcttccaaatcccaataataccantcgcgtaaatccagatatcagggcagctggaactgaaggtggcgggagccgagtgatccggcggtgagctgagcggggcgggatggcggcggagcaggggcggtcgctggcggagacgcccacctggtccgtggcaaccgtcaccacgctcatggtcgctgcctgcttcctcgtcgagcgctccctctcgcgcttcgcccagtggctgcgcaagacccagcggaaggccatgctcgncgcgctcgagaagatccgcgagagctgatgctgctcgnagtcatctcgctgctgctcagccagacggggcgcttcataatcggagatctgggtggccgtgctccgntcttcaccaagccgtttctaaatctggtccgaagagggataacaagaaactgcttgggcaaaaccggaagcccaacccaaggggggttcgaaaaaaaaaattggttccgtgggcaaaagggttggccctcttggggggagagggccattgaaacctttt

SEQ ID NO: 31349 - protein, 60 aa, Zea mays
  misc_feature: Ceres CLONE 1407619-F
  misc_feature (52)..(52): Xaa is any aa, unknown, or other
MAAEQGRSLAETPTWSVATVTTLMVAACFLVERSLSRFAQWLRKTQRKAMLXALEKIRES

SEQ ID NO: 31350 - DNA, 703 bp, Zea mays
  misc_feature: Ceres CLONE 1407621-F
  misc_feature: Encodes the peptide sequence at SEQ ID NO. 31351
  misc_feature (570)..(570): n is a, c, t, g, unknown, or other
  misc_feature (617)..(617): n is a, c, t, g, unknown, or other
  misc_feature (622)..(622): n is a, c, t, g, unknown, or other
  misc_feature (623)..(623): n is a, c, t, g, unknown, or other
  misc_feature (633)..(633): n is a, c, t, g, unknown, or other
aaagctggagctccccgcggtggcggccgctctagaactagtggatcccccgggctgcaggaattcgcacgagaccattacctagaacatcctaatcgaaaaacacacgactagaaccaggcaaccagctgcggagggaggaaacctagcggaacactgtgcaggtgacggcggcgcgctaccggtgacaggggatacggcggcatcgtcccctcctccatccccggcgcggcggcgccagcagccggcctgcaggcacacaagtggccacccttccaatggcggtggagaagtccagcagcggcacatcaactccctccaccacctccaccatggaccggtttcagaagattgtcctaagctgggattacctccgtctcatcgctgaatccaagggcggcaagcaggccaaggtgctgcagcatgtgaagaacacatacgtctcggtggctgagtaccttggtgtctttgagccactgctctttgaggaggtcaaggcacagatcatccagggacgcagtaacgacgaggaagaatctgggatggactggaggaggggagcaggggggncccggccggagcctgaggggtgccccaagctctctgtgccgggggangacannttttgggttngggtgccacacatggccccacgacgatacaccaagacacctttttcgccgcttcttccccaaacgtttta

SEQ ID NO: 31351 - protein, 141 aa, Zea mays
  misc_feature: Ceres CLONE 1407621-F
  misc_feature (98)..(98): Xaa is any aa, unknown, or other
  misc_feature (113)..(113): Xaa is any aa, unknown, or other
  misc_feature (115)..(115): Xaa is any aa, unknown, or other
  misc_feature (119)..(119): Xaa is any aa, unknown, or other
MAVEKSSSGTSTPSTTSTMDRFQKIVLSWDYLRLIAESKGGKQAKVLQHVKNTYVSVAEYLGVFEPLLFEEVKAQIIQGRSNDEEESGMDWRRGAGGXRPEPEGCPKLSVPGXDXFWVXVPHMAPRRYTKTPFSPLLPQTF

SEQ ID NO: 31352 - DNA, 710 bp, Zea mays
  misc_feature: Ceres CLONE 1407622-F
  misc_feature: Encodes the peptide sequence at SEQ ID NO. 31353
aaagctggagctccccgcggtggcggccgctctagaactagtggatcccccgggctgcaggaattcgcacgagaccattcctaaaacattctaatcgaaaaccacctccaaagtccaaaagcgaagcctacgcccgccccaacggtgaaaacgtcggaaccctagatccctctcacggtcgcgcctgtgctccaaaaccttagatccgacatgcatcagcccagagcccgctacccacccgggtatggctccagcggcggaggcggtggcggcggaggcggtagtggagtaggaagaggaggcagcggcggcggatgaaaccacaactactacggccggaacacacatccacagcatcaacaccactaccagcagcagcagcagcactcgcataggaactcctcgcaccagcagcagtggctgcggcgagaccagggccccgccgttgcggggtcagtgtctgcaaacgctgtgcctaagatggcgcctcagcttgacgctgttgactccagttctcaagattggaaggctcaactaaatataccagctccagacacacgctacaggacagaggatgtcactgcaacaaaaggcaatgagtttgaggattatttcttgagacgtgagctgcttatgggaaatatgataaagggatttgaaatgccttcttctatttaggaatacagattcttattgcgcttgcctggaag

SEQ ID NO: 31353 - protein, 65 aa, Zea mays
  misc_feature: Ceres CLONE 1407622-F
MAPQLDAVDSSSQDWKAQLNIPAPDTRYRTEDVTATKGNEFEDYFLRRELLMGNMIKGFEMPSSI

SEQ ID NO: 31354 - DNA, 704 bp, Zea mays
  misc_feature: Ceres CLONE 1407623-F
  misc_feature: Encodes the peptide sequence at SEQ ID NO. 31355
  misc_feature (378)..(378): n is a, c, t, g, unknown, or other
  misc_feature (629)..(629): n is a, c, t, g, unknown, or other
  misc_feature (674)..(674): n is a, c, t, g, unknown, or other
aaagctggagctccccgcggtggcggccgctctagaactagtggatcccccgggctgcaggaattcgcacgagaccattacctagaacatcctaatcgaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcantgttccgcgggccgtggctcgcccgcgcggacttcctgctgacgtgcgacccggcggccgtccagcactgcctggcgtccaaccacgggggctacgacaggggccgagactttgcggagatgttcgacctcctgggcgacgggctgctggttgcggacgccgcgtcgtgggcgcgccagcggcacgccgccgccaccgtcttcggcaccccggggttccgggcctttcgccctgggcaccatggcgcgccngagggggcggttggtcgttgcgtttctggactgcgcccccgcggnatcgggaaaggaacggggggcgtctttcca

SEQ ID NO: 31355 - protein, 69 aa, Zea mays
  misc_feature: Ceres CLONE 1407623-F
MFDLLGDGLLVADAASWARQRHAAATVFGTPGFRAFRPGHHGAPEGAVGRCVSGLRPRGIGKGTGGVFP

SEQ ID NO: 31356 - DNA, 682 bp, Zea mays
  misc_feature: Ceres CLONE 1407626-F
  misc_feature: Translation starting site: 351
tggagctccccgcggtggcggccgctctagaactagtggatcccccgggctgcaggaattcgcacgagaccattacctagaacatcctaatcgaaaaagttcagtggcgccgtcgtgcctcgacgacggcgggagaccccgcaagcaggtgagagtgagacgggcggtgactagcgggcgcttaggccgacatcggccccgcagcggcggggtagggtgcgtcgacacgcgggactgcgacttgggggggattgattcccttcgctgttctctcttctccggcgcgtgcgcgcgggatcgaaggtagggtttgggccccaaagttcgtgtctttggggacagcggcggcgatggactacaccaacgccatccacatcatcccggacgccgcgggccccgacgcctgggccaacgcggcgtcggccgcgggcgccgacgccagcatctgggccaccgaggacgactaccgccagtggagcgccgaaccaggctacggcgaccggaacccctcgtcgcggacggggagcgagcagccgccgccgcgcaagaaggctcgggatgcttgcgacggcatcggtatcgttgggcggtggcagcacgagcaagtcgcgcgacattgggaagatgctcttcaagaccaagctctggtgtgagttccgcggcgcgacctgttgctacgttc

SEQ ID NO: 31357 - DNA, 637 bp, Zea mays
  misc_feature: Ceres CLONE 1407633-F
  misc_feature: Encodes the peptide sequence at SEQ ID NO. 31358
  misc_feature (383)..(383): n is a, c, t, g, unknown, or other
tccccgcggtggcggccgctctagaactagtggatcccccgggctgcaggaattcgcacgagaccattacctagaacatcctaatcgaaaagcgctctgtgcacagacgaccttcttcccatcccttcccttccctctgctagtctgcttcgttcctcggccatggtggtcctcgccaagggtgagctcgagcagatcgccctcccggctgcagagccgcccccggccgacgtgcggtcggtggacctgtccgccccggcgggccccgcgcgcgaggccgcggcgcgcgcgctggtggcggcgtgcgaggagcacgggttcttccgggtgacggcccacggcgtgccggccagactcgtggccgccgcggaggccgcggccgnccgttttcttcgcgcgcccacagggtcgagaaaggaggaggagggcccccacgttcgggttacggaagcaaggcgcatcgggggaaaacggcggaccttcggttgggatcgagaacctcccttggtcgggggaacacccgccccgctgccgggtcttcttcggaaattattgccccggcgccgccggccccggtggccggtcagagcaaaacccggttctgtttatgggacctttctggggggagaactcccat

SEQ ID NO: 31358 - protein, 158 aa, Zea mays
  misc_feature: Ceres CLONE 1407633-F
  misc_feature (74)..(74): Xaa is any aa, unknown, or other
MVVLAKGELEQIALPAAEPPPADVRSVDLSAPAGPAREAAARALVAACEEHGFFRVTAHGVPARLVAAAEAAAXRFLRAPTGSRKEEEGPHVRVTEARRIGGKRRTFGWDREPPLVGGTPAPLPGLLRKLLPRRRRPRWPVRAKPGSVYGTFLGGELP

SEQ ID NO: 31359 - DNA, 660 bp, Zea mays
  misc_feature: Ceres CLONE 1407634-F
  misc_feature: Translation starting site: 342
  misc_feature (310)..(310): n is a, c, t, g, unknown, or other
  misc_feature (340)..(340): n is a, c, t, g, unknown, or other
  misc_feature (346)..(346): n is a, c, t, g, unknown, or other
  misc_feature (509)..(509): n is a, c, t, g, unknown, or other
  misc_feature (510)..(510): n is a, c, t, g, unknown, or other
tggagctccccgcggtggcggccgctctagaactagtggatcccccgggctgcaggaattcgcacgagaccattacctagaacatcctaatcgaaaaagaaacatagaaggcgtgtacaccaagaagaagccggccaaccaaccgactcccccgaccctcctgatcgatcgagggccccttgttctagccagttgtccccttccctctcgccggcgttgctcctgcctgctccaatggccgctgcctctgccgccgcccccacgaagacggcgaacatccccgcgacgatgcgggccgtgcagtacgacntcctgcggcgggggcgccgctggactcagncatgtnggaagttccggtcccttcggccaaaaagaatgagcttctgctgaagctggaggcagcaagcatcaacccagtgggactggaaggtgcagaaaggcatgctgaggcctttcctgcctcgtaaattaccttttatcccagtgattgatgtggcaggagtcgtggnnttgatgttggtcaggaaatcatgggggtccaagccgaagaatccaggttgttgctatgctcactcattaaacggaaggtgggcttgccggagtatgctgtggaatcagaaaatctgaacggcagaagggctcctggagatctgggtgccc

SEQ ID NO: 31360 - DNA, 701 bp, Zea mays
  misc_feature: Ceres CLONE 1407641-F
  misc_feature: Encodes the peptide sequence at SEQ ID NO. 31361
  misc_feature (455)..(455): n is a, c, t, g, unknown, or other
  misc_feature (517)..(517): n is a, c, t, g, unknown, or other
  misc_feature (579)..(579): n is a, c, t, g, unknown, or other
  misc_feature (676)..(676): n is a, c, t, g, unknown, or other
  misc_feature (693)..(693): n is a, c, t, g, unknown, or other
tccccgcggtggcggccgctctagaactagtggatcccccgggctgcaggaattcgcacgagaccattacctagaacatcctaatcgaaaaaaatcccaccacccttttccccttccaaccctcgggatctctccggcccgccatggaagtgttctactacctcgtgttcggcgcgctcgccgccatcgtggcggcgctggagctcgccaagtccggcaaggaccgcgtcgccacctccccggccttcaactcatttaagaacaactacatcctcgtttactccctcatgatgtctggggactggctgcaggggccctacgtgtactacctctacagccagtacggcttcgacaagggcgacattggccgcctcttcatcgccggcttcggttcctccatgctcttcggcaccatcgtcggatccctcgcggataagcaggggcggaagagggcngtgtgtcacgtactgcatcacctacatcctcagctgcatcaccaagcactctccccagtacnagtttcttaatggattgggcgtgggtcctttgggtggcattggccacttcgctgctcttctncagcggttttgagtccgtgggcctccgtggcagagcacaccaaggaaaaaggatttgattccccccaaatgtttggtcgataacattctccaagggnttatattttccttggcnaaaggggg

SEQ ID NO: 31361 - protein, 127 aa, Zea mays
  misc_feature: Ceres CLONE 1407641-F
  misc_feature (4)..(128): Pfam Name: DUF791 Pfam Description: Protein of unknown function (DUF791)
  misc_feature (125)..(125): Xaa is any aa, unknown, or other
MEVFYYLVFGALAAIVAALELAKSGKDRVATSPAFNSFKNNYILVYSLMMSGDWLQGPYVYYLYSQYGFDKGDIGRLFIAGFGSSMLFGTIVGSLADKQGRKRAVCHVLHHLHPQLHHQALSPVXVS

SEQ ID NO: 31362 - DNA, 655 bp, Zea mays
  misc_feature: Ceres CLONE 1407643-F
  misc_feature: Encodes the peptide sequence at SEQ ID NO. 31363
  misc_feature (487)..(487): n is a, c, t, g, unknown, or other
tggagctcaccgcggtggcggccgctctagaactagtggatcccccgggctgcaggaattcgcacgagaccattacctagaacatcctaatcaaaaaaggccagcgtggaaactggaaaagctgcctccgccaaatccaaaccaaacgggacggtcgccggaggaagcatacccgaaactcccctcccctctccttacaataccgcgaggcggcggctgacgtcgcttagccgctttcccacaccttcgccgccgcctatactcctgcagaaatagcccgagggagggcggttgctgctgcatcgtgttcggtgttccttccctcgccgcacgcgggatccatttgacggacggaccgaccgagcgactcacccgtccaccgagagccatggggcagaggcagagccacagcaagcgggacgtgagcagccacgggcggcggtcgcgctcctttcagcagcagccgtcggcgcagtggggcgccggnagggaggagggtactaccagcagggaccaagcaccggctactaccggcgcgccggtgcaccaaaaagggggaggaggggtactaccaaaaggcacccagggcaccgggatactacgggcggcgccggtgccaaccaaaaaagggggggaagggtaacgcccgcgcccg

SEQ ID NO: 31363 - protein, 84 aa, Zea mays
  misc_feature: Ceres CLONE 1407643-F
MGQRQSHSKRDVSSHGRRSRSFQQQPSAQWGAGREEGTTSRDQAPATTGAPVHQKGGGGVLPKGTQGTGILRAAPVPTKKGGEG

SEQ ID NO: 31364 - DNA, 605 bp, Zea mays
  misc_feature: Ceres CLONE 1407646-F
  misc_feature: Encodes the peptide sequence at SEQ ID NO. 31365
  misc_feature (352)..(352): n is a, c, t, g, unknown, or other
  misc_feature (419)..(419): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
tccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctggccgacttcctgcagtcggtgaacctcaagtacgtgcgcctncggtacactacctcatcgggcacggcgtgtacctggccacatccccgtcatccgtgctggtgtgcgncgccgagctgggcagcctcagcgcgacagctggnnnnaaaggggggggggggaagccacctacgacctcgccaccgggtcgccttcctcgcggccctcgcttaaccttctcggttaaatatggccaggcccaagcccgggaaccccaccaatttcgtggttaaaagccgccgagaagtttaggggg

SEQ ID NO: 31365 - protein, 108 aa, Zea mays
  misc_feature: Ceres CLONE 1407646-F
  misc_feature (75)..(75): Xaa is any aa, unknown, or other
  misc_feature (86)..(86): Xaa is any aa, unknown, or other
  misc_feature (87)..(87): Xaa is any aa, unknown, or other
MAREEQALLSTEIVNRGVEPSGPDAGSPAFSVRVRRRLADFLQSVNLKYVRLRYTTSSGTACTWPHPRHPCWCAXPSWAASARQLXXKGGGGSHLRPRHRVAFLAALA

SEQ ID NO: 31366 - DNA, 667 bp, Zea mays
  misc_feature: Ceres CLONE 1407647-F
  misc_feature: Encodes the peptide sequence at SEQ ID NO. 31367
  misc_feature (555)..(555): n is a, c, t, g, unknown, or other
aagctggagctccccgcggtggcggccgctctagaactagtggatcccccgggctgcaggaattcgcacgagaccattacctagaacatcctaatcaaaaaaaaaaaagttggtccgctcccaccctccgtccgaccgtcctcgacctcccgtcccgccgcctcccacagtcgcaaccctagtcccacccgccgtcctcccgccctcccgcttcccattttcagtcgccgagccgcgtacagcgcacgcactgcacgcgcatcggcacttccagcgacgcgtcgtgagctcctcccttcgacccttcctgtggcgcgtcgtaagctctgtgcaggcgacggcggcgcgctaccagtgacggggggatacggcggcatcgtctccctcggcccctcctccatcccggtgcggcggcgccagcctacagggcaggagtaccaccaagcgagcgcgatggtgagctccgcactgaggcgctgtctcccctgccatgcctctctctgtcatgccttccctccccatccgctgctggccgctgccggcgtcttccgtcgntcattccaggcccgggggatggtgagactatggacgattccaaagaaacggtttgtttgggggcaaggacacagaccaaggatcactctacgagaagctcgatagggctgaa

SEQ ID NO: 31367 - protein, 68 aa, Zea mays
  misc_feature: Ceres CLONE 1407647-F
MVSSALRRCLPCHASLCHAFPPHPLLAAAGVFRRSFQARGMVRLWTIPKKRFVWGQGHRPRITLREAR

SEQ ID NO: 31368 - DNA, 673 bp, Zea mays
  misc_feature: Ceres CLONE 1407648-F
  misc_feature: Translation starting site: 225
  misc_feature (435)..(435): n is a, c, t, g, unknown, or other
  misc_feature (504)..(504): n is a, c, t, g, unknown, or other
  misc_feature (637)..(637): n is a, c, t, g, unknown, or other
ggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgacctccggggagaagtacgggcccatcttncaccatgcggatggggcagcgcaccctcatcgtggtcacctcggcggagctcatccacgaggcgctggntgaagcagggccccatgttcgcgagcccggcccgaggacagccccacccgcctcctcttcagggtcgggaagtgcaccgtcaactcggcgcctacggccccccctgtggcgtgctctgcgccgcacttcgtcngccgagatcgtgtcccgcaccgcgtcaaggcttccc

SEQ ID NO: 31369 - DNA, 675 bp, Zea mays
  misc_feature: Ceres CLONE 1407649-F
  misc_feature: Encodes the peptide sequence at SEQ ID NO. 31370
tggagctccccgcggtggcggccgctctagaactagtggatcccccgggctgcaggaattcgcacgagaccattacctagaacatcctaatcgaaaaaatcaactcgtttctctccgattgctcctccgagtccgagactccgttctctcccgcatccaccgccgtctcatccccaatccgagcaacgcctcccctcgcctccaaaaccctacccctcctgtcaccggcgggggcatgaaccggtgatcgcttacctggtctcgtctgtctgcgcacgcgcgaggtcagtgagtgagcattgcggtggtccgatcgcccgcggggggccatggcgtctgtggcgggatcgggcggcggggcaagcgcgggggccggtgggttgaaaacttacttcaagacccccgaggggcggcacaagctgcagtacgagaagacgcacctcccccgccgtcgtgcactacaaccacaacgggcaagaccgtcgcccagatgacgggggcatatttggaggagaagccagcagggcagggttccacgccttcaacaccaagtggctggtagggggggatgcgggtctgcagctggcgagactgcttggcactggggaaatggtagcccggacacttagcttcgggagcatgggtacccaagcaggggctgtctcaggaagagcg

SEQ ID NO: 31370 - protein, 54 aa, Zea mays
  misc_feature: Ceres CLONE 1407649-F
MASVAGSGGGASAGAGGLKTYFKTPEGRHKLQYEKTHLPRRRALQPQRARPSPR

SEQ ID NO: 31371 - DNA, 606 bp, Zea mays
  misc_feature: Ceres CLONE 1407650-F
  misc_feature (188)..(188): n is a, c, t, g, unknown, or other
  misc_feature (271)..(271): n is a, c, t, g, unknown, or other
cgcggtggcggccgctctagaactagtggatcccccgggctgcaggaattcgcacgagaccattacctagaacatcctaatcaaaaacacgcgaaggcacctagcagccgccactcgccgaactgaggaacacgccgggcgacgggatacagcagcagcgcgcccctctatgcccgacgcgacggcgncctgcagctgcagataacctggtccatgggcaacaaaaaggaggtgggggacaaaaaactgctaagagatgatacgatctacngaaaggttgtggaaagagattaccttcgagaagggaaaaaaatagaagctgtgcagatttacgatttggccgagggatccccaagtagctactattcccggtggaattctaagaatcttcccagaaggggcctttgttttcatacctgggggggggtgtggaaaaaaattttgccggaaaaatggggcttttcacggggcaccatggtgcacccccggaaaaaggggagcttaaataacaggggcccatttggcacgagaagaaaaaaggtttttggggggggtaaacacccatctatcttaaaaaaaatgggtttaaaaaaacggcgcggggcg

SEQ ID NO: 31372 - DNA, 654 bp, Zea mays
  misc_feature: Ceres CLONE 1407654-F
  misc_feature: Encodes the peptide sequence at SEQ ID NO. 31373
  misc_feature (379)..(379): n is a, c, t, g, unknown, or other
  misc_feature (422)..(422): n is a, c, t, g, unknown, or other
aaagctggagctccccgcggtggcggccgctctagaactagtggatcccccgggctgcaggaattcgcacgagaccattacctagaacatcctaatcgaaaagttagctgtgcctgctcccatttggagggacgaagttttatcctgtggttactgcctgtcgatgtcaagcaatttttatgtactctagagattagtttggctgcatcctccgtatctttaccttgttgaccagggatggagcttgtatacatggaaaggagaaacggatcgtacaaggatggcgcggtccaggagttcagtggaagggggcctggaaggggatcaggatcaggacccgtccgctgctgctcccgaggtccagtctgactcgcgtcanacaccggacgagaagaagagcaagggctgccaatcatgccggnacccattctgttcatgcagcggcggcacacccaactcggaactgttccccccacatcctgccaagatgagaatcctggagttcctcgtcgcgagcctcaggcacccgacaagaaccacaacatcagggatctcgacgacctgatcggcgacgggtcagcccaggggagcgtggtaacctcggccttctggaaaaaaggtgctggaatctctgcacgccatggtaaacgcaaa

SEQ ID NO: 31373 - protein, 94 aa, Zea mays
  misc_feature: Ceres CLONE 1407654-F
  misc_feature (33)..(33): Xaa is any aa, unknown, or other
  misc_feature (48)..(48): Xaa is any aa, unknown, or other
MARSRSSVEGGLEGDQDQDPSAAAPEVQSDSRXTPDEKKSKGCQSCRXPFCSCSGGTPNSELFPPHPAKMRILEFLVASLRHPTRTTTSGISTT

SEQ ID NO: 31374 - DNA, 634 bp, Zea mays
  misc_feature: Ceres CLONE 1407655-F
  misc_feature (354)..(354): n is a, c, t, g, unknown, or other
  misc_feature (407)..(407): n is a, c, t, g, unknown, or other
ccccgcggtggcggccgctctagaactagtggatcccccgggctgcaggaattcgcacgagaccattacctagaacatcctaatcgaaaaaagaaaccatgagttctaggtttgctgaaatctcctttgatctttaatctgttcatctccttgcgtgagtctgtggcgttagcgtgatgccttctcctagttcatgaacttccttccggttcgcaatccctagtcgtcttgtcctgatcttacttgagtgctcgtgagctctttccagtggctaaagactgcagatttgagttctggcccaagaaccgcgtgctagcccgccatgggaggtgaggtccgagcaagggctgatgnccgggggagggatcttattcggcatggcgaaaaaggcccgccgcgccccgggnccccgccggtcgtccgccgcaattggcaaagcggtgcgcaatggcggaaaaccgcggagggggaacccgccggggtccgcctcccgggggactttttccccccgggggaagggtgttttaaccaagccggggggggggcgaaccccgggggggtttgaatgcccccggggaaaaaaggtctttttgagagaaaaaggggccttccaagtgggcgcaaaaaaaagggg

SEQ ID NO: 31375 - DNA, 685 bp, Zea mays
  misc_feature: Ceres CLONE 1407658-F
  misc_feature: Encodes the peptide sequence at SEQ ID NO. 31376
  misc_feature (253)..(253): n is a, c, t, g, unknown, or other
  misc_feature (297)..(297): n is a, c, t, g, unknown, or other
  misc_feature (461)..(461): n is a, c, t, g, unknown, or other
  misc_feature (568)..(568): n is a, c, t, g, unknown, or other
aaagctggagctccccgcggtggcggccgctctagaactagtggatcccccgggctgcaggaattcgcacgagaccattacctagaacatcctaatcgaaaaatccgactaaaaagggccagggccagggccttcgcttgcttactactcctgcttaccacactctaccttgtctcttcacgtgcacacgacgcctcccccaatggctgcggtggcggaggaggaggtgatcgtcgtcggcgcggggcagcgngggctagcgggtggcggcgtgcctgtccctgcgcggcgtgcggncgctggtcctggagcgcgacgactgcgtgggggtcgctggtggcggaagcgcgcctacgaccgcctccacctccacctcaccaagaagtactgcgcgctgccgcacgcgccgcaccccggccgagggcccccgcgtactggcaccgcgacgaacttcgcgcggnaacctgggacggtaacccccgggcggggttcgccgggccgcccgggcctcccggcggggagggccgggccgggcgccgggaccaaccccgcaaggggcgccgggggncaagcgggaagcccggggaacccccggcacgggacgagggccgaagggcaaagagggcgcgaggagccaggggagcgccacctgaccggggggagaagcggcaaaaagtgcacttcg

SEQ ID NO: 31376 - protein, 161 aa, Zea mays
  misc_feature: Ceres CLONE 1407658-F
  misc_feature (32)..(32): Xaa is any aa, unknown, or other
  misc_feature (87)..(87): Xaa is any aa, unknown, or other
MAAVAEEEVIVVGAGQRGLAGGGVPVPARRAXAGPGARRLRGGRWWRKRAYDRLHLHLTKKYCALPHAPHPGRGPPRTGTATNFARXPGTVTPGRGSPGRPGLPAGRAGPGAGTNPARGAGGQAGSPGNPRHGTRAEGQRGREEPGERHLTGGRSGKKCTS

SEQ ID NO: 31377 - DNA, 586 bp, Zea mays
  misc_feature: Ceres CLONE 1407659-F
  misc_feature: Encodes the peptide sequence at SEQ ID NO. 31378
  misc_feature (304)..(304): n is a, c, t, g, unknown, or other
ccccgcggtggcggcgctctgaatagtggtcccccgggctgcaggaattcgcacgagaccattacctagaacatcctaatcgaaaaactcccaccgtatcctcccctgcgtagggtttaacctactcgcagcagccgccgtgactcgagaatcatgtcagcgccgccgtcgctcaagaccccggcaaccgccgtagcggtctctcggcgctcggtcgccaccccgagagccaccgggcttcgcggcgcctgtgctcccccgactcggcgcctccggtgctcagcctccgccgccgtgggccggngcttccaccgagatggctgatgctccgctggactgggggcagaggagtcggctggaggagttacgcagcttgccggaccacgacacggttctggcttgatggcgctctcgccgctggacgggcgggaacgatcgcttcgtcaaggagctgatccttttttttcggggaggtcggcctaaacaaaaaccgggttttcatggagaaaaagggggttacgggaacttttctcaattcctgaaaaaccggggggggggcccccattccgaagggaaaagggggtct

SEQ ID NO: 31378 - protein, 56 aa, Zea mays
  misc_feature: Ceres CLONE 1407659-F
  misc_feature (51)..(51): Xaa is any aa, unknown, or other
MSAPPSLKTPATAVAVSRRSVATPRATGLRGACAPPTRRLRCSASAAVGRXFHRDG

SEQ ID NO: 31379 - DNA, 668 bp, Zea mays
  misc_feature: Ceres CLONE 1407660-F
  misc_feature: Encodes the peptide sequence at SEQ ID NO. 31380
  misc_feature (456)..(456): n is a, c, t, g, unknown, or other
  misc_feature (457)..(457): n is a, c, t, g, unknown, or other
  misc_feature (551)..(551): n is a, c, t, g, unknown, or other
aagctggagctccccgcggtggcggccgctctagaactagtggatcccccgggctgcaggaattcgcacgagaccattacctagaacatcctaatcgaaaagatctccccaatccgaccagaccggcaggcaccttcgactcgagcggagcaggcgaggcagagatggcgctgcgacgggcgctcctcagatcggtcaacttctcccccgacagcaaggctgcaattgagtacttttattctttctcaagggcacagtctgcttgttctctcaatggtgctggtctttgtcctgctagtagatcatttagcacccaggctgccactacgtcaagcacaccacagcctccacctccaccaccccctccagagaaaactcactttggtggtctcaaagatgaggatcgcattttcaccaacctctatggtctgcatgacccttttcggaaaggcgcgnntgaagagaggtgactggtaagggaccaaggatttgggtgattaaggggggcagactggatagttaatgaatgaagaatcagggcctctcccggnccggggggggggggcaaggttttcccctcggggccggaaatggtcctttaatggcccaaggggtttctggatgaacgcccttctttaatcttgggtggttaagggggggaaggagag

SEQ ID NO: 31380 - protein, 101 aa, Zea mays
  misc_feature: Ceres CLONE 1407660-F
  misc_feature (98)..(98): Xaa is any aa, unknown, or other
MALRRALLRSVNFSPDSKAAIEYFYSFSRAQSACSLNGAGLCPASRSFSTQAATTSSTPQPPPPPPPPEKTHFGGLKDEDRIFTNLYGLHDPFRKGAXEER

SEQ ID NO: 31381 - DNA, 655 bp, Zea mays
  misc_feature: Ceres CLONE 1407662-F
  misc_feature: Encodes the peptide sequence at SEQ ID NO. 31382
tggagctccccgcggtggcggccgctctagaactagtggatcccccgggctgcaggaattcgcacgagaccattacctagaacatcctaatcgaaaaatcccgcatccggcacaaaccaactgcatcaagctccaccagagaagacaggcccgccgacggccgcagccgcgggcggactcgtgagtcgcgactacgccgctgcagttcccaactcagggtgcctgcccgtaacctacccaagagcggccccgccatgcgcgcggaggtcacccagatcagcgccctaaccgccgtggccgcgcacgtgctctgctctgcgggccttgctgccgcccacgccctcgctggccgcggtgcgctcgtctccgaccccgggctcgcccttcgccttctcgtggtctgtgaagcgcccatagtcatcgcagtgttcagctagctccggcgtgatgctaaaagatgctcgattttcagggctgttgcaagaggattgatcgccttgaccggggcagcgttccttaatgcatttgcagcaaccattcctggggcacctgttggagtcaagtactgggaagctacctattactggacgcttgtcatgacccctgctttacggttgttccccgagggatgtggcttttggaacatccccgtacg

SEQ ID NO: 31382 - protein, 60 aa, Zea mays
  misc_feature: Ceres CLONE 1407662-F
MRAEVTQISALTAVAAHVLCSAGLAAAHALAGRGALVSDPGLALRLLVVCEAPIVIAVFS

SEQ ID NO: 31383 - DNA, 737 bp, Zea mays
  misc_feature: Ceres CLONE 1407663-F
  misc_feature (297)..(297): n is a, c, t, g, unknown, or other
  misc_feature (316)..(316): n is a, c, t, g, unknown, or other
  misc_feature (332)..(332): n is a, c, t, g, unknown, or other
  misc_feature (365)..(365): n is a, c, t, g, unknown, or other
  misc_feature (377)..(377): n is a, c, t, g, unknown, or other
  misc_feature (378)..(378): n is a, c, t, g, unknown, or other
  misc_feature (387)..(387): n is a, c, t, g, unknown, or other
  misc_feature (406)..(406): n is a, c, t, g, unknown, or other
  misc_feature (407)..(407): n is a, c, t, g, unknown, or other
  misc_feature (475)..(475): n is a, c, t, g, unknown, or other
  misc_feature (476)..(476): n is a, c, t, g, unknown, or other
  misc_feature (494)..(494): n is a, c, t, g, unknown, or other
  misc_feature (496)..(496): n is a, c, t, g, unknown, or other
  misc_feature (497)..(497): n is a, c, t, g, unknown, or other
  misc_feature (509)..(509): n is a, c, t, g, unknown, or other
  misc_feature (510)..(510): n is a, c, t, g, unknown, or other
  misc_feature (521)..(521): n is a, c, t, g, unknown, or other
  misc_feature (578)..(578): n is a, c, t, g, unknown, or other
  misc_feature (584)..(584): n is a, c, t, g, unknown, or other
  misc_feature (585)..(585): n is a, c, t, g, unknown, or other
aagctggagctccccgcggtggcggccgctctagaactagtggatcccccgggctgcaggaattcgcacgagaccattacctagaacatcctaatcaaaaactcgcaatgtctacttgtctaccgtcgctgcgctagccctcctccctgcttcttgcttttgcctgagcctgcagcctgctgcaagcttttgctttggtttaggtgcttcttttccacccctttactgttccccccacttttgcttgctttgtcacgcacacgaaaagctcctgcctttaccttatctccgcacccngtagtgggatttgggtggngagctgcgctgctcgncccctcgcgtttctttgcttcaattggggggtncacggtcacggnncccgcgggnttgctggcgcgtggctcgnntgggcggcggaaaattccggggtttctcttgcggccgggtcccgggtcccccctccgggcgattggcnnggacgcttcctctgcagnanntcttcgcgtaannactccgggagncgcggccgggagaattgaaactggcgggccgcccgaccagcttgggccggccggggntcccgnncgccccgtcgtgctttcctcaaacctgaaactgggaaccagttcttattggccggccgaccagcttcgacccggcgctccaagctcgatggtctccctccccggcgtccaactcgacggccggccgccgcgggttactgacggccgcgctcc

SEQ ID NO: 31384 - DNA, 503 bp, Zea mays
  misc_feature: Ceres CLONE 1407664-F
  misc_feature: Encodes the peptide sequence at SEQ ID NO. 31385
ggagctccccgcggtggcggccgctctagaactagtggatcccccgggctgcaggaattcgcacgagaccattacctagaacatcctaatcaaaaaactacggtaactcgtctgctcgcatttcctcccaatccatcccgcctccaaacccgaactccaagtcgccccgcatcgatggcgcccaaggccgagaagaagcccgcggcgaagaagccggcggaggaggagcccgcggccgagaaggcgccggccgggaagaagcccaaggcggagaagcgtgtcccagcgggcaagtccgccggcaagggaggggcggtgaaggggaaagaggggccggaagaagggcaagaagagcgtgggagacttaacaagaatctaccattttttccaagggggggcttgaaagcaaaggtgggacccccggaaaaatttcggggaattttttcccccccccaaggggcccctgggtgccccatcccagggggaaaacccccccctttttt

SEQ ID NO: 31385 - protein, 109 aa, Zea mays
  misc_feature: Ceres CLONE 1407664-F
MAPKAEKKPAAKKPAEEEPAAEKAPAGKKPKAEKRVPAGKSAGKGGAVKGKEGPEEGQEERGRLNKNLPFFPRGGLKAKVGPPEKFRGIFSPPQGAPGCPIPGGKPPPF

SEQ ID NO: 31386 - DNA, 638 bp, Zea mays
  misc_feature: Ceres CLONE 1407665-F
  misc_feature (328)..(328): n is a, c, t, g, unknown, or other
tggcggccgctctagaactagtggatcccccgggctgcaggaattcgcacgagaccattacctagaacatcctaatcgaaaagaaggtcactgtctctcttccatctttttctctctcaacaaaactccctgaattgcaaactccaccaaaacaaactccaagcccatccatcaccagtcctctgtcccctccccgaccgcaacgatctgctttgcatcttcccctccctccaattccagtcccatgcgtaatcgtctttcggaattgaatctctccatgtcatggcgctctgagcaagtacagctgcagtcagtgagagaaatgtangcaccacaaatcagtccagcaaatccctgctcgtggtctaccaaaaaatccagtctttttccagcccaaatccgcctcttccgctgctgccataaagcccggactttacgaggctttcacgacgtgcgagaattctgttatcgatctccacgaacccgatagctgccaaaaagctggacagacgcttccattgcttcaaccaaaaaccatcaaaatcttgacccaaaaggtaaaacatctccggggggaatgaaggccccgcagggttcaagaaaaaaacggggggggaatggggggggccccgaaaccg

SEQ ID NO: 31387 - DNA, 606 bp, Zea mays
  misc_feature: Ceres CLONE 1407666-F
  misc_feature (86)..(86): n is a, c, t, g, unknown, or other
cgcggtggcggccgctctagaactagtggatcccccgggctgcaggaattcgcacgagaccattacctagaacatcctaatcgaanactcactatatactcactcctgctgttttccgtccatccgcccaccggttcgcagcccgcgcctcaaaccctagccccgggcggatcgcggggcgcctccgcggtgccagcgacgcggctcgtttgatccgattgtgggtcgagccccgccctcgctgccgcgcttcgttcccgttggggaaggggggtgaccaccgagcaaactccggaaatggggaactggtggggggggcgggatttagggatggggagccctccccctggggcccccaaaaaaggtttccaaaaaaaaagggcaaaggatggaaaaaactcttaacggggtgggaaaaaaaagacccttttttgttttttatttccccaagggggggaaaagaggagggggaaaacccgcgacccccccccgggggaaaaaatttccccccttaaaaaaacctccgggggcgccaagggaaattttccccccccgaaagggtttaagaaaaaaagaggggggggttttttgtttctcttttataaa

SEQ ID NO: 31388 - DNA, 641 bp, Zea mays
  misc_feature: Ceres CLONE 1407667-F
  misc_feature: Encodes the peptide sequence at SEQ ID NO. 31389
  misc_feature (472)..(472): n is a, c, t, g, unknown, or other
  misc_feature (500)..(500): n is a, c, t, g, unknown, or other
  misc_feature (607)..(607): n is a, c, t, g, unknown, or other
  misc_feature (608)..(608): n is a, c, t, g, unknown, or other
aagctggagctccccgcggtggcggccgctctagaactagtggatcccccgggctgcaggaattcgcacgagaccattacctagaacatcctaatcgaaaaccacagaactctccccgactttgccgtccactcccccgccgcagccgcgccgttcgccgggacaggagggatagtagagcaccaggatgccggcgacgccgacgatcatcggtgccctcctggggctgggcacccagatgtactcaaacgctctccgcaagctcccctacatgcgccatccatgggagcatttgttggggatgggtctcggtgcagtgtttgtgaaccagctggtaaagtttgatgagaagctcaaggaggacctcgacaagatgcttgagcgcgccaggctagccaacgagcagcgctacattgacgatgatgaatagatgcccagatttatttgccagcgacctggtattttttttgcnaacatgttgtcagtacacatggccaggnactgatgatccccccatcgtcttagttctctcagctttcgcattttcaactgtgatcttgtgaaataaaagatgtcggattctcatggattaccatgaaccccccannttttgggggtctttattacacagggggggttgt

SEQ ID NO: 31389 - protein, 80 aa, Zea mays
  misc_feature: Ceres CLONE 1407667-F
MPATPTIIGALLGLGTQMYSNALRKLPYMRHPWEHLLGMGLGAVFVNQLVKFDEKLKEDLDKMLERARLANEQRYIDDDE

SEQ ID NO: 31390 - DNA, 656 bp, Zea mays
  misc_feature: Ceres CLONE 1407672-F
  misc_feature: Translation starting site: 203
  misc_feature (285)..(285): n is a, c, t, g, unknown, or other
  misc_feature (304)..(304): n is a, c, t, g, unknown, or other
  misc_feature (305)..(305): n is a, c, t, g, unknown, or other
acccgcggtggcggccgctctagaactagtggatcccccgggctgcaggaattccacgagaccattacctagaacatcctaatcgaaaaacacgcacaccgcgacccagtccagagccagtacgtgcgaagcagcacgcacgctgctggtccgcgtacgcgagacgacggtcaggtcggccggtgcttttcagtttggaataatgacggcgacgacgacgacagccgccggcggcggcaaggtgcagccgcgcggcctgcccgcggcgctgtccctgctgctgcntcctggtgttggcagcggnngctgggcggtggcgccgaggcgcagcaaacgtgcgcgggccagctgcgcgggctggccccctgcttgcgctacagcgtgcaccttggccgggggcaaggttccgccggcgcccggggcccggagtgctgctcccgcgcttgggggccggggcccagggactgcgccctgcggaaacgttcagcatcatcaacagcctgccgggcaaatggcgccctcccgccagtcagttgccaggaaatgagctgatgatagccagtgcgatgcactgggcaaaaggcaagggatccaaaccgctggaataataaagggccaccggggcgagttcgaatcggggtcctcattcggcattg

SEQ ID NO: 31391 - DNA, 656 bp, Zea mays
  misc_feature: Ceres CLONE 1407677-F
  misc_feature: SWISSPROT Homolog: EC 4.3.2.1 Argininosuccinate lyase
  misc_feature (540)..(540): n is a, c, t, g, unknown, or other
  misc_feature (610)..(610): n is a, c, t, g, unknown, or other
tggcggccgctctagaactagtggatcccccgggctgcaggaattcgcacgagaccattacctagaacatcctaatcaaaagtggactgtcctcaggacaatcgccaaaaccccccgagccaacacctactacgccgccgcgccgccgcgtcaaacaacggcgagaggacgcctatggcattcacttcccaatccctaatcttccgggcacccgcctcgccctcttgtgcccgcataaccccgtcatccggtcgcgtcaccctccgggaccgcagcgccgttttcccgctcgtcgcggcggcctccacctcgatggcgtcctcggagagcgaagataagagggaaaccaagctgtggggcgggcgggttcgaggagggcgtcaccgacgccgtggagcgcttcacggagtccatatcctacgactggcagctctacaaatacgacataatgggcagcaaggcccacgcctccatgctcgctggggcagggttttgataacagctactggatagggatatcatcttagaggggcttgatcnagatagagaggctggatccagaaagcaatttgaagtggaggaaggaccccgggaggatgtgcatatgaancattgagcgtctttaattggaaagggttgggtgagccagcccagaa

SEQ ID NO: 31392 - DNA, 702 bp, Zea mays
  misc_feature: Ceres CLONE 1407678-F
  misc_feature: Encodes the peptide sequence at SEQ ID NO. 31393
  misc_feature (473)..(473): n is a, c, t, g, unknown, or other
  misc_feature (614)..(614): n is a, c, t, g, unknown, or other
aaagctggagctccccgcggtggcggccgctctagaactagtggatcccccgggctgcaggaattcgcacgagaccattacctagaacatcctaatcaaaaaaccacgcaaaccgagctcgagaacaccaccacgaacaagaaagaaacacggccgcggcggggcggggcggggcggcttctccttttccaactcgctgcccgttgcgtgattccgccgcgtcgcgtcgcgtgtgcatttgcgcgcgcgcgcaggagccgccgctccgatcgccctgaaaaaggtgccaattgttactgattccagataggtgttcctacgctggcactaactgcgccgcgaccttcttcagcaatcttatgctcatgtctcactctcaacagatggctaatagtaggaagcctcctggcctcaggttactcggaggcgccggctcactgagaacgtaccagacactagtcctggtcctcacngtcttgccatacacatgcttccacatgactcggaaggtcccaagcatagtcaagaacgctctggacccgcaaacaaggtggggttcctccactggggaacggtgcccccaacaaaaacgtttccccacggggttgtgccgntaaacacggcaagggtccgggtttgtcgggaaaaaaaaattcgggttcctcccggaaccccgggggagggtcttcccgggcccaccgg

SEQ ID NO: 31393 - protein, 83 aa, Zea mays
  misc_feature: Ceres CLONE 1407678-F
MSHSQQMANSRKPPGLRLLGGAGSLRTYQTLVLVLTVLPYTCFHMTRKVPSIVKNALDPQTRWGSSTGERCPQQKRFPTGLCR

SEQ ID NO: 31394 - DNA, 708 bp, Zea mays
  misc_feature: Ceres CLONE 1407679-F
  misc_feature: Encodes the peptide sequence at SEQ ID NO. 31395
  misc_feature (592)..(592): n is a, c, t, g, unknown, or other
  misc_feature (600)..(600): n is a, c, t, g, unknown, or other
  misc_feature (699)..(699): n is a, c, t, g, unknown, or other
aaagctggagctccccgcggtggcggccgctctagaactagtggatcccccgggctgcaggaattcgcacgagaccattacctagaacatcctaatcgaaaagattcctctccccgtgattccccgtcccgtggccgcagcccccgtcggcgtcctcgcggctgcagccgaccatagccgccgcgcccgcaaatcacgcgcccccttccatccatggcaggtccgcgcccctgcggcccaaatcgcgcggatggaaggtacgcgcgtccgctaggcctacaactcctcctcctctccccattgctcagtgtaggcagtccccaaatccacgcgtccgcgccctcatcctctccccagcaatgcgccgccacctcctcctcggacgcgcggtggaaggttcgcgcctttgcgccccccaaatcgcgcggatggaaggtccgtggtgtggggaaggcctggggcggggtgctcatcctgctcatcgttgtgtacggggccgggttcggctggtcctggggccccctcgggtggctggtccccaacgagatttttccgctggagtgcgcgctgccgggcagagcgtcccgctggnagtgcggntgccatgcctggacctccgtcgccgccatagaaggtaaacggccacccgatgaagtacctccctagggctgactcgtcgggttcgtcccgccaaacggnagctgcgaa

SEQ ID NO: 31395 - protein, 150 aa, Zea mays
  misc_feature: Ceres CLONE 1407679-F
  misc_feature (127)..(127): Xaa is any aa, unknown, or other
MAGPRPCGPNRADGRYARPLGLQLLLLSPLLSVGSPQIHASAPSSSPQQCAATSSSDARWKVRAFAPPKSRGWKVRGVGKAWGGVLILLIVVYGAGFGWSWGPLGWLVPNEIFPLECALPGRASRWXCGCHAWTSVAAIEGKRPPDEVPP

SEQ ID NO: 31396 - DNA, 715 bp, Zea mays
  misc_feature: Ceres CLONE 1407680-F
  misc_feature: Encodes the peptide sequence at SEQ ID NO. 31397
  misc_feature (436)..(436): n is a, c, t, g, unknown, or other
  misc_feature (474)..(474): n is a, c, t, g, unknown, or other
  misc_feature (479)..(479): n is a, c, t, g, unknown, or other
  misc_feature (532)..(532): n is a, c, t, g, unknown, or other
  misc_feature (562)..(562): n is a, c, t, g, unknown, or other
aaagctggagctccccgcggtggcggccgctctagaactagtggatcccccgggctgcaggaattcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatggcggcggcgccagcgctcgcgcgggagctgctggacgcggcgcgggagccggagttcgcggagtggcagcgcggcgtgcggcgccggatccaccagcacccggagctggccttccaggagcaccgcaccagcgcgctcgtgcgcgccgagctcgacgcgatcggcgtcccgtacgcctggnccgtcgcgcagacgggcgtcgtggccaccatcaccggncccgnccgcggcccccgtgtcgcgctccgcgccgacatggacgcgctccccatccagnaaatggtagaatgggagttcaagagcaggnaagacgggaagatgcatgcgtgcggccatgacggccacgtggcgatgcttcttggaagagctaggttgctccaggctcggagggaaaattaaagggactggaaggttttttgggtggcttttttggcaaaaaaatttccgaaaccgtccaaca

SEQ ID NO: 31397 - protein, 133 aa, Zea mays
  misc_feature: Ceres CLONE 1407680-F
  misc_feature: SWISSPROT Homolog: EC 3.5.1.14 Aminoacylase
  misc_feature (62)..(62): Xaa is any aa, unknown, or other
  misc_feature (76)..(76): Xaa is any aa, unknown, or other
  misc_feature (94)..(94): Xaa is any aa, unknown, or other
  misc_feature (104)..(104): Xaa is any aa, unknown, or other
MAAAPALARELLDAAREPEFAEWQRGVRRRIHQHPELAFQEHRTSALVRAELDAIGVPYAWXVAQTGVVATITGPXRGPRVALRADMDALPIQXMVEWEFKSRXDGKMHACGHDGHVAMLLGRARLLQARREN

SEQ ID NO: 31398 - DNA, 710 bp, Zea mays
  misc_feature: Ceres CLONE 1407682-F
  misc_feature: Encodes the peptide sequence at SEQ ID NO. 31399
aaagctggagctcaccgcggtggcggccgctctataactagtggatcccccgggctgcaggaattcgcacgagaccattacctagaaattctaattgaaaaaaagtacgttacacctacctcctcgtatataggtatgtggttctcgcgtttataagccaaactttatctcctccacgctcctcgatgctgcgaagaacacaactcgaccaagagcgagagggacgacctatctccaatggcgcgggaaacggcatgctcttctggcccgccgtctgcctcggcgcccggtggaggcgtgccatcgtacgacagcgtttggccgcccccggatgagatccagctcacgaagcaggcgtgcgcaggagatcgcggcgcggatctttaacgtcgtagagggcaagagccttcgcgtcgacaacggcgacgatgacgtcgacggcttccgtggaggaagtatcctgcgtgccaccgctgatgctggtgttggccgcatcgcgggcggaggacttgccttatcgtcatctggcgcgggtgggcatggttgttctatcccagcgttatcttatcggagcagtgcactgcagcactcatatgtcggacatcaggggacgagcaaagagattgaaattccgaatggaagggttgatgttattattgaagaagctggagaaactattaggtatattcagcttcgatcagcagcagaga

SEQ ID NO: 31399 - protein, 126 aa, Zea mays
  misc_feature: Ceres CLONE 1407682-F
MRSSSRSRRAQEIAARIFNVVEGKSLRVDNGDDDVDGFRGGSILRATADAGVGRIAGGGLALSSSGAGGHGCSIPALSYRSSALQHSYVGHQGTSKEIEIPNGRVDVIIEEAGETIRYIQLRSAAE

SEQ ID NO: 31400 - DNA, 705 bp, Zea mays
  misc_feature: Ceres CLONE 1407687-F
  misc_feature: Encodes the peptide sequence at SEQ ID NO. 31401
  misc_feature (538)..(538): n is a, c, t, g, unknown, or other
  misc_feature (539)..(539): n is a, c, t, g, unknown, or other
  misc_feature (551)..(551): n is a, c, t, g, unknown, or other
  misc_feature (554)..(554): n is a, c, t, g, unknown, or other
  misc_feature (666)..(666): n is a, c, t, g, unknown, or other
aaaagctggagctccccgcggtggcggccgctctagaactagtggatcccccgggctgcaggaattcgcacgagaccattacctagaacatcctaatcgaaaaacacgactagaaccaggcaaccagctgcggagggaggaaacctagcggaacactgtgcaggtgacggcggcgcgctaccggtgacaggggatacggaggcatcgtcccctcctccatcccggcgcggcggcgccagcagccggcctgcaggcacacaagtggccacccttccaatggcggtggagaagtccagcagcggcacatcaactccctccaccacctccaccatggaccggtttcagaagattgtcctaagctgggattacctccgtctcgtcgctgaatccaagggcggcaagcaggtcaaggtgctgcagcatgtgaagaacacatacgtctcggtggctgagtaccttggtgtctttgagccactgctctttgaggaggtcaaggcgcagatcatccagggacgcagtaacgacgaggagattttgnnaaatggactggnagnagcgcgggcactgtcctcgtgcacggagtctgaggggttccacaagctctctgtggcggaggagactattttcaggataatgtgtcagagaatgatctactgcttatctccnagagacatttgatgagggatcgacccctagtgatatgct

SEQ ID NO: 31401 - protein, 133 aa, Zea mays
  misc_feature: Ceres CLONE 1407687-F
  misc_feature (88)..(88): Xaa is any aa, unknown, or other
  misc_feature (92)..(92): Xaa is any aa, unknown, or other
  misc_feature (93)..(93): Xaa is any aa, unknown, or other
MAVEKSSSGTSTPSTTSTMDRFQKIVLSWDYLRLVAESKGGKQVKVLQHVKNTYVSVAEYLGVFEPLLFEEVKAQIIQGRSNDEEILXNGLXXARALSSCTESEGFHKLSVAEETIFRIMCQRMIYCLSPRDI

SEQ ID NO: 31402 - DNA, 707 bp, Zea mays
  misc_feature: Ceres CLONE 1407693-F
  misc_feature (583)..(583): n is a, c, t, g, unknown, or other
  misc_feature (648)..(648): n is a, c, t, g, unknown, or other
  misc_feature (655)..(655): n is a, c, t, g, unknown, or other
  misc_feature (705)..(705): n is a, c, t, g, unknown, or other
aaagctggagctccccgcggtggcggccgctctagaactagtggatcccccgggctgcaggaattcgcacgagaccattacctagaacatcctaatcgaaaaagtgtttcgcactttgctattcagcttcgttcttcaccggttcaccctagccgccaccccaacccccagcgacagggaccttcgccgccaggccgcccccaatccctagcgactgcgagcaccgtcgccaggcgccgtgcagcgagcgtcgccgcctggcgaagtcgcgcgactcgtgccctgcagcgagcgccgctgtcccgcacccaccgtcgaacggctgccgatgcccaacgccctgcagcgagttgcgccgtcgtccgcttcctctcgctggtaacctcgtgtttcgatttggacagattgctcgtgacttggtgttgcgccgccgaccgagcctccttcccctaagtccctaaccgtaagtcctaaatcttggtgagttctgttcatgtgcatttgagcttacgcatctatgatacgcgccttagggattgtgatctgtgatttaggggttgtgaaattgagatgcattttaggnaattgtggaagtgtgaactgtgccttactgaaatcgagatgccatttgagcagttttcaactatnttgttgnattggcgaggttatgagaccttttcagatactttatatccgaattgttgnaa

SEQ ID NO: 31403 - DNA, 730 bp, Zea mays
  misc_feature: Ceres CLONE 1407694-F
  misc_feature: Encodes the peptide sequence at SEQ ID NO. 31404
  misc_feature (551)..(551): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (664)..(664): n is a, c, t, g, unknown, or other
  misc_feature (673)..(673): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
aaagctggagctccccgcggtggcggccgctctagaactagtggatcccccgggctgcaggaattcgcacgagaccattacctaaaacatcctaatcgaaaaatccaattcacaggctcaccacaccaaccaacaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccgcgacgccgccccaccacgcccgatggccgccgtaaggtcgctgctccgctcgtcggcctcccttcttcgcgccgcccccgccctcgcgagatcctcggctaccacgcgtccgtctcttcggcgcgcattggctgctcctcctcgcctcctcaggtcgcccgtcgagtcgagcttnctgcgtggagtcgcttctgcctctgcaaccgcccaccgccggtgcacgcatgacgtccatgctcgccgctcctgggcaggnnngctcgctggctcacccagctgaaaactgancgaatacgncccctggggtgtagaaaaaaaaaaaaaaaaaaaaannnnnnnnnnnnnnnnnnnnna

SEQ ID NO: 31404 - protein, 160 aa, Zea mays
  misc_feature: Ceres CLONE 1407694-F
  misc_feature (126)..(126): Xaa is any aa, unknown, or other
  misc_feature (154)..(154): Xaa is any aa, unknown, or other
MSGRGKGGKGLGKGGAKRHRKVLRDNIQGITKPAIRRLARRGGVKRISGLIYEETRGVLKIFLENVIRDAAPPRPMAAVRSLLRSSASLLRAAPALARSSATTRPSLRRALAAPPRLLRSPVESSXLRGVASASATAHRRCTHDVHARRSWAGXLAGSPS

SEQ ID NO: 31405 - DNA, 721 bp, Zea mays
  misc_feature: Ceres CLONE 1407696-F
gctctagaactagtggatcccccgggctgcaggaattcgcacgagaccattacctagaacatcctaatcgaaaagccatagaggattgttcctaggattgttgccccaagcgaccatttgcgcgtgttcctgccgatgtccgagaccctccactccccggcggttggcggatgacgcttcgaactgacccagatgatatggctaacgctcaccacagcttgtctcaaaagcgcaaccgtgtgcgcctcatccgcctccgcagcatcgagaatgctgtatccgcgcgcgtcacggccagactcgtctcggaccaccgccgcatataggctaagctccgcgcctgagaggtcatgtaggtgctcgctccccacgcttgaacgacccgttcaacgagcgtcatggtgtgacactttaggatagatgacgaatcggcccgaggattgaggcagccgaatgcgatgaggtacgagggaaatgccaacaaaaaggggctgcagagaccttaaaagaattatgccgtcgaataaaaaaaggccgccgatttcgaatgcccaaaccccttcccccaaaaaggaaaaaaattgccggtaaaaatggcccacaggggggaaaatacctaccggacggggccaaagtttcttgggagggcctgtgcctaactggcttttaccggggaaaggcggagggccccccccagggggagggcgtgggaacacaccta

SEQ ID NO: 31406 - DNA, 700 bp, Zea mays
  misc_feature: Ceres CLONE 1407699-F
  misc_feature: Encodes the peptide sequence at SEQ ID NO. 31407
aagctggagctccccgcggtggcggccgctctagaactagtggatcccccgggctgcaggaattcgcacgagaccattacctagaacatcctaatcaaaaggtggttgacggccgcttacccgcaccggcgccatgcgcgcgcgcggctaggtggtcgaggtcaagccaaacgctgcccaccgcctctgcctctgcctcgcatatatcctcgcgcacgttctttgctcgtctcgcactcgcttccttcgacgactcatcgccgatcacaccaggctagctagcccacccacagtcgtagggccaggaccgatcggaggagctcggtttttcgaccaggaccgccgccgccacacccgaagaagccgacgatgcagacgacgacgtcctcggcggcggcgtcgccgcgcccgcgcgcgcgggcgccgcagtccgtggtggccgagctggagggcgcgctgctccggagcgcggacacgttcccgtacttcatgctcgtggcgttcgaggcgtccgggctgccgcgcttcgcgctgctgctggcgctgtggccgctgctgcggctgctgcaggtggcgggccggcgcggtctggcgctgcgcgccgccgcgttcgtggccaccgcgggcgtgccgcgcgccgaggtggaggcagtgtcgcgcgccgtgctgcccaagtcatgggccgacgacgtcgtccccg

SEQ ID NO: 31407 - protein, 110 aa, Zea mays
  misc_feature: Ceres CLONE 1407699-F
  misc_feature: SWISSPROT Homolog: EC 2.3.1.15 Glycerol-3-phosphate O-acyltransferase
MQTTTSSAAASPRPRARAPQSVVAELEGALLRSADTFPYFMLVAFEASGLPRFALLLALWPLLRLLQVAGRRGLALRAAAFVATAGVPRAEVEAVSRAVLPKSWADDVVP

SEQ ID NO: 31408 - DNA, 729 bp, Zea mays
  misc_feature: Ceres CLONE 1407703-F
  misc_feature: Encodes the peptide sequence at SEQ ID NO. 31409
  misc_feature (458)..(458): n is a, c, t, g, unknown, or other
aaagctggagctccccgcggtggcggccgctctagaactagtggatcccccgggctgcaggaattcgcacgagaccattacctagaacatcctaatcgaaaagtaatataggattttgttaggtttttgcccccaaccgcccaactgcgcgtgctcctgccgacctcccacccctccactccccggcggttggcggctgtctcgccgaagcgacccagccgatatggagaagggcgaccacgcgctggcgcgcaagcgcaaccgtgtgcgccgcacgcgcctccgtaacaccgagaacgctgattccgagcgtgtcgcggcgatcatcgcctccaaggaccgccgtcaatcgctcgaagccccgcgcctgcgagggcatgtgcttcaagctccccacgcccgacgaccagttcaactatcgccatgccaggaaacacaagctcgatgacgagcccggncgtagacacagccgcccgactccggtgaggacagagcccatccccataaagaagggcgtctaacaccaaaaagaaaccagccggtggcaaaagtatggccccctaggccaaaagcccaaaggcctttccccaaaaataaaaattggtgcggaacggggcccccggggaatttctacccgcccggcccaattccctggggggcctggcccaaagctaattccggaatcccccggggcccccaaagaaaggggcaccgccccacttcccccgg

SEQ ID NO: 31409 - protein, 74 aa, Zea mays
  misc_feature: Ceres CLONE 1407703-F
MEKGDHALARKRNRVRRTRLRNTENADSERVAAIIASKDRRQSLEAPRLRGHVLQAPHARRPVQLSPCQETQAR

SEQ ID NO: 31410 - DNA, 708 bp, Zea mays
  misc_feature: Ceres CLONE 1407705-F
  misc_feature: Encodes the peptide sequence at SEQ ID NO. 31411
  misc_feature (348)..(348): n is a, c, t, g, unknown, or other
  misc_feature (369)..(369): n is a, c, t, g, unknown, or other
  misc_feature (504)..(504): n is a, c, t, g, unknown, or other
  misc_feature (510)..(510): n is a, c, t, g, unknown, or other
ggagctccccgcggtggcggccgctctagaactagtggatcccccgggctgcaggaattcgcacgagaccattacctagaacatcctaatcgaaaaactgatggatcactcctgcagctgcagctgcagtgcgtcgccgctactccatcgtctattaattcctcgtgtagctccagcgctcggcttagacaagcctctccaacatgaagctcctgggttggatgcaccggaagttacgacagaacagtaatgatgtgttcaaagagttcaacaacgctggaggtgggacgtgcaactgcatcaccgggctggccgcgtcggacccggccactttcctcgccaccgccnacgaatacttcgccgccgacnacgacttcaccaacaatcatccatcgtcgccgggcgccgacctctttcactttggtggcagcggcctcctcaccattgccacgctaggcatcgccgccgtcgcggtgtctgcagatgctgatgaatttgattacnacgtcnacgccgatgctgactccgattttgaagacaacgacgaacccgccggtgatgacaaaaaccaagtcgaaaggggccctcccgccaaggttcacttaggaggggccgcccccggaaaagaacccccggtccctccaaaaaggtttcaatttcccgggttgggcccttttgccaaaggggccccccccccccccctggggg

SEQ ID NO: 31411 - protein, 168 aa, Zea mays
  misc_feature: Ceres CLONE 1407705-F
  misc_feature (49)..(49): Xaa is any aa, unknown, or other
  misc_feature (56)..(56): Xaa is any aa, unknown, or other
  misc_feature (101)..(101): Xaa is any aa, unknown, or other
  misc_feature (103)..(103): Xaa is any aa, unknown, or other
MKLLGWMHRKLRQNSNDVFKEFNNAGGGTCNCITGLAASDPATFLATAXEYFAADXDFTNNHPSSPGADLFHFGGSGLLTIATLGIAAVAVSADADEFDYXVXADADSDFEDNDEPAGDDKNQVERGPPAKVHLGGAAPGKEPPVPPKRFQFPGLGPFAKGAPPPPLG

SEQ ID NO: 31412 - DNA, 694 bp, Zea mays
  misc_feature: Ceres CLONE 1407707-F
  misc_feature: Encodes the peptide sequence at SEQ ID NO. 31413
  misc_feature (464)..(464): n is a, c, t, g, unknown, or other
  misc_feature (495)..(495): n is a, c, t, g, unknown, or other
  misc_feature (521)..(521): n is a, c, t, g, unknown, or other
  misc_feature (544)..(544): n is a, c, t, g, unknown, or other
  misc_feature (643)..(643): n is a, c, t, g, unknown, or other
aaagctggagctccccgcggtggcggccgctctagaactagtggatcccccgggctgcaggaattcgcacgagaccattacctagaacatcctaatcaaaaagcacaagccaaacgtgcagctgaggaatcgcaacggcagtcacgtgtgcgcgttgccaaataaagctactatactagtcaccgctcgattgccgtcgcagccgcccgccggacggagatgggtgcgccggcgctgtcgtccgtcgtcgtggtggccacggcggcagtggtttgcctgtgcggggcctttgcgcaggcgcaggacatggacagcgagtgtgcgcggccggcctaccgcgggttcttcggcgcccccgccgggtcgctgctgccgcagtcggacgtggacctgctggagttccgctgaatctggagtaacctggagacggagttctttctgctgggtccgctctggggtacggnctcgacgccatcgacggcaaccctcaccggnggcgggacgcccctcacatcggcggncagtccgcgtcccttcccccgtncatccgcgaggggcccccccagtctgttacgcaaagtcggcactcagcgatcagagacggtgagggcaccccgagccgtgctgacatcaccgcggcacntcggaagatatcagcagcgctgacggacctggaccgcctttcaccctacaa

SEQ ID NO: 31413 - protein, 62 aa, Zea mays
  misc_feature: Ceres CLONE 1407707-F
MGAPALSSVVVVATAAVVCLCGAFAQAQDMDSECARPAYRGFFGAPAGSLLPQSDVDLLEFR

SEQ ID NO: 31414 - DNA, 720 bp, Zea mays
  misc_feature: Ceres CLONE 1407711-F
  misc_feature: Encodes the peptide sequence at SEQ ID NO. 31415
  misc_feature (567)..(567): n is a, c, t, g, unknown, or other
  misc_feature (585)..(585): n is a, c, t, g, unknown, or other
aagctggagctccccgcggtggcggccgctctagaactagtggatcccccgggctgcaggaattcgcacgagaccattacctagaacatcctaatcgaaaaaaaacagctaatatcgtcgttcgttcctcaagtgatcttaattaatcgtcgagaagttaccagctagcggagatcatcggcaatgtcgaacatggggcaatccttccaggccggcaaggcgcaggcccagggcgagtgccaggcggagcgcgcagcgcagtgcgtcagggacggcgccggcgccaccgcctgcgccgtgaccgacaccgccggagccgcggccgacagcgcgcagctgcaggagcaccgcgccgccggcaccgttcagcaggctgccgagcaggtggcgcagacggcggcgggcgtggcggcagccgtcaaggacacggtggcgggcgcggcggcggccaccaaggacaccgtggcaggagcggcggcaggcgccaatgacgcggtgaccggcggccactcaccgactcacgcgcgtgaaccggacggcgtaccaacaatgctgcatgggcagggntttgcggcggaaggaggnagagacaaccggcgatggcggcgtccgcgaggtccggggagagggcgaccagcttcgccgtcgcgtgcagcctcctcagtcgcttcgtccgccagaaacgcgtcgcggctgccgagctaggcctcaggatcaaag

SEQ ID NO: 31415 - protein, 173 aa, Zea mays
  misc_feature: Ceres CLONE 1407711-F
MSNMGQSFQAGKAQAQGECQAERAAQCVRDGAGATACAVTDTAGAAADSAQLQEHRAAGTVQQAAEQVAQTAAGVAAAVKDTVAGAAAATKDTVAGAAAGANDAVTGGHSPTHAREPDGVPTMLHGQGFAAEGGRDNRRWRRPRGPGRGRPASPSRAASSVASSARNASRLPS

SEQ ID NO: 31416 - DNA, 720 bp, Zea mays
  misc_feature: Ceres CLONE 1407713-F
  misc_feature: Encodes the peptide sequence at SEQ ID NO. 31417
  misc_feature (326)..(326): n is a, c, t, g, unknown, or other
  misc_feature (350)..(350): n is a, c, t, g, unknown, or other
  misc_feature (356)..(356): n is a, c, t, g, unknown, or other
  misc_feature (374)..(374): n is a, c, t, g, unknown, or other
  misc_feature (412)..(412): n is a, c, t, g, unknown, or other
  misc_feature (438)..(438): n is a, c, t, g, unknown, or other
  misc_feature (497)..(497): n is a, c, t, g, unknown, or other
  misc_feature (546)..(546): n is a, c, t, g, unknown, or other
ggagctccccgcggtggcggccgctctagaactagtggatcccccgggctgcaggaattcgcacgagaccattacctagaacatcctaatcgaaaaacagtaggttcattccccccaccacatcgaactgtgcgcgcgctgcgcggtcggtcgctcccctcctctgtccgcgatctcggctggccgcctgggcttggccctcgccaccgctcccgtctccggttccggcggccgagccaggtttgctcgggtcttcgtgccagcgacgatgaaggacaagcgtgggctcgaggacgccggcgacggccgccctgatgccaagaggncgcggtctccggctctgtgcagtngtattngtgaaagcgtcaaagtgnatagtctgcagaggctctgctcatcatggaaaccaatncttcgagagtagtcagtgaaaagtgnagtgcgcactggtccaacttgccctgcaacaatcggggaagggcttccccaaggcgaantgaagggtcaaatggaaaaactctgcaactccgatcccgaacagggtgncctttccccttttaactggagaaaaaatttaaggggggacgggacctccaattccgggtgttttgattaagggggacctgggttgggtttaaccccccgggcccaaggcctttcgcaaatttaaacccgtgtgtttaaaagggggttcccaccaaaaaaaaaggggagttgtca

SEQ ID NO: 31417 - protein, 51 aa, Zea mays
  misc_feature: Ceres CLONE 1407713-F
  misc_feature (20)..(20): Xaa is any aa, unknown, or other
  misc_feature (28)..(28): Xaa is any aa, unknown, or other
  misc_feature (30)..(30): Xaa is any aa, unknown, or other
  misc_feature (36)..(36): Xaa is any aa, unknown, or other
  misc_feature (48)..(48): Xaa is any aa, unknown, or other
MKDKRGLEDAGDGRPDAKRXRSPALCSXIXESVKVXSLQRLCSSWKPXLRE

SEQ ID NO: 31418 - DNA, 676 bp, Zea mays
  misc_feature: Ceres CLONE 1407715-F
  misc_feature: Encodes the peptide sequence at SEQ ID NO. 31419
  misc_feature (348)..(348): n is a, c, t, g, unknown, or other
tggagctccccgcggtggcggccgctctagaactagtggatcccccgggctgcaggaattcgcacgagaccattacctagaacatcctaatcgaaaaagctagcagtcgtcttgcattgtagctagtccattgctctcatcttctcttcttcctccagtcctcccccctttcccctcttcggcctctctcgctcagctcgctcttcattaagctcacgtcgttcctcccttcttcctcttcttcttcttatccgttgttcaattcgttcagctagccggccagagatcgagcatcatctccatcatcgatcgatccatctcatctctttctcttcttctattctatgncgtcgtcgtcccagattagatcgaagctgctagcagtctatccagtctctagctagctagatcaagcccgcagactatataatataatacaagctagctacgtgcttattgctttattagtctagaagaataatctagatatatacgatcgaacatatatctcgatctccgatccaccgatacacacccggccctattcatgcttgaggtgtcgacgctgcgcgggcctactagcagcggcagcaaggcggaaaagactgcgggggggggggggcttcgtcggcaaccacatggggggttcccgaagctcggggaatggttcccatgg

SEQ ID NO: 31419 - protein, 43 aa, Zea mays
  misc_feature: Ceres CLONE 1407715-F
MLEVSTLRGPTSSGSKAEKTAGGGGLRRQPHGGFPKLGEWFPW

SEQ ID NO: 31420 - DNA, 703 bp, Zea mays
  misc_feature: Ceres CLONE 1407716-F
  misc_feature: Encodes the peptide sequence at SEQ ID NO. 31421
  misc_feature (697)..(697): n is a, c, t, g, unknown, or other
tggagctccccgcggtggcggccgctctagaactagtggatcccccgggctgcaggaattcgcacgagaccattacctagaacatcctaatcgaaaaggtgaactgctgacgcttcgcgcgtgtccgaggtcaagtggcaggagtatggagtattaccagggtgaccgcccaggttatcgtcggccgccggcgagctgtaccccgaggagaagatgtatctgatggcgaacgagtggatcgagggtctgccattcttggcgacggacgggcaggtgtatcgtctcagctgccctcagactcgatgtgctccgccgcggtgcccgcgaggtccgatccctctatctccggggctcctcctgctggtcccagcagctcctcgacgtcgtggttcgaatcatccgaggttacataataaagacggatgatgtgcggaaggctttccgtggagcgtactgtgctttccaccttgcttcttatggtatgtgaagcaaggagatggtgcacactgacagatctgatgaggttaatataaatgtgagctgcaatgtactgaacgtttgccatgagcaacatgacataaggcttgtcgatgaaaggacatactatgtcgtgattcgcaggataaccgattgtcaacgtacatgaggcgttgtcttattttccgattgcagaccatgatgatgcttatgtgcacancatatt

SEQ ID NO: 31421 - protein, 49 aa, Zea mays
  misc_feature: Ceres CLONE 1407716-F
MVHTDRSDEVNINVSCNVLNVCHEQHDIRLVDERTYYVVIRRITDCQRT

SEQ ID NO: 31422 - DNA, 900 bp, Zea mays
  misc_feature: Ceres CLONE 1407716-R
ggtggtgtgggttttcttggtgcgaatggttttctaacctgtacgattcgcttgcctttacattcatgtctgggtcgtggagctgctctctaggacagcttcctttgcggtacattatctcgcctcaatctgctcgcttgccgcatgaatattcactattaaagagcgccgattacatgcatcttggcgatgcttctcatgtactcttccaggataggggctggacatgctactaaagcgcagaactcctgtccttgtgcatatttggcaaaccgaaccctgttctcccgaaagtcaccaacagcgtggtgagcacccgtatcaacgtctccccacgtatcacaaagacgaccgcaaggaggctgtgcctcaagtgccagtataacccactgatgacagactacggtggtgctgcttgatcacgctgcaccaagccacgctctggtgtgcaagtgacaacccgcgatcgccatggcaaagcgcacgcttgagaatgcttgtgcatatctgcactggcaatcaccagctgactcgccattgagggctatgaagacgctcacggagctcattacgataattcacaatgagttgtactgtctgggcttctcggagatgaatctgtatccaaccgaacgccctgtcgcaagccatgaacgacaacatcgtaaccacgcttctcgtttatcaacaaccgccctcaatgtgggattgcctgacagaatgggtcccaatcatgctacgcatggacacccaagtctgaaatgccccacgttgtcatgcggggcatggctcctgcgcaatatcgaggcaaccttccacgggattgaatcatggtcccatttacctggggttccacccaaccttggcgtttcgcactttctctggggaacctggactgaa

SEQ ID NO: 31423 - DNA, 736 bp, Zea mays
  misc_feature: Ceres CLONE 1407724-F
  misc_feature: Encodes the peptide sequence at SEQ ID NO. 31424
  misc_feature (590)..(590): n is a, c, t, g, unknown, or other
aaagctggagctccccgcggtggcggccgctctataactagtggatcccccgggctgcaggaattcgcacgagaccattacctagaacatcctaatcgaaaaacataaataacacacaaagttgtccgatcaaagcttgcgcgtttacaatgtctggacgatcaaggcacttcacaatgcccacccttctcgctaccagcttcttctttgtactcctatgcagctcgctacaagtacgtggcgtgaactacacgttcgtgaaggacgcggtgctggcgcccatcgtgtcgtactacgactacatcatcgtgggagacgacacggtcctgtccccgctgcccgccatgctgtcgaagcgcatcctggtgctgctgatggagtgtgccgcctcgccctacgacgacaagcgcatcctctacatgaaccacttcgcggacacgctgtgggagatctcgcccggactcgccctcgcagagacttcgtggcgaattcaagtatcatcaatttccaaccgcgggcgctgggtactcgacacctgccaaatgggccgagcaaactaacacgtgcctcggcaaccattaagtgcgcangccaacctttacgaatctattcccccccccaaggccaagcgctcccctcccgcacatttccccgggcaagaatgttcttgcccgccaccgtggttccagggtgaatttcccgtgatcccacgcacggacctcgcttgaaagcccgg

SEQ ID NO: 31424 - protein, 136 aa, Zea mays
  misc_feature: Ceres CLONE 1407724-F
MSGRSRHFTMPTLLATSFFFVLLCSSLQVRGVNYTFVKDAVLAPIVSYYDYIIVGDDTVLSPLPAMLSKRILVLLMECAASPYDDKRILYMNHFADTLWEISPGLALAETSWRIQVSSISNRGRWVLDTCQMGRAN

SEQ ID NO: 31425 - DNA, 695 bp, Zea mays
  misc_feature: Ceres CLONE 1407725-F
  misc_feature: Encodes the peptide sequence at SEQ ID NO. 31426
aaagctggagctccccgcggtggcggccgctctagaactagtggatcccccgggctgcaggaattcgcacgagaccattacctagaacatcctaatcaaaaaactgcagcagtgctcctcctcctccaccaccacctcggtccatctcactctcacaggctccaattggcatctcgtctcgcgctcgctttccccagtccactcgcgctctcgtttcccggagcttcgcgatgcagcgccttctcgcgctggtggcagccctgctggtgctgctggcgtcgcgtccagcgctggccaccgacccctacgccttcttcgactgggacgtctcctacgtcactgcggcgccgctcggcgtcaagcagcaggtgataggcatcaacggcaagttcccagggcccgtcgtgaacgtcagcaccaactggaacgtcgtcgtcaacgtgctcaacgacctcgacgagcccctcctcatcacctggaacgggatccagcaccggaagaactgctggcaggacggggtgctcggcaccaactgccccatcccgcccggctggaactggacgtacgagttccaggtgaaggaccagatcggcagcttcttctacttcccctcctgcagcgcgccgcctgcggcttcggcggcatcgtcgtcaacaccgcgacgtcatcgccgtgcccttcgtccgccctgacgc

SEQ ID NO: 31426 - protein, 153 aa, Zea mays
  misc_feature: Ceres CLONE 1407725-F
  misc_feature (32)..(135): Pfam Name: Cu-oxidase_3 Pfam Description: Multicopper oxidase
  misc_feature: SWISSPROT Homolog: EC 1.10.3.3 L-ascorbate oxidase
MQRLLALVAALLVLLASRPALATDPYAFFDWDVSYVTAAPLGVKQQVIGINGKFPGPVVNVSTNWNVVVNVLNDLDEPLLITWNGIQHRKNCWQDGVLGTNCPIPPGWNWTYEFQVKDQIGSFFYFPSCSAPPAASAASSSTPRRHRRALRPP

SEQ ID NO: 31427 - DNA, 680 bp, Zea mays
  misc_feature: Ceres CLONE 1407728-F
  misc_feature: Encodes the peptide sequence at SEQ ID NO. 31428
aaagctggagctccccgcggtggcggccgctctagaactagtggatcccccgggctgcaggaattcgcacgagaccattacctagaacatcctaatcaaaaaaaaaacactttacatgaaattttttggatgaaaagcccgcaaccgacttgctcctcaagatctccctgccgtggcactcactcgccttcttcctcccattcccctcgaatcaaccaccagcgattgggatcgaaacgaaacgaaccaaaccaaccaactcgccaccctccaaagtcgtaggcccaatctgaccgccggctaggcaggtagagcgcgcaccgcgccatgtcatccacgtcaacgatctcagagggggtaccatctcagagctgtcgagcaaccggagcgcgacaaggagagctagatactgcactgcccatgtgtagcactctgcctccgccatcgtatgcatcgctgccaggagcgagcggatacagatgctcgaacacggtgcctacgacatctttctcgagctccagccgcctctggtcgtcacctcatatctggtcctgcccgagcgcagcgcctcgcactgcatgacatcaagctatcagacgtgcatcttgtccacctgattcaagtgcctccactgtctggctatcccatctgagtgaggctcaagcccgacacttactgcc

SEQ ID NO: 31428 - protein, 45 aa, Zea mays
  misc_feature: Ceres CLONE 1407728-F
MLEHGAYDIFLELQPPLVVTSYLVLPERSASHCMTSSYQTCILST

SEQ ID NO: 31429 - DNA, 675 bp, Zea mays
  misc_feature: Ceres CLONE 1407730-F
  misc_feature: Encodes the peptide sequence at SEQ ID NO. 31430
  misc_feature (675)..(675): n is a, c, t, g, unknown, or other
aagctggagctccccgcggtggcggccgctctagaactagtggatcccccgggctgcaggaattcgcacgagaccattacctacaacattctaatcgaaaaatcaccgccgcggcctctatttctcccccatcccccctcgcatgccccgctcgccgccgctacctcctcccgcccctaggtgacggggactcactgactccctacttccgtcgcccaaatttctatctcactatctccgccgcgagatctccggctgcccgcccatggtcgccgcctccggcctcgcgctgccgcgggtatccgcaccatgcccggtgcgcacgcgtggtggcctccgccccgccttcctccgagtcgcgcagcccgtgacgctgccaccgccccagctccggtgctgcgcgtccaccgtcgacgatggcgtggtgtccgctgcggcttccaagccccgcctccccagggcgattggtatgggttcaaaggtcggtggatgtggatcagccatcccaacacttagcgtgtcaaatgatgacctttcgaagatagttgaaacctcatatgaatgaattgcggctcgaactgggattcgtaacaggagagatctttcaggagatgaaaccttgcggggactctcgatacaagcagctcaaagggcacttgagatggccgggataan

SEQ ID NO: 31430 - protein, 99 aa, Zea mays
  misc_feature: Ceres CLONE 1407730-F
  misc_feature: SWISSPROT Homolog: EC 2.3.1.41 Beta-ketoacyl-acyl-carrier-protein synthase I
MVAASGLALPRVSAPCPVRTRGGLRPAFLRVAQPVTLPPPQLRCCASTVDDGVVSAAASKPRLPRAIGMGSKVGGCGSAIPTLSVSNDDLSKIVETSYE

SEQ ID NO: 31431 - DNA, 687 bp, Zea mays
  misc_feature: Ceres CLONE 1407731-F
aagctggagctccccgcggtggcggccgctctataactagtggatcccccgggctgcaggaattcgcacgagaccattacctagaacatcctaatcgaaaactcctccattcctctccctctctctctcgtcggtgggaccgtgggatacgctgacggacggacgggctgaggcaaggccgcctgcgggcgggaggaagaaaagcgaagctgctgcgccctcccctcccccatctccgccccccgcctcacccaccagacgagagagcgagcgcagttcggccgccggtcgcgtccgactccagcaaagccgagcgcccaccccctcaccctattaccttcctctcgggtccaattcggtgcctggctgactccgcacgttttccccccttttccctccctcgaccgacgaccgtccgtccaccaccggatccaggagcgaccctccctcgtgctcgtcgacgatcgaccggccgccgatcgtccaggaaggatgtcgagcctcgaggagccgctgggtctcggagacctgcccaagttgagtattaacagactccggcgggttcgtgtcgctgggcgctcggaggccaccggcccgacgacgacgacccccgcactgggaaaataaagcagcaggctcctgcaaaaatgggaagccctcagaagggctttccatcatggagagcac

SEQ ID NO: 31432 - DNA, 696 bp, Zea mays
  misc_feature: Ceres CLONE 1407732-F
  misc_feature: Encodes the peptide sequence at SEQ ID NO. 31433
  misc_feature (558)..(558): n is a, c, t, g, unknown, or other
  misc_feature (564)..(564): n is a, c, t, g, unknown, or other
aaagctggagctccccgcggtggcggccgctctagaactagtggatcccccgggctgcaggaattcgcacgagaccattacctagaacatcctaatcaaaaaacagatccctctccactgtctcaccctttctctctcctcgaccctcccgacgcggcaaagcaaaaacacaaggaggagaggagggagagaaggaagaaggcgaggccaaaaatcccctccccctccccaaatcctagcccaataatctctcaatcaggggattcttaggtctgatcaagtcggaggattcggcagggcgcagccatgaacgagaaggcgtccgtctccaaggagctcaacgccaagcacaagaagatattggaaggtcttctacggcatcctgagaatagagaatgcgcagactgcaagtcaaagggtcctcgatgggcaagtgtgatctaggtatctttatatgcatgacatggtctggcattcatagaagcctgggggtgcacatatctaaggtaagatctgccaccctggatacatggctgccagagcaagttgcatttattncatcanggggaaacgaaaaagcaaatagctatggggaagcagagctgcctcctaactacgataggggtggaataaagaattccatccgtgcaaataatgaggacaagagatggtaccaagggatggaacatccaaatc

SEQ ID NO: 31433 - protein, 100 aa, Zea mays
  misc_feature: Ceres CLONE 1407732-F
  misc_feature (1)..(100): Pfam Name: ArfGap Pfam Description: Putative GTPase activating protein for Arf
  misc_feature (55)..(55): Xaa is any aa, unknown, or other
  misc_feature (57)..(57): Xaa is any aa, unknown, or other
MRRLQVKGSSMGKCDLGIFICMTWSGIHRSLGVHISKVRSATLDTWLPEQVAFIXSXGNEKANSYGEAELPPNYDRGGIKNSIRANNEDKRWYQGMEHPN

SEQ ID NO: 31434 - DNA, 740 bp, Zea mays
  misc_feature: Ceres CLONE 1407733-F
  misc_feature: Encodes the peptide sequence at SEQ ID NO. 31435
  misc_feature (588)..(588): n is a, c, t, g, unknown, or other
  misc_feature (651)..(651): n is a, c, t, g, unknown, or other
  misc_feature (705)..(705): n is a, c, t, g, unknown, or other
  misc_feature (714)..(714): n is a, c, t, g, unknown, or other
aagctggagctccccgcggtggcggccgctctagaactagtggatcccccgggctgcaagaattcgcacgagaccattacctagaacatcctaatcgaaaaaaaaccacctcacgagcccaaccaaattcaaaccaacgctaccgtgcaaccaaaccaaccaaccccattcctccgccggccgccggcagccgcccgcgatgtcgaaggccgcggcagcgtccctcccgccgccgccgccagaggtggcgcaccttgtggagcagctccagcgccaccacctcgccccggacgcgtccctcctctccagctccgcgcactccgacctcctccaggcgcgcgaggaggtcgcggcggagcgcgcgctgtacctcgaggcactggcggtgtacgcggaggcggtggccatggtggaagagtaccatgcggctgccggcgccggcaagaagctcaactgctcccccgcagtgtacgagtctttggagcaccggttggccgtggcagaagcagcacagaggcttaagctcccactgctctctcaggacggggaagtcccatgagcagagatcgaaaagctgagcacctattncagaaagtcattcgatagcaccctcacaagcgcgacacccagctcaaagtcaatctcgacgangtacaacattatagcagcagcgctagtgcggtgactggtgctgctccacattgnagtggtagntctgatgcagttgaaccctggaagtg

SEQ ID NO: 31435 - protein, 119 aa, Zea mays
  misc_feature: Ceres CLONE 1407733-F
MSKAAAASLPPPPPEVAHLVEQLQRHHLAPDASLLSSSAHSDLLQAREEVAAERALYLEALAVYAEAVAMVEEYHAAAGAGKKLNCSPAVYESLEHRLAVAEAAQRLKLPLLSQDGEVP

SEQ ID NO: 31436 - DNA, 742 bp, Zea mays
  misc_feature: Ceres CLONE 1407737-F
  misc_feature: Encodes the peptide sequence at SEQ ID NO. 31437
  misc_feature (453)..(453): n is a, c, t, g, unknown, or other
  misc_feature (456)..(456): n is a, c, t, g, unknown, or other
  misc_feature (517)..(517): n is a, c, t, g, unknown, or other
  misc_feature (617)..(617): n is a, c, t, g, unknown, or other
  misc_feature (630)..(630): n is a, c, t, g, unknown, or other
  misc_feature (724)..(724): n is a, c, t, g, unknown, or other
  misc_feature (736)..(736): n is a, c, t, g, unknown, or other
  misc_feature (742)..(742): n is a, c, t, g, unknown, or other
ggagctccccgcggtggcggccgctctagaactagtggatcccccgggctgcaggaattcgcacgagaccattacctagaacatcctaatcgaaaagcattgcattgcataaacctctcgtgggaagtgcaaacaccaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggcaccgtccccttctacccgtccgcggagtccgccgccgccgcgcactgcgacggcacgctgtacccggagctctgcctgtcgacactcgcggacatcccggacctacacaagaagccgctcccggacgtcatctgcgncgncgtgaaccgcaccgaggacgtggtggtcgccacgtccagcaactgctcgtactacctgcangacaggtccctgtcggcgcgggacccgctggccatcaacgactgcctggagctgctgtccacacgatggacgagctccgcgccagcaccgccgacctggngtccccccccgcnagggggtcggcgtcggcgggcgtgtcccagggcgcaggcgcgcgacgatgagcacgtgatgacggtgttttcgggggcatcaccaacagtacanctggctcgacgntttcgn

SEQ ID NO: 31437 - protein, 170 aa, Zea mays
  misc_feature: Ceres CLONE 1407737-F
  misc_feature: SWISSPROT Homolog: EC 3.1.1.11 Pectinesterase
  misc_feature (74)..(74): Xaa is any aa, unknown, or other
  misc_feature (75)..(75): Xaa is any aa, unknown, or other
  misc_feature (95)..(95): Xaa is any aa, unknown, or other
  misc_feature (129)..(129): Xaa is any aa, unknown, or other
  misc_feature (133)..(133): Xaa is any aa, unknown, or other
  misc_feature (164)..(164): Xaa is any aa, unknown, or other
MPPIPKRGEHLLVLLIVACAATAATAAGTVPFYPSAESAAAAHCDGTLYPELCLSTLADIPDLHKKPLPDVICXXVNRTEDVVVATSSNCSYYLXDRSLSARDPLAINDCLELLSTRWTSSAPAPPTWXPPPXGGRRRRACPRAQARDDEHVMTVFSGASPTVXLARRFR

SEQ ID NO: 31438 - DNA, 662 bp, Zea mays
  misc_feature: Ceres CLONE 1407743-F
  misc_feature (490)..(490): n is a, c, t, g, unknown, or other
tggagctccccgcggtggcggccgctctagaactagtggatcccccgggctgcaggaattcgcacgagaccattacctagaacatcctaatcgaaaatctctatgacacgtgccgcttcccccctcgtaagctaagggacccatgggaaggccggcatcttctccaatcgccagcctctggccctctcgatttcttcttccacatctcccgatccatcgcaacccaaagcctactccaggcagatctccgtctccgccgacgctgccggctagagaacagcatcagatccgctgtgatgcttctccgccgcatgctatcaaccgcggtgcgccgacgctcggccgtgaacgccctggccttcgcgaacgcgcgagaggactccacgtacgtccgtgggctgctgcctgcgctcgctgccgatgcgacagtgcgcgagaatacgtgatgccgaatgagcgcatcgacgaggacgcgatgcacagctccgcngcatgaagcacctgaacgagcgctacgtcaggtacttcagacacgtgctgatcgacgaggaccagaagctcgatcctgtcgtgtaagagaccagcgtcagcacagtgtgcaagaagctgggcatcatctaggatcgtcgctcggcgtgtgcatgagtactacgacaagggaa

SEQ ID NO: 31439 - DNA, 745 bp, Zea mays
  misc_feature: Ceres CLONE 1407744-F
  misc_feature (545)..(545): n is a, c, t, g, unknown, or other
  misc_feature (546)..(546): n is a, c, t, g, unknown, or other
  misc_feature (567)..(567): n is a, c, t, g, unknown, or other
  misc_feature (620)..(620): n is a, c, t, g, unknown, or other
  misc_feature (692)..(692): n is a, c, t, g, unknown, or other
  misc_feature (741)..(741): n is a, c, t, g, unknown, or other
  misc_feature (745)..(745): n is a, c, t, g, unknown, or other
tggagctccccgcggtggcggccgctctagaactagtggatcccccgggctgcaggaattcgcacgagaccattacctagaacatcctaaccaaaaaaacgagaaggaagccaccgctccccaatcgcctgcttgccttcccatcctcctcgtagatctccggcaccgggcaccatgagctcctactccggcgaccgctcctcctcctcctccttgcgccccaccaacacctccttcgactcctacaagttcgacttcggcatcaactcctcccgctcctccggctctcgccccctccgcgaccagcggccgggcgcggctaccaaccctccaacgaggcccgccaccggcgccacgtggatgcaccagcccgccagcgccaagccgtcgtggacccaccagccttcccccgccgcggcgtcggcgcccaccatggcggggcctggatccgggccaacctccatggtcggcgacatctttggccggagctggtcctccgccgcgccctcctctgggttcggcatccctcaggccaacaaccccgnngctctcagcgatctcctcggntccgcgctcggttcctccccgctccagtccaacgcgccgctcagatcccgcgncgcgccacaggcatccaggccagccggtgagaagcccaatggtcacgctagcagctctcccttctcgatggncgccatggcgggcgcgctcccgaaactacgggagcacgatgggctccgntgan

SEQ ID NO: 31440 - DNA, 689 bp, Zea mays
  misc_feature: Ceres CLONE 1407745-F
aaagctggagctccccgcggtggcggccgctctataactagtggatcccccgggctgcaggaattcgcacgagaccattacctagaacatcctaatcgaaaaattttgccgatgcgacggtgaaatcccgcacctacctccttcctctctcaccgaggaccctcgcaccaagaactgagcgggaagagaggtagagaggcaagcgcacgagagtttctgctcctagtgtcgtctcgccccgcctccgtctcctttccctctctggtgctctctctgcgagtctcgtcgcattgggtccgctccctcacgaaaggcggtagctttctgtcttccctgatcgatctagataatggcgaccacgacgtacgcgaccaccgccgcagcaggaggcgccaccaccgccaagccgtggccgtcgagatcggtcatctggcacaggatggccggaggagggaagcgaagctcccaggtggagcggagagacgccgacgctgtgaagggccgatagaaagacgaggatatgcggtaagtgtcacagcctgagagcagtgtgagataccatcggagagagaaccgaccgtcatgagcacgataggaagtgatagagatctgtggaaacaccaaatcggctggatggggcctgaaaagtttcctaaccggaaagaatgtgtaaggacccggatcaaatg

SEQ ID NO: 31441 - DNA, 732 bp, Zea mays
  misc_feature: Ceres CLONE 1407748-F
  misc_feature (27)..(27): n is a, c, t, g, unknown, or other
aaagctggagctccccgcggtggcggncgctcaataactaaaggagcccccgggctgcaggaattcccacgagaccattacctagaacatcctaatcgaaaaaagggctctacacgaaattttgcggccaagtgttcgcaaccaacccctcttcctcgcccactgaaaggcgcagagggtcccgtgttagcataccgagcgagacgaatgagggggggacgtggaaagctttgggcccagtgcagtgtgaactgtatgagactccgaagccaagcggagaccttcttcaccgccgacgactcctggagatccggccggagggaggaggccacggacgctgatacccatctggataactgactgtatgatctccacgaggcactcaggtgacggaccgacacagatctggcccaccctctggcctctactgcacgaatcagaacacatatctaggaccgttgcgtaaagtgggatctcgcacacagcatctgtgctgtttccgcgcaatagcttagccagagttatagctatccgacttactgctcccaaacttatcaactatgcatgcagaagtagacctcacgatttcatctataatagatacctacggcccccgacttaaaggcagaagaaccccaaccaccgagcatcaaatcatcgactgcatccagagatgtgcaaatccgcgtgctggatatgcccagatggaacgccattgatcgcgctgatata

SEQ ID NO: 31442 - DNA, 752 bp, Zea mays
  misc_feature: Ceres CLONE 1407749-F
  misc_feature: Encodes the peptide sequence at SEQ ID NO. 31443
  misc_feature (619)..(619): n is a, c, t, g, unknown, or other
  misc_feature (624)..(624): n is a, c, t, g, unknown, or other
aagctggagctccccgcggtggcggccgctctagaactagtggatcccccgggctgcaggaattcgcacgagaccattacctagaacatcctaatcgaaaaatcccacgctgccctcggcgctgcgtctggacccggcacctacctcccccctccccacctcgccgccggcgggtggagtcgggctggagcagccgctctcctctgttacccccctaaccccctataaagaaaaagaaaaaaaaacagagagagagagcgagcgaccggcggctcggcagccatggggcacggcgtcagctgcgcccgcaccggcgacaagcacgactacttccgcgcggcgcaggtcggtgacctcgaggccctggacgcgctcctcgacgccgacccctctctcgcccgccgcgccacgctctacgaccgcctctccgcgctccacatctccgccgcgaatggccgcctcgaggtgctgtcaatgctcttggatcacggggtgccgccggacgtggtgaatcggcacaagcagacgccgctgatgctcgcggcgatgcacggcaagactgactgcgtgctgacgctcctgcatggcggcgccaatatcctcatgttcgattcccagnacggntggagctgacgtgcacacgcgtcctacttacggcacgtcggctgcctgcagccatcatcacggaggagcggacacgccggtagcagactcatgaggcttctgccggatcgtcgacgtgagggacgacc

SEQ ID NO: 31443 - protein, 116 aa, Zea mays
  misc_feature: Ceres CLONE 1407749-F
  misc_feature (79)..(111): Pfam Name: Ank Pfam Description: Ankyrin repeat
  misc_feature (46)..(78): Pfam Name: Ank Pfam Description: Ankyrin repeat
  misc_feature: SWISSPROT Homolog: EC 2.7.11.1 Non-specific serine/threonine protein kinase
  misc_feature (113)..(113): Xaa is any aa, unknown, or other
MGHGVSCARTGDKHDYFRAAQVGDLEALDALLDADPSLARRATLYDRLSALHISAANGRLEVLSMLLDHGVPPDVVNRHKQTPLMLAAMHGKTDCVLTLLHGGANILMFDSQXGWS

SEQ ID NO: 31444 - DNA, 739 bp, Zea mays
  misc_feature: Ceres CLONE 1407750-F
  misc_feature (108)..(108): n is a, c, t, g, unknown, or other
  misc_feature (174)..(174): n is a, c, t, g, unknown, or other
  misc_feature (179)..(179): n is a, c, t, g, unknown, or other
  misc_feature (180)..(180): n is a, c, t, g, unknown, or other
  misc_feature (239)..(239): n is a, c, t, g, unknown, or other
  misc_feature (243)..(243): n is a, c, t, g, unknown, or other
  misc_feature (293)..(293): n is a, c, t, g, unknown, or other
  misc_feature (354)..(354): n is a, c, t, g, unknown, or other
  misc_feature (388)..(388): n is a, c, t, g, unknown, or other
  misc_feature (426)..(426): n is a, c, t, g, unknown, or other
  misc_feature (534)..(534): n is a, c, t, g, unknown, or other
aaaactggagctccccgcggtggcggccgctctagaactagtggatcccccgggctgcaggaattcgcacgagaccattacctagaacatcctaatcgaaaaactgcncctgcggaggatcggaggaaccagtagcggaggcttcgattttctgctggcgcaataaatttctcncatgnnatcggaggggcgcgtcctcgctcgtctcccgctgcctcctggcgagggcccctgccggngcgncccccgctgccccctccttggctggtgcaggacagtggcctgcagatggnaatgaacaggctggtttgccaggtggttcccttcaaaaaggttcagcaactggcaggaagncaagaaaagagaagcccccctttacccgcggggnctcagttcatgtgaactaacacaagcttcctcattaantggggcaactttttgttgattccgcattccggcagacctttcccaactctggacctcctaaacagggggagtgaattgctcatggtgggctgaaggttgacccaaggnaacttttaacgctgcagtaactggcgtttccaaggtttttttgatgaaggcattgcccgagatactggcctatggaaaggtccgtattccctactgggggttgctgatttgaagagaagcacatgacgagcttgctggctttgagaactgggacacggaagcatatgacagcagcccaattgaaatacccatggtgcccctctat

SEQ ID NO: 31445 - DNA, 732 bp, Zea mays
  misc_feature: Ceres CLONE 1407754-F
  misc_feature: Encodes the peptide sequence at SEQ ID NO. 31446
  misc_feature (523)..(523): n is a, c, t, g, unknown, or other
aaagctggagctccccgcggtggcggccgctctagaactagtggatcccccgggctgcaggaattcgcacgaaccattacctagaacatcctaatcgaaaaaatcagtgctcgctagcccaccacgccctgaacctagcccggacaccagccagaacaggccatgtccatgggctccccggtgcagctcaggcggctgaagcctctgtaccagttcgtggtgaacaacatcctggccatcgtggccgtgccgctcgccaccgcggtcctgctcaaggcgtcgtcgctcgggcccgaggagatcctggcgctccggccggcgcacctgttcctggccgcgttcctgcctgccgcggccacggtgctgtacctgatgctccggccgcgcacggtgtacctggtggactacgcgtgcttccgcaccagccccaaactgcgcgtcccgttcgcgacgttcctgaagcactcccgcgtgtgggcgggcttcgacgagcgcagcgtccggttcatgacgcgcctgctgnagcgttcggggctcgggggaggaaacgtgcctgccgtacgggaagaactacatcccgccgtcgcgcgacctggagtcctcccgcgcggaggcgaactcgtcatcttttcgacatcgaagacttgctcccaagaccggggtcccccgcggaacatcaactcctggggggaactggaccctgttcggccaacccctcctttggggaatggg

SEQ ID NO: 31446 - protein, 190 aa, Zea mays
  misc_feature: Ceres CLONE 1407754-F
  misc_feature (69)..(172): Pfam Name: FAE1_CUT1_RppA Pfam Description: FAE1/Type III polyketide synthase-like protein
  misc_feature (121)..(121): Xaa is any aa, unknown, or other
MSMGSPVQLRRLKPLYQFVVNNILAIVAVPLATAVLLKASSLGPEEILALRPAHLFLAAFLPAAATVLYLMLRPRTVYLVDYACFRTSPKLRVPFATFLKHSRVWAGFDERSVRFMTRLLXRSGLGGGNVPAVREELHPAVARPGVLPRGGELVIFSTSKTCSQDRGPPRNINSWGELDPVRPTPPLGNG

SEQ ID NO: 31447 - DNA, 729 bp, Zea mays
  misc_feature: Ceres CLONE 1407758-F
  misc_feature: Encodes the peptide sequence at SEQ ID NO. 31448
  misc_feature (694)..(694): n is a, c, t, g, unknown, or other
aagctggagctccccgcggtggcggccgctctagaactagtggatcccccgggctgcaggaattcgcacgagaccattacctagaacatcctaatcgaaaaatcacccacgcgacgcgagccaaacccgaaaaaacagtaggcgaggcagggaaacggaaaccagactaccgcccccgaaaccgcgacgaccccacacctcgtccgcccctcctcccttcccgactcctactggctatccatcgcccgtctcccccgcgatcaagctgaccagagccggcaaccgatggtggtggtggcggtgggagggggcggaggcggcggctgggggacgtgggaagagctggtgctgggcggcgcagtgctccggcacgggggcgccgcgtgggccaccgtcgccgaggagctccggacccgttccccgtgcaccttctcggccgaggaatgtgaagcaaaatttgcagagatacagttgcggtactccgcatgcaatgcttggtttgaagagcttcgtaagcagagagttgctgaactgaaaagggaattggagaagtcgaaaaattctatcggatccctccaatctgtgattcaaagcctcagcaatagcaaacatggttgacgggagttctgaataccacaccagtcatactgaatcatgtccccgctctgaaatacagcagatactaattcctcanggtaagaacatcccaggatagatcatcagctgcta

SEQ ID NO: 31448 - protein, 110 aa, Zea mays
  misc_feature: Ceres CLONE 1407758-F
MVVVAVGGGGGGGWGTWEELVLGGAVLRHGGAAWATVAEELRTRSPCTFSAEECEAKFAEIQLRYSACNAWFEELRKQRVAELKRELEKSKNSIGSLQSVIQSLSNSKHG

SEQ ID NO: 31449 - DNA, 683 bp, Zea mays
  misc_feature: Ceres CLONE 1407760-F
  misc_feature: Encodes the peptide sequence at SEQ ID NO. 31450
aaagctggagctccccgcggtggcggccgctctagaactagtggatcccccgggctgcaggaattcgcacgagaccattacctagaacatcctaatcgaaaactgcctttcggcttaccctctctctctctctctcacacacacacacaaccactcacactgccggttggtttcccttccgttgtggttggtgcgtacttagtggcggccggccatggcgcggaggaggggcttctcggcggtgctcctgtgcctggcaggcgcggcgtcgggcgagccgctgccgcagtactacaatgccatcttcagcttcggcgactccttctccgacacgggcaacttcgtcatcatcaactcgggcaagctgcccaacatgcccaagttcccgccgccgtacgcgaggtgctccaacggccgcctcgtgatcgacttcctggccgaggcgttcggtctcccgctgctccctccgtcggcgaacaagggcaccaacttcagccagggcgccaacttcgcggtgatgggcgcgacggcgcttgacctcaagtacttcaaggacaacaacgtgtggagcatcccgcccttcaacacgtccatgggcgtgcagctggagtggttccaggaggtgaagcgcagcatctgccccgacgaccccggcgcgtgccgcgccctgttcgggagggccc

SEQ ID NO: 31450 - protein, 156 aa, Zea mays
  misc_feature: Ceres CLONE 1407760-F
  misc_feature: SWISSPROT Homolog: EC 3.2.1.51 Alpha-L-fucosidase
MARRRGFSAVLLCLAGAASGEPLPQYYNAIFSFGDSFSDTGNFVIINSGKLPNMPKFPPPYARCSNGRLVIDFLAEAFGLPLLPPSANKGTNFSQGANFAVMGATALDLKYFKDNNVWSIPPFNTSMGVQLEWFQEVKRSICPDDPGACRALFGRA

SEQ ID NO: 31451 - DNA, 744 bp, Zea mays
  misc_feature: Ceres CLONE 1407763-F
  misc_feature: Encodes the peptide sequence at SEQ ID NO. 31452
  misc_feature (702)..(702): n is a, c, t, g, unknown, or other
aaagctggagctccccgcggtggcggccgctctagaactagtggatcccccgggctgcaggaattcgcacgagaccattacctagaacatcctaatcgaaaagttagctgtgcctgctcccatttggagggacgaagttttatcctgtggttactgcctgtcgatgtcaagcaatttttatgtactctagagattagtttggctgcatcctccgtatctttaccttgttgaccagggatggagcttgtatacatggaaaggagaaacggatcgtacgacgatggcgcggttccagagttcagtggaaggggggctggaggggatcaggatcaggacccgtccgctgctgcatccgaggtccagtctgactcgcgtcagacaccggacgagaagaagagcaagggctgccaatcatgccgtgacccattctgttcatgcagcggcggcacaccccactcggaactgttccccccacatcctgccaagatgatgatcctggagttcctcgtcgcgagcctcaggcacccgacaagaacccacaacatcagtgatctcgacgacctgatcgccgacggggtcagccaagggagcgtggtaaacctcggcccttctgagaagaaggtgctggaatctctgcacgccatggtaaacgccagacgaggccgagagcccgtcgcccgtcatggcgggatctaagctgangaaaatccgtccaagtccacgtcatacgcagtcgaaatactg

SEQ ID NO: 31452 - protein, 152 aa, Zea mays
  misc_feature: Ceres CLONE 1407763-F
MELVYMERRNGSYDDGAVPEFSGRGAGGDQDQDPSAAASEVQSDSRQTPDEKKSKGCQSCRDPFCSCSGGTPHSELFPPHPAKMMILEFLVASLRHPTRTHNISDLDDLIADGVSQGSVVNLGPSEKKVLESLHAMVNARRGREPVARHGGI

SEQ ID NO: 31453 - DNA, 744 bp, Zea mays
  misc_feature: Ceres CLONE 1407765-F
  misc_feature (195)..(195): n is a, c, t, g, unknown, or other
  misc_feature (367)..(367): n is a, c, t, g, unknown, or other
aaagctggagctccccgcggtggcggccgctctagaactagtggatcccccgggctgcaggaattcgcacgagaccattacctagaacatcctaatcgaaaactgcctttcttctcccgttccccgcggcctgcgcgcgcgttctctccctcacctccgcccctttctctctctctctcgctctcgctccgggcngacggctggggcgaccgccgctttatccgtgcggcccttccttttgttctcccgtccccccaaccccccttcgagctctatctgtctcttcctctcgaggcgacgcctgggctaccgcgccgctactggcggctcccgcgacaggtgcctagtctccatcaggtggcatgtnctcttcgggctcttcaccggggacgtgcactggcagctctgcatggatacacccagttcctttactgggtccgcggccgccctatggacctcgtaaggttaaaaaagtgggaaaagtggaaatccaaggtccggagggaaagtaaaatccaaaaggggggaaattggggggaaattcccggaaaattcaagagaaaaagggggggggggttttttcgggggggacttggggaccccacaaaaaatttggggggtggggacccctgtaaccccaggggggggaaaagatggggggaaaaaagagcccccttggaacaaagggaagttggaaggccccccccctgggggggggggggggggccccccctctcaaaaatg

SEQ ID NO: 31454 - DNA, 736 bp, Zea mays
  misc_feature: Ceres CLONE 1407769-F
  misc_feature: Encodes the peptide sequence at SEQ ID NO. 31455
  misc_feature (241)..(241): n is a, c, t, g, unknown, or other
  misc_feature (260)..(260): n is a, c, t, g, unknown, or other
  misc_feature (262)..(262): n is a, c, t, g, unknown, or other
  misc_feature (265)..(265): n is a, c, t, g, unknown, or other
  misc_feature (268)..(268): n is a, c, t, g, unknown, or other
  misc_feature (271)..(271): n is a, c, t, g, unknown, or other
  misc_feature (277)..(277): n is a, c, t, g, unknown, or other
  misc_feature (340)..(340): n is a, c, t, g, unknown, or other
  misc_feature (403)..(403): n is a, c, t, g, unknown, or other
  misc_feature (571)..(571): n is a, c, t, g, unknown, or other
  misc_feature (595)..(595): n is a, c, t, g, unknown, or other
  misc_feature (607)..(607): n is a, c, t, g, unknown, or other
  misc_feature (625)..(625): n is a, c, t, g, unknown, or other
  misc_feature (648)..(648): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (719)..(719): n is a, c, t, g, unknown, or other
  misc_feature (721)..(721): n is a, c, t, g, unknown, or other
  misc_feature (723)..(723): n is a, c, t, g, unknown, or other
  misc_feature (724)..(724): n is a, c, t, g, unknown, or other
  misc_feature (732)..(732): n is a, c, t, g, unknown, or other
aagctggagctccccgcggtggcggccgctctagaactagtggatcccccgggctgcaggaattcgcacgagaccattacctagaacatcctaatcgaaaaccggaatggtatcgtgcgacctgtagtcgtcgccagccacctcgctccctcctagacgacacccagctagtgctcccttccacacccaggaaccagccacctaaccccgcccgccatgccgggcctcgccgcctccgaanactcgcccccggcggcggngncgncgncgngccggntctcgtcgccgctaccccgtcgcgcgccgtcgtccccgtcgccgtccgcctcctcgcgcgccnggcctcggaaagcctcgccctctcccgcggcctttcccggcgaggccgacgactcgctcggcnacccggatctgggggcccttcctcctccggcaggggcgccacgccctggtgtccagcgaagggcggtgcccccccccgcgcattccaattccccccagccggccgccatggccctctaaccaaccggcgaaggggcccaaactcaaactcgcccgggaacccccccgntccccgcccgcatccatggggggnctgggcgggccngctaaaggggtccccgtnccaagaggggctgtggagatctnaggcggccccaaaagggcccccccaaaggggagcccaaaaccaaggcggggtnnncgggggggagaaaacncnanngatgtggnctct

SEQ ID NO: 31455 - protein, 101 aa, Zea mays
  misc_feature: Ceres CLONE 1407769-F
  misc_feature (9)..(9): Xaa is any aa, unknown, or other
  misc_feature (15)..(15): Xaa is any aa, unknown, or other
  misc_feature (16)..(16): Xaa is any aa, unknown, or other
  misc_feature (17)..(17): Xaa is any aa, unknown, or other
  misc_feature (18)..(18): Xaa is any aa, unknown, or other
  misc_feature (19)..(19): Xaa is any aa, unknown, or other
  misc_feature (21)..(21): Xaa is any aa, unknown, or other
  misc_feature (42)..(42): Xaa is any aa, unknown, or other
  misc_feature (63)..(63): Xaa is any aa, unknown, or other
MPGLAASEXSPPAAXXXXXRXSSPLPRRAPSSPSPSASSRAXPRKASPSPAAFPGEADDSLGXPDLGALPPPAGAPRPGVQRRAVPPPAHSNSPQPAAMAL

SEQ ID NO: 31456 - DNA, 740 bp, Zea mays
  misc_feature: Ceres CLONE 1407770-F
  misc_feature: Translation starting site: 341
  misc_feature (700)..(700): n is a, c, t, g, unknown, or other
  misc_feature (715)..(715): n is a, c, t, g, unknown, or other
  misc_feature (716)..(716): n is a, c, t, g, unknown, or other
  misc_feature (719)..(719): n is a, c, t, g, unknown, or other
  misc_feature (723)..(723): n is a, c, t, g, unknown, or other
  misc_feature (728)..(728): n is a, c, t, g, unknown, or other
  misc_feature (730)..(730): n is a, c, t, g, unknown, or other
  misc_feature (735)..(735): n is a, c, t, g, unknown, or other
  misc_feature (740)..(740): n is a, c, t, g, unknown, or other
aaagctggagctccccgcggtggcggccgctctagaactagtggatcccccgggctgcaggaattcgcacgagaccattacctagaacatcctaatcgaaaaaactccgacccacaccacggcacggcagtctttctcagtctcgggcgagcgcgtcgctctcttcgttgctgcctcctagctgtccgggctctgcgcggcgccgagcttcggtcgtacgctcagacgattcgatcggaggtggctgaggagatggagcctgattcgtcgacgacgagggtcgcattgctggagctgcttctcctggcggtcgtccgcccgcccgtgctcggcggctccgatggatgatgtgctgctcagctctggtgactttgagacggcaccagccggctgtttcctaatatctgcgtctgttgatgagtgtgcctcgtcgatcgctgtgtgtgcatcttgggcccagtctagctcttttcagcaggccacgccctgggtggcatgatcctgattgttccatagggagaccatgctggtttgctagggaatgatgctagcgttgggaaggtggtgtacttccagaggggctcgcctccgctggtacatttcggctggccggtcttggggacagttggaggcactgatcgtctcggggttaggtggtggggcggccatagtggtttgagcgaggctcgtccccccgggnggtgggggggggtgnnttngttngtgtngngttgnggggn

SEQ ID NO: 31457 - DNA, 770 bp, Zea mays
  misc_feature: Ceres CLONE 1407771-F
  misc_feature (328)..(328): n is a, c, t, g, unknown, or other
  misc_feature (426)..(426): n is a, c, t, g, unknown, or other
  misc_feature (456)..(456): n is a, c, t, g, unknown, or other
  misc_feature (471)..(471): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (583)..(583): n is a, c, t, g, unknown, or other
  misc_feature (585)..(585): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (593)..(593): n is a, c, t, g, unknown, or other
  misc_feature (597)..(597): n is a, c, t, g, unknown, or other
  misc_feature (598)..(598): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (607)..(607): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (618)..(618): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (642)..(642): n is a, c, t, g, unknown, or other
  misc_feature (643)..(643): n is a, c, t, g, unknown, or other
  misc_feature (682)..(682): n is a, c, t, g, unknown, or other
  misc_feature (745)..(745): n is a, c, t, g, unknown, or other
aagctggagctccccgcggtggcggccgctctagaactagtggatcccccgggctgcaggaattcgcacgagaccattacctagaacatcctaatcgaaaaacccaattcaatttcaaaccgcaatctcccctgccttgccttccttccccttcacagcttcatccaccgctcctccaatctccatcgccatcgccaaccctgagctgaaagcaaggccaacaagcatcatagcagtctcgctctcgcaccacgcgagtgagacaccaggcaaccaccacgagacagggacaccgacgggcgccatcctcatccaccaccaccctccncagcttccgttggcttcactcccactgcaggccccacttcactcgctcgcgccacagatctcgcctgccggaacctaaatggccgcaggtggacgcgncccgggggagtaacgccgatgcagccgccnggtggggcaatggcnggacggcgaggcccaggggggcggagnnnntcggcgccgtcatcaaggaagaaaggaatgaggagctcgcgctcttcctcgagatgcgccgacgcagaaaaaggagcgcggngnttnnncgnaggnncgnnnnnanaannnnnnaangannnnnngggatctctggagaannacaggggccggggggaagagaattgaaggtttttcgggncctcccgccatccggcggagccccaaaacctggtggagtacaaaagtgggcttggggggcggnatttaagaaaggccccctgggcgga

SEQ ID NO: 31458 - DNA, 723 bp, Zea mays
  misc_feature: Ceres CLONE 1407773-F
  misc_feature: Encodes the peptide sequence at SEQ ID NO. 31459
  misc_feature (141)..(141): n is a, c, t, g, unknown, or other
  misc_feature (220)..(220): n is a, c, t, g, unknown, or other
  misc_feature (388)..(388): n is a, c, t, g, unknown, or other
  misc_feature (411)..(411): n is a, c, t, g, unknown, or other
tggagctccccgcggtggcggccgctctagaactagtggatcccccgggctgcaggaattcgcacgagaccattacctagaacatcctaatcgaaaaccatccagtccgtccggttagttagttagtaagttagttgaggngagaagaagcaggggcaggggaagcgatgagcaacatgctgcgggctcgccgccgcctggacctcctgcaggtggtgcncttcgccgctgtgctcctcgtcgtcgtcgccgacgccggcgtgacgagccagtaccggcggaagctggaggcgacggtggagatgccctgggacgccgacgtcttccgcgtcccgccggggtacaatgccccgcagcaggtgcacatcacgctgggtgaccaggaggncacggcgatgatcgtgtcgtggntgacggccaatgagctgggcagcagcaccgtcatgtacagcgaggcgtcccccggacccggagaagatggagctccgggcggaagggaccccaccgcgctacgacaacttcactacccctccggtttcctccaccactgccccctcaaaaccttaaggcttagccccgggacctctccccccgggggttccgccccccgggggaggagttttggtttccccccccccccctgggcggggccctggggggcccttaaggttcggccctttgggcgacctggcccaaaatttgacctcaaacagaacgtgttcc

SEQ ID NO: 31459 - protein, 185 aa, Zea mays
  misc_feature: Ceres CLONE 1407773-F
  misc_feature: SWISSPROT Homolog: EC 3.1.3.2 Acid phosphatase
  misc_feature (18)..(18): Xaa is any aa, unknown, or other
  misc_feature (74)..(74): Xaa is any aa, unknown, or other
  misc_feature (82)..(82): Xaa is any aa, unknown, or other
MSNMLRARRRLDLLQVVXFAAVLLVVVADAGVTSQYRRKLEATVEMPWDADVFRVPPGYNAPQQVHITLGDQEXTAMIVSWXTANELGSSTVMYSEASPGPGEDGAPGGRDPTALRQLHYPSGFLHHCPLKTLRLSPGTSPPGGSAPRGRSFGFPPPPWAGPWGALKVRPFGRPGPKFDLKQNVF

SEQ ID NO: 31460 - DNA, 773 bp, Zea mays
  misc_feature: Ceres CLONE 1407774-F
  misc_feature: Translation starting site: 231
  misc_feature (115)..(115): n is a, c, t, g, unknown, or other
  misc_feature (292)..(292): n is a, c, t, g, unknown, or other
  misc_feature (372)..(372): n is a, c, t, g, unknown, or other
  misc_feature (420)..(420): n is a, c, t, g, unknown, or other
  misc_feature (630)..(630): n is a, c, t, g, unknown, or other
  misc_feature (669)..(669): n is a, c, t, g, unknown, or other
  misc_feature (734)..(734): n is a, c, t, g, unknown, or other
  misc_feature (735)..(735): n is a, c, t, g, unknown, or other
aaagctggagctccccgcggtggcggccgctctagaactagtggatcccccgggctgcaggaattcgcacgagaccattacctagaacatcctaatcgaaaagcggctactgttntctgtttcttccttcgaccccggtcgtcccgtcctccgctgggcatcgaaagtcgaacgcctcccccctccctccctcccagttccgtcgtcggctcctgcagcagcagcaagcaatggcggcttcctggagagccgtggcgctggcggtggccgcagtgggctggcttcttgccgntgccgcgcgggcgttcccggacgaggactgggtcgcgcggctgccggagcagcctccgtcacgttcaggcagtcgccggntacgtggacgtcgaccgcaaggccggaggagcctctctactacttcgncgaagggggggagggacgcgcccgccagcgcttaggctgggtttgaaagaggccctggttgtctccggggggaagggggggtttcaccgagttagggcattttttcgggaggggaaggcgcgcccccttaaacaaaaaaaaagtttggggaaaagggcgtccctttttgggttggggaaaacccgggggggagtgggaggggttttattnaaaactttttcgggaatacaaaaattgggaaaagggggncctctcttaaaaataaagacattttttggggagggggggaggaaaaaaatcctcggaaaaaaaannagggttttttttctcctacggagaaggaatacccccca

SEQ ID NO: 31461 - DNA, 732 bp, Zea mays
  misc_feature: Ceres CLONE 1407775-F
  misc_feature: Translation starting site: 247
  misc_feature (306)..(306): n is a, c, t, g, unknown, or other
  misc_feature (374)..(374): n is a, c, t, g, unknown, or other
  misc_feature (434)..(434): n is a, c, t, g, unknown, or other
  misc_feature (508)..(508): n is a, c, t, g, unknown, or other
  misc_feature (536)..(536): n is a, c, t, g, unknown, or other
  misc_feature (551)..(551): n is a, c, t, g, unknown, or other
  misc_feature (553)..(553): n is a, c, t, g, unknown, or other
  misc_feature (571)..(571): n is a, c, t, g, unknown, or other
  misc_feature (572)..(572): n is a, c, t, g, unknown, or other
  misc_feature (575)..(575): n is a, c, t, g, unknown, or other
  misc_feature (598)..(598): n is a, c, t, g, unknown, or other
  misc_feature (601)..(601): n is a, c, t, g, unknown, or other
  misc_feature (602)..(602): n is a, c, t, g, unknown, or other
  misc_feature (604)..(604): n is a, c, t, g, unknown, or other
  misc_feature (608)..(608): n is a, c, t, g, unknown, or other
  misc_feature (620)..(620): n is a, c, t, g, unknown, or other
  misc_feature (629)..(629): n is a, c, t, g, unknown, or other
  misc_feature (631)..(631): n is a, c, t, g, unknown, or other
  misc_feature (650)..(650): n is a, c, t, g, unknown, or other
  misc_feature (652)..(652): n is a, c, t, g, unknown, or other
  misc_feature (656)..(656): n is a, c, t, g, unknown, or other
  misc_feature (659)..(659): n is a, c, t, g, unknown, or other
  misc_feature (661)..(661): n is a, c, t, g, unknown, or other
  misc_feature (674)..(674): n is a, c, t, g, unknown, or other
  misc_feature (676)..(676): n is a, c, t, g, unknown, or other
  misc_feature (687)..(687): n is a, c, t, g, unknown, or other
  misc_feature (692)..(692): n is a, c, t, g, unknown, or other
  misc_feature (694)..(694): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (700)..(700): n is a, c, t, g, unknown, or other
  misc_feature (703)..(703): n is a, c, t, g, unknown, or other
  misc_feature (709)..(709): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
aaagctggagctccccgcggtggcggccgctctagaactagtggatcccccgggctgcaggaattcgcacgagaccattacctagaacatcctaatcgaaaaagctaggttcctatgcccaaagtcacacagcttcttctccttctacttctccttcctcctctcctcaccggcaccttgatctaatctcttccatcctagcttgctcgccgctgccagtctctcctccgcctgcaacgactgcccatgtctcagtcttctcctctcttctccgtcgccgagacggcacggcggaaagcaggaggncgagccgtggcagccgctctcctgctccgtcgtcgccccattgcacagctgccgcacagcatcctggncctacggtgtctctctccagccagagcgacaccttccaagacgctcctcagcctccccgncgccacgctgtcctccttcgccgaccccgacggcgacggcggctccagcgcgaaagcaagcgacggcggcgccnaggccggcgccggcggggaggagcaggncggggaatgcgagangncggagaaggccagggcgnnccncaccccgccacggggggcgacgnccnncnccgngacgaacggcgncgccgcccncnccgggccgcgggggaagcncncgcnggncngccccggaacccncnggaagaaagcncgggngnannncngcnccgggnggggnnnnnnnggggggggaaaa

SEQ ID NO: 31462 - DNA, 742 bp, Zea mays
  misc_feature: Ceres CLONE 1407776-F
  misc_feature: Encodes the peptide sequence at SEQ ID NO. 31463
  misc_feature (472)..(472): n is a, c, t, g, unknown, or other
  misc_feature (742)..(742): n is a, c, t, g, unknown, or other
aaagctggagctccccgcggtggcggccgctctagaactagtggatcccccgggctgcaggaattcgcacgagaccattacctagaacatcctaatcgaaaaatccgatttcgattcgatttgccggcggtgcccgcggcggataggatggcgagatccttctccttcccgctgatgaatccggcggacattgcggaggcgctgcacagctactgcatcgcgcccagccccggcctccgagccgagcacatcggcaccccgcagcccggcctcgtcgccgaggtcctcgccctcttcctcgccaacttcgtcggcgacgacgagcccgacgagcagctagagtttcaggcgctgcaggcgatcgacaacccggagcaccacatgcgcgccatagcgctctcgcgcctctaccggagggccaacgccttcctccactccatcctcttccgggacctcacgctccgcgaccttnctccgcgccgacggccgccgtgtcgtctacatcctcagcgccataatcaacttcctccactacaggcaggataagctcagctttcttgagcccatcgtccaagagtacgccccccttcaggaacggcacacggagctcaggggctaagatcgccgagcttcggaacgcaaaagaagacatctacttaaggagcagatggagggcgcccgtggtcagcaacttccaagaaagagggtcatgccctcaagcagaggcttcgtgaatacacan

SEQ ID NO: 31463 - protein, 132 aa, Zea mays
  misc_feature: Ceres CLONE 1407776-F
  misc_feature (109)..(109): Xaa is any aa, unknown, or other
MARSFSFPLMNPADIAEALHSYCIAPSPGLRAEHIGTPQPGLVAEVLALFLANFVGDDEPDEQLEFQALQAIDNPEHHMRAIALSRLYRRANAFLHSILFRDLTLRDLXPRRRPPCRLHPQRHNQLPPLQAG

SEQ ID NO: 31464 - DNA, 766 bp, Zea mays
  misc_feature: Ceres CLONE 1407777-F
  misc_feature: Encodes the peptide sequence at SEQ ID NO. 31465
  misc_feature (243)..(243): n is a, c, t, g, unknown, or other
  misc_feature (504)..(504): n is a, c, t, g, unknown, or other
  misc_feature (616)..(616): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (645)..(645): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (683)..(683): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (703)..(703): n is a, c, t, g, unknown, or other
  misc_feature (704)..(704): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
caaagctgggagcttcaccgcggtggcggccgctctagaacttagtgggatcccccgggctgcaggaattcgcacgagaaccattaacctaagaacatcctaatcgaaaaaagtaagcccttccctgttccattcgaacccagcagagcagccagccgaacaacgaagcatgccgtcgaagccgaacgccgcgtcgcgcctcgtcttcctcgctttcctcctcgtcatcagcgccgccgcggncaacgatgacgccgcggcgcggcgacggatggagcagttcgccggcttccccgcctccgacgacggcgagggcccttccagcgacttccacgtcgactccgagggcctccagcgtcagatcgatgaactggcctcgttctccgactcgcccgcgccgtccgtgacccgcgttctgtacaccgacaaggatgtgcaggctcgaaggtatataaaagggataatgaatcaacttggccttgttgttcgagaagatgctgttgntaacatatttggccgctggaagggttccgatcctggactaggagcagttgcaactggatctcatgttgatgccattccattctcaagcaaatttgattggtgttggtgaaantctgnnngctcttgaannnnataatttgnttaaaannnctgctttccctgccaaaaagaacttttgnaggnnnttatgtttaccctnnaaagnnnnnaannnnnnnnnnnnnnnnnnnnnnngnnnnnnnnnttttattnnnnnnnnntc

SEQ ID NO: 31465 - protein, 147 aa, Zea mays
  misc_feature: Ceres CLONE 1407777-F
  misc_feature: SWISSPROT Homolog: EC 3.5.1.87 N-carbamoyl-L-amino-acid hydrolase
  misc_feature (25)..(25): Xaa is any aa, unknown, or other
  misc_feature (112)..(112): Xaa is any aa, unknown, or other
MPSKPNAASRLVFLAFLLVISAAAXNDDAAARRRMEQFAGFPASDDGEGPSSDFHVDSEGLQRQIDELASFSDSPAPSVTRVLYTDKDVQARRYIKGIMNQLGLVVREDAVXNIFGRWKGSDPGLGAVATGSHVDAIPFSSKFDWCW

SEQ ID NO: 31466 - DNA, 741 bp, Zea mays
  misc_feature: Ceres CLONE 1407782-F
  misc_feature: Encodes the peptide sequence at SEQ ID NO. 31467
  misc_feature (688)..(688): n is a, c, t, g, unknown, or other
  misc_feature (733)..(733): n is a, c, t, g, unknown, or other
  misc_feature (741)..(741): n is a, c, t, g, unknown, or other
tggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgacctccgggagaagtacgggcccatcttcaccatgcggatggggcagcgcaccctcatcgtggtcacctcggcggagctcatccacgaggcgctggtgaagcaaggccccatgttcgcgagcccgcccgaggacagccccacccgcctcctcttcagggtcgacaagtgcaccgtcaactcggcgccctacggccccctggggggtgctctgcgcccgcaccttcgtcgccaagatggttccccgaaccgcgacgggggcttctcccggaatctcgaagccnccccgcgtacacccctcgtcgcggcctctggtaggatctttttgntgtctgtn

SEQ ID NO: 31467 - protein, 172 aa, Zea mays
  misc_feature: Ceres CLONE 1407782-F
  misc_feature: SWISSPROT Homolog: EC 1.14.99.9 Steroid 17-alpha-monooxygenase
  misc_feature (155)..(155): Xaa is any aa, unknown, or other
  misc_feature (170)..(170): Xaa is any aa, unknown, or other
MDVNDVLLVVLAAALAAMWWRRCSKTGGVDGLPPGPPGWPVVGNLFQVILQRRPFMYVVRDLREKYGPIFTMRMGQRTLIVVTSAELIHEALVKQGPMFASPPEDSPTRLLFRVDKCTVNSAPYGPLGGALRPHLRRQDGSPNRDGGFSRNLEAXPRTPLVAASGRIFLXSV

SEQ ID NO: 31468 - DNA, 729 bp, Zea mays
  misc_feature: Ceres CLONE 1407783-F
  misc_feature: Translation starting site: 386
  misc_feature (1)..(1): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (512)..(512): n is a, c, t, g, unknown, or other
  misc_feature (527)..(527): n is a, c, t, g, unknown, or other
  misc_feature (558)..(558): n is a, c, t, g, unknown, or other
ntggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagcacccgcaccgagtgccaatggcgactgcagcgagttcgaacgccggcggcgcggcagcctactctgggtctgcgcgcactgaacccgcgcgggtggccccgggagaggcannngcgaaggttgccgccgctgcggcgtttgggnggcccaacgtgccgnaagctccaggtcggctgcctcgacagcttcnagccatggcagggacttggcccgtgcttctcgcccagccccgctcgctccccgtcatcgtcactaacaggccggattttggaagggaggccagtacgcaggcgaagatgagccacggtttgaggcgcttctactggcaatggagctgggagtgaaatatgtcgatgtcaaa

SEQ ID NO: 31469 - DNA, 734 bp, Zea mays
  misc_feature: Ceres CLONE 1407784-F
  misc_feature: Encodes the peptide sequence at SEQ ID NO. 31470
  misc_feature (396)..(396): n is a, c, t, g, unknown, or other
  misc_feature (416)..(416): n is a, c, t, g, unknown, or other
  misc_feature (455)..(455): n is a, c, t, g, unknown, or other
  misc_feature (458)..(458): n is a, c, t, g, unknown, or other
ctggagctccccgcggtggcggccgctctagaactagtggatcccccgggctgcaggaattcgcacgagaccattacctagaacatcctaatcgaaaaacttccaccgccaccgccgagcgcggtggcaccgacacgacacacgtagctgcagacctgcagtgccagcacggctgccaatccctgctggcgctgttcccggctccgagatcatttggactcggcactcggcagggatggggatggggacggaatggccgccgacgcctgcgcacagaggaaagcggtggtgagcgccgggtcggcgctgaagctggtactgttcgtgattctcgcgggcctcgcactgcggctggctggtggggcccccagcctacctcctgccgcccaccgccgncgccagagggggccgctcgntcttttcgcggtggcggagagggaaagaaccgccggcgncgncggcggcgggataccttcgtcgaacgaatgatgcggttttacttttgacgaatcagacctctaacagcttagggaagaaaggaaggtccacaaaaacaaaaaaaaagtgggatcttttccatggggaaggggttccccaattatccaggacagctttatacaaatgcaaagtgcccgtttcatgagtttccctaaaaactgttggaaaaagggaaaacctggacacaatttttccaattgggagaggaaacccaattgggtgggaaggaaaacaca

SEQ ID NO: 31470 - protein, 167 aa, Zea mays
  misc_feature: Ceres CLONE 1407784-F
  misc_feature (132)..(132): Xaa is any aa, unknown, or other
GAPRGGGRSRTSGSPGLQEFARDHYLEHPNRKTSTATAERGGTDTTHVAADLQCQHGCQSLLALFPAPRSFGLGTRQGWGWGRNGRRRLRTEESGGERRVGAEAGTVRDSRGPRTAAGWWGPQPTSCRPPPXPEGAARSFRGGGEGKNRRRRRRRDTFVERMMRFYF

SEQ ID NO: 31471 - DNA, 742 bp, Zea mays
  misc_feature: Ceres CLONE 1407785-F
  misc_feature (707)..(707): n is a, c, t, g, unknown, or other
aaagctggagctccccgcggtggcggccgctctagaactagtggatcccccgggctgcaggaattcgcacgagaccattacctagaacatcctaatcgaaaaaggatgaagatatttcccactccaatcgaattagaaccctaccgaataaagcattcactctgcgccggcgtacgcaggtcccgtcccgccaccacatcagcccaggaactccgcgtcggggaggctgctcgaggagccgcgctgtatctcccgcgccgtcgtacctttgtgctcgccgttgccatgatttgtccgatgtccgcggaggggacaggaccatccgcgggagtcgaaaaagtcacggcttctcttagagttgcctcttcatgccagctgctacattgaggaatcatgcatagtgccccatcaacaaagatgagcttactatgaaagatatcgcgacgtgcaataccaacaaggtgcacgaacaccgtgccttggcaggctgccagcattccaggactccttggcattattcagaacgagtgtgatgctctcatgattactaattttgctttgcagcagcagctacacacagagagactacgacttagtcttgcactctagcaatgtgacgcatgcctgccgggtattagccagtgtgaacaggaaaaagagatgaggctacagcactctttggatcaagctgagagacagattccagncatcaagttgcagggagtgcttccttgcaggttgt

SEQ ID NO: 31472 - DNA, 736 bp, Zea mays
  misc_feature: Ceres CLONE 1407786-F
  misc_feature: Encodes the peptide sequence at SEQ ID NO. 31473
  misc_feature (584)..(584): n is a, c, t, g, unknown, or other
aaagctggagctccccgcggtggcggccgctctagaactagtggatcccccgggctgcaggaattcgcacgagaccattacctagaacatcctaatcgaaaacccactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggcaacagccggcccggccgccgcaggcgctccgctctacctctccctctccgcccggtggccgcgcactctgctcggattgctggtgagatgcccaagcctttgtgatcttagatgatgttgtgcaacacaccctgactaatttgcacagtattcacaaaagcttattattttggcaggccaaggctgagggaacaaattctcagaaagtgtactttatgaatttttgagagaggtccaaggggcctttgttgatgcaacatatcanacactcactagactcgggagcaatggacgccctgtccaatacattttgcattctgcatccctgatatggtgtcaacaaaactcgctgccctgacagtatgcaacactgcttggcgcttttttcttgagaggtccattctgaagtgaaaaatg

SEQ ID NO: 31473 - protein, 95 aa, Zea mays
  misc_feature: Ceres CLONE 1407786-F
MATSPPQNPSSGEPSDASSLAAAALEAPVRVWRSLVARFPPLPDSSSFLAGVSDLQLRYFGNSRPGRRRRSALPLPLRPVAAHSARIAGEMPKPL

SEQ ID NO: 31474 - DNA, 773 bp, Zea mays
  misc_feature: Ceres CLONE 1407788-F
  misc_feature: Encodes the peptide sequence at SEQ ID NO. 31475
tggagctccccgcggtggcggccgctctagaactagtggatcccccgggctgcaggaattcgcacgagaccattacctagaacatcctaatcgaaaaaaacagtgaagaaggaagccggttagggtttccacctcctttcccctcctctccttcagcgacgaccgcgggccacaccctcgatatccttcccctcggaaccggaggcgagcaggagtctccagcgtgtgccacgtctgcccgtctctgtattgggagaattcgtcatgtgtgacatggagtctgtcgcagttctcatgaactcgactagctgcaagatacagcagcttcatgaggcatttgctgagcttgagagtcagagcacgtcttccatggatctcaggtgtatacagcttgagacccctttcgggggcttgaacagcccctcaagaaaaagtttgaccaggttaaaaaagcaggaaaaggggtcccgggggactgtcgaaaaaccgaagaaaattctgggagcaggggaggagatttttttgggaaaaggaactgaccctttttggaaaattcggaggaaaaaagaaaattcctataatatggtttttaagagagggggggtttccttatggggggcaaacaccaaccccggggaaaggggggggaaaaattttgggggggggggggcaaaaacgggttcgggggagagggggccctcggagaggataaaagggggaggccccccccccttgaggggtgggggcccccggggagaaaaaagaggagagga

SEQ ID NO: 31475 - protein, 169 aa, Zea mays
  misc_feature: Ceres CLONE 1407788-F
MCDMESVAVLMNSTSCKIQQLHEAFAELESQSTSSMDLRCIQLETPFGGLNSPSRKSLTRLKKQEKGSRGTVEKPKKILGAGEEIFLGKGTDPFWKIRRKKENSYNMVFKRGGVSLWGANTNPGERGGKNFGGGGAKTGSGERGPSERIKGGGPPPLRGGGPRGEKRGE

SEQ ID NO: 31476 - DNA, 749 bp, Zea mays
  misc_feature: Ceres CLONE 1407789-F
  misc_feature: Encodes the peptide sequence at SEQ ID NO. 31477
  misc_feature (541)..(541): n is a, c, t, g, unknown, or other
  misc_feature (542)..(542): n is a, c, t, g, unknown, or other
tggagctccccgcggtggcggccgctctagaactagtggatcccccgggctgcaggaattcgcacgagaccattacctagaacatcctaatcgaaaaacttccaccgccaccgccgagcgcggtggcaccgacacgacacacgtagctgcagacctgcagtgccagcacggctgccaatccctgctggcgctgttcccggctccgagatcatttggactcggcactcggcagggatggggatggggacggaatggccgccgacgcctgcgcagcagaggaaagcggtggtgagcgccgggtcggcgctgaagctggtactgttcgtgattctcgcgggcctcgcactgcggctggctggtggggcccccagcctacctcctgccgcccaccgccgcgccagagggggccgctctgtcttttcgcggtgccgggagagggaaagaaccgccggcggcgggcggcggcgggataccttccgtcgaacgggaatggattgcggtttttactttgaccgattcagaacctctaacagctttaggnnaagaaaggaaggttccacaaaccagaaggaaaagttgtgatctttccatggggcggagtggggttcccaattcatcaggaccagcttatactaatgcaagctgccgctttcattgagtctcctcagaactgtatgaacaaatggaagacctgacacagattatctcaattgggagatgaagccccataaggggtgtggagtatcaac

SEQ ID NO: 31477 - protein, 115 aa, Zea mays
  misc_feature: Ceres CLONE 1407789-F
  misc_feature (103)..(103): Xaa is any aa, unknown, or other
MGMGTEWPPTPAQQRKAVVSAGSALKLVLFVILAGLALRLAGGAPSLPPAAHRRARGGRSVFSRCRERERTAGGGRRRDTFRRTGMDCGFYFDRFRTSNSFRXRKEGSTNQKEKL

SEQ ID NO: 31478 - DNA, 732 bp, Zea mays
  misc_feature: Ceres CLONE 1407792-F
  misc_feature: Translation starting site: 270
  misc_feature (422)..(422): n is a, c, t, g, unknown, or other
  misc_feature (489)..(489): n is a, c, t, g, unknown, or other
  misc_feature (512)..(512): n is a, c, t, g, unknown, or other
  misc_feature (568)..(568): n is a, c, t, g, unknown, or other
  misc_feature (569)..(569): n is a, c, t, g, unknown, or other
  misc_feature (703)..(703): n is a, c, t, g, unknown, or other
aaagctggagctccccgcggtggcggccgctctagaactagtggatcccccgggctgcaggaattcgcacgagaccattacctagaacatcctaatcaaaaatcgctctctcctttgcacccctagctagctagtactactgctgctcctccgacttgctcttcgcgcagcaggacggagaaacaagaaccatccctccccctaccggctaccgctgctactcatgggcgcgcgcactgcctcctggtgccgccgcgtatgatccagacatgaatagggcgcacagcagcagctccaagctcatcaacgagaagctcgtggaacaccggatctccactgcgaagcactgcccccactgcggcgagaaaatcgacagcaaaccggattgggtggggctgccggcaggcgtcaagttcgatccnactgaccaggagctgacgagcacctcgaggcgaaagggaaggatgaaagctcgagatctcccctctncatcgacgagttctaccacatangatggggggaggacggcatatgttacacccaccccgagaaacttccaggtgggacnnagggatggcctaagcaagcacttcctccaccggccgtccaagccctacacgacgggcaccgaggaaagaggaggaagatacagacgggagtgcgacgtccacaaggggggaagacgaggtggcacaagacggcnaagaccggggcccggggatgggtgacggc

SEQ ID NO: 31479 - DNA, 728 bp, Zea mays
  misc_feature: Ceres CLONE 1407793-F
  misc_feature (401)..(401): n is a, c, t, g, unknown, or other
aagctggagctccccgcggtggcggccgctctagaactagtggatcccccgggctgcaggaattcgcacgagaccattacctagaacatcctaatcgaaaacactcgccgcggctaacccagctcccagcccccgtctcgtcgccatgggaaccaggaatcttacgcggaaccgcgccgcttccatggcgacggcatccacttacgctgctcctctcccttgccttcctcgccttcgccttggcggcgtcaccagtcgccggatgcgtaggcgatctcccggtaccaggagtacctccgcatcgacgcggcgcatccgtcgtcagattacgccgtgtacgatgtctgtctgcgcaacaggccgtcgagactggactctagtgagcacgctgagttcgccgncaggtagtcctgtgttgatgcaactgtttcggtcgtcacaagaatgtcccgtacgatactgcactcaaccttgaattggcggcaagaaaccataacgggacaaccccagcggtttcggccggcctcgtgggccctccgggtgcacaacgaggggggctccaggactggaaggggggggggggggataattttggaccatcccccaaatcaggcctggggttttggggcgggactaagaattttaaggaaatttgttccccaaaattgaaaaagggggatccacccggggtcccccgggttcccctctcgtagcaaaagaatgggggt

SEQ ID NO: 31480 - DNA, 775 bp, Zea mays
  misc_feature: Ceres CLONE 1407794-F
  misc_feature: Encodes the peptide sequence at SEQ ID NO. 31481
  misc_feature (387)..(387): n is a, c, t, g, unknown, or other
  misc_feature (573)..(573): n is a, c, t, g, unknown, or other
  misc_feature (627)..(627): n is a, c, t, g, unknown, or other
  misc_feature (706)..(706): n is a, c, t, g, unknown, or other
  misc_feature (708)..(708): n is a, c, t, g, unknown, or other
  misc_feature (709)..(709): n is a, c, t, g, unknown, or other
caaagctggagttccccgcggtggcggccgcttctagaacttgtggatcccccgggcttgcaggaattcgcacgagacctttacctagaacatcctaaatcgaaaaacctaaatatcgatttccgccagcggttttcctcattttttttttctctccctctcttgcccggcgatcggtcgggatcgattcgaagcagatggcggcggcatgggcagtgcttggcggcggtgctcgtcgcagcgcaggtggcgtctgctgcgccggtcacggcgccagcgttcctctgggcgcccaagaactacggattcctctctgatgatgctaaggaggtagtcgattatcaaacaatctcaccaaagaacttagctaaatctgttctttgaggnaaggtggctgcgtcaacctttatgtgcttcaagggaggatactgagagcccatgttgatgttgccatttgtttttattggctcaaagctacaatcatcagacatatcgaaagataagcacgttgatccagctttagcagatacattgaagctctccttcacaaaatcagagttttccatggcattncccctatgtttccacatcatacgatgagaaaactagaggagtcattgctataangcttcgctagaactggggaaaagtggtttttggaagaaaccgtatcgcctacacagacacgtggcgccgtgagtggccnannatctgaagacgtttcccaacatggatgctatcaattggacttggtaagtgtcaggaagaaccaacc

SEQ ID NO: 31481 - protein, 127 aa, Zea mays
  misc_feature: Ceres CLONE 1407794-F
QSWSSPRWRPLLELVDPPGLQEFARDLYLEHPKSKNLNIDFRQRFSSFFFSLPLLPGDRSGSIRSRWRRHGQCLAAVLVAAQVASAAPVTAPAFLWAPKNYGFLSDDAKEVVDYQTISPKNLAKSVL

SEQ ID NO: 31482 - DNA, 758 bp, Zea mays
  misc_feature: Ceres CLONE 1407796-F
  misc_feature: Encodes the peptide sequence at SEQ ID NO. 31483
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (598)..(598): n is a, c, t, g, unknown, or other
  misc_feature (676)..(676): n is a, c, t, g, unknown, or other
tggagctccccgcggtggcggccgctctagaactagtggatcccccgggctgcaggaattcgcacgagaccattacctagaacatcctaatcgaaaagctcaagtcaattcataaactcacaatggcggctacggcataccccactgtggtgctcatcccactatgcgtcccaggccacctcgcgtccatgatcgaagccggcaagcggctgctcggcagaagccgctgccccatgtccctcaccgtgctcatcacgcagatgaccatgtccgccaacctgatgtccgacgtcgacgacatcatgcgacgggaagccgactccggcctggacatccgcttcgtccacctccccgccgtggagctccccaccgtccaccacggcctcgaggacttcatgatgcgcttcatacagctccacgcgacgcacgtcaaggaggccgtctccggcatgtcgtcccgggtcgccgctggtcgtggtggactacttctgcaccaccctattcgacgtcgcgcgcgaagctcgcgctgccggcgtacgcctacatgccgtccgnnngcgtcgatggtcgcgctcatgctgcggttaccggcgctggnaccggggaaggtgtcccggggacttcgaggcgatggaagggaacggtcgatctaccaggggatgcccgccggtgccgnctcgtctcatgccgtctccgcttgatgaagaaggacccgaacttccccgtggctggtggaccatggcaaccgctttatggaa

SEQ ID NO: 31483 - protein, 192 aa, Zea mays
  misc_feature: Ceres CLONE 1407796-F
  misc_feature (145)..(145): Xaa is any aa, unknown, or other
  misc_feature (159)..(159): Xaa is any aa, unknown, or other
  misc_feature (185)..(185): Xaa is any aa, unknown, or other
MAATAYPTVVLIPLCVPGHLASMIEAGKRLLGRSRCPMSLTVLITQMTMSANLMSDVDDIMRREADSGLDIRFVHLPAVELPTVHHGLEDFMMRFIQLHATHVKEAVSGMSSRVAAGRGGLLLHHPIRRRARSSRCRRTPTCRPXASMVALMLRLPALXPGKVSRGLRGDGRERSIYQGMPAGAXSSHAVSA

SEQ ID NO: 31484 - DNA, 762 bp, Zea mays
  misc_feature: Ceres CLONE 1407797-F
  misc_feature: Encodes the peptide sequence at SEQ ID NO. 31485
  misc_feature (442)..(442): n is a, c, t, g, unknown, or other
  misc_feature (476)..(476): n is a, c, t, g, unknown, or other
  misc_feature (477)..(477): n is a, c, t, g, unknown, or other
  misc_feature (573)..(573): n is a, c, t, g, unknown, or other
  misc_feature (618)..(618): n is a, c, t, g, unknown, or other
  misc_feature (650)..(650): n is a, c, t, g, unknown, or other
  misc_feature (670)..(670): n is a, c, t, g, unknown, or other
  misc_feature (671)..(671): n is a, c, t, g, unknown, or other
tggagctccccgcggtggcggccgctctagaactagtggatcccccgggctgcaggaattcgcacgagaccattacctagaacatcctaatcgaaaaagatttggatgtggactagatgcttaaggtgtgaacgtgaaagtggggtccccagatcatcacgaagggtgataatgtcagctgaagcacactacctttcatttgggaagttccttgaacttagtttttcaagccactcaaccgctagaaggctgccaatatgcgggcattcactcaatacggattgtctgcgctttttttgggttgggctccaaagttgcaatgttccagtattcctcagtcgaaatttacaatgcctgcaaaccacagcctactcttgagattcacaaccccgatatgcacaaagatgccccaaggttgcttgccctcgtgtttcgtgctctngattgttgagtcttcaatgagagctgattccagnntatatagaggtgaacaagcttttgattatttcttttggttaatttggtgcaaacatatagagggtgaacaagcttatttacaggaagatccttganccaatcaaagagttcatacaatagatgaaaccgatattgtgattnctctcaatgggtggcttcatggagcaagcaantcattcaccttggtcactannaatttcagactgaagctccagataaggctttgagcaatccccctgggaaagattaatatttccctttgtcgccacaaactttaagtagtta

SEQ ID NO: 31485 - protein, 90 aa, Zea mays; identical to SEQ ID NO: 11994
  misc_feature: Ceres CLONE 1407797-F

SEQ ID NO: 31486 - DNA, 743 bp, Zea mays
  misc_feature: Ceres CLONE 1407798-F
  misc_feature: Translation starting site: 223
  misc_feature (415)..(415): n is a, c, t, g, unknown, or other
  misc_feature (479)..(479): n is a, c, t, g, unknown, or other
tggagctccccgcggtggcggccgctctagaactagtggatcccccgggctgcaggaattcgcacgagaccattacctagaacatcctaatcgaaaactcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtgggtggcgtcggtgctccaagaccgggtgtcgacggcctcccgcggggccctccgggttggcccggtggtggggaacctggttccaggtgatcctgcagcgactgcccttcaatgtacgtggtgcgcgaccttccggnagaagtacgggcccatcttcaccatggcggatggggcagcgcacccctcatcgtggtcacctcnggcggagctcatccacgaggcgctgggtgaagcagggccccatgttcgcgagccggcccgaggacagccccacccgcctcctcttcagcgtcggcaagtgcaccgtcaactcggcgcctacggccccccctgtggcgtgctctgcgccacacttcgtcggccgagatcgtgtccccgcaccgcgtcagggctctctggaataccgggaggtggcccggggacgcgcacttgcgccgcctccggccgaactcgcgggggaggggg

SEQ ID NO: 31487 - DNA, 762 bp, Zea mays
  misc_feature: Ceres CLONE 1407803-F
  misc_feature: Encodes the peptide sequence at SEQ ID NO. 31488
  misc_feature (590)..(590): n is a, c, t, g, unknown, or other
  misc_feature (591)..(591): n is a, c, t, g, unknown, or other
  misc_feature (597)..(597): n is a, c, t, g, unknown, or other
  misc_feature (647)..(647): n is a, c, t, g, unknown, or other
  misc_feature (651)..(651): n is a, c, t, g, unknown, or other
  misc_feature (652)..(652): n is a, c, t, g, unknown, or other
  misc_feature (704)..(704): n is a, c, t, g, unknown, or other
  misc_feature (710)..(710): n is a, c, t, g, unknown, or other
aaagctggagctccccgcggtggcggccgctctagaactagtggatcccccgggctgcaggaattcgcacgagaccattacctagaacatcctaatcgaaaaatcacacactaatcaacaagcaggaccagctagctagctcctctcactgctatcacccgcccagccatctcgctgaaagagaaaagcgcagccatgaagactactagctcgggcattgcagtcgtcctactggtggccatgctggcagtccattccgcgttggccgacatctcgtgctccgacgtgctcaacgacctgtcgccgtgcctgcccttcctgcagggcaaggcagccaaacccagcgagagcaacaaccagtgctgcgacggcgtgagggccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttcccttaccagaacctacgacggnnaatggnggatgttcagtgccctgctagcagtaggctgcatctgcactgagggatanaatnnaagattttggggggatgttgtgctggaattagtgtggtcgcctgtacctgtnggaagngccctcgttgctttcccttatatcccgtgtctaatctcgcaaaaaaaaaaaa

SEQ ID NO: 31488 - protein, 119 aa, Zea mays; identical to SEQ ID NO: 566
  misc_feature: Ceres CLONE 1407803-F
  misc_feature (28)..(115): Pfam Name: Tryp_alpha_amyl Pfam Description: Protease inhibitor/seed storage/LTP family

SEQ ID NO: 31489 - DNA, 754 bp, Zea mays
  misc_feature: Ceres CLONE 1407804-F
  misc_feature: Encodes the peptide sequence at SEQ ID NO. 31490
  misc_feature (1)..(1): n is a, c, t, g, unknown, or other
  misc_feature (344)..(344): n is a, c, t, g, unknown, or other
  misc_feature (421)..(421): n is a, c, t, g, unknown, or other
  misc_feature (484)..(484): n is a, c, t, g, unknown, or other
naaagctggagctccccgcggtggcggccgctctagaactagtggatcccccgggctgcaggaattcgcacgagaccattacctagaacatcctaatcgaaaagcaaggatggttttcagcaactagtttctgaacagcgtgtccgctgtctggtctgtcaaaataatcttggtaaccagtgccaaaatgattgctgggggaggctattttgatggttctcatgaccatattctcatggaaggatcaatgatccatgattcttcacaatcttccatctatgacaatacagatgttgaacagcagaacttcagatttgcgccctttatcatagaagatcactccnatccagccaaccttacctctgaggctgcaagggtgatagaccaaattcacacaggctggggattgacatcgagcagnaccatagtgatcactgaatggcagaagttcctccagagaactggaaaattggggtctgctggnctatgggggttcagaacattatcctagccaccagaatgaaagccgcataaattaattggggaaacaaccgggctggggtatgaccctgcattattcgaaagggccttatggcggggcaaggacctttaaaaccccaaaaccccaaggggggggttggatcccggaattttctccaaaaattattctttttgggtcccccaaaaatggggccaaagggtgaaataaaaaaggttctccggaggaaaattttagaggggggggaggggtccc

SEQ ID NO: 31490 - protein, 107 aa, Zea mays
  misc_feature: Ceres CLONE 1407804-F
  misc_feature (53)..(53): Xaa is any aa, unknown, or other
  misc_feature (78)..(78): Xaa is any aa, unknown, or other
MIAGGGYFDGSHDHILMEGSMIHDSSQSSIYDNTDVEQQNFRFAPFIIEDHSXPANLTSEAARVIDQIHTGWGLTSSXTIVITEWQKFLQRTGKLGSAGLWGFRTLS

SEQ ID NO: 31491 - DNA, 780 bp, Zea mays
  misc_feature: Ceres CLONE 1407805-F
  misc_feature: Encodes the peptide sequence at SEQ ID NO. 31492
  misc_feature (129)..(129): n is a, c, t, g, unknown, or other
  misc_feature (133)..(133): n is a, c, t, g, unknown, or other
  misc_feature (358)..(358): n is a, c, t, g, unknown, or other
  misc_feature (363)..(363): n is a, c, t, g, unknown, or other
  misc_feature (373)..(373): n is a, c, t, g, unknown, or other
  misc_feature (418)..(418): n is a, c, t, g, unknown, or other
  misc_feature (435)..(435): n is a, c, t, g, unknown, or other
  misc_feature (437)..(437): n is a, c, t, g, unknown, or other
  misc_feature (445)..(445): n is a, c, t, g, unknown, or other
  misc_feature (447)..(447): n is a, c, t, g, unknown, or other
  misc_feature (491)..(491): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (506)..(506): n is a, c, t, g, unknown, or other
  misc_feature (508)..(508): n is a, c, t, g, unknown, or other
  misc_feature (511)..(511): n is a, c, t, g, unknown, or other
  misc_feature (519)..(519): n is a, c, t, g, unknown, or other
  misc_feature (524)..(524): n is a, c, t, g, unknown, or other
  misc_feature (530)..(530): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (584)..(584): n is a, c, t, g, unknown, or other
  misc_feature (585)..(585): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (597)..(597): n is a, c, t, g, unknown, or other
  misc_feature (604)..(604): n is a, c, t, g, unknown, or other
  misc_feature (605)..(605): n is a, c, t, g, unknown, or other
tggagctcaccgcggtggcggccgctctagaactagtggatcccccgggctgcaggaattcgcacgagaccattacctagaacatcctagtcgaaaatccaacctggttccgatccgccccgagccgtntgancatggtaatcagggatggccgctcggccctccacctccacgctctcgctttcctcatcctcgccgcctccccctgcctccaagtccaagctctagtggaccatcgcaaacaggtatctgaactgggtaggcaacccaactttgaactgcagaatatgtcctcgagtcaaagggatggctctcatctcttgggcagatcaaagaaaataccacacaggacactaanggggnggaatttgtnggtaaggaacaaaataggaagaagggcgagcaggtttatgaaagnattacccaaacttggcncnacaaaggnantgggacggtcaagattgttggattcccccaggccctggcacacnattnnnnnatgaganancgnggaaatgnaaaangaaagntttcccctcacccccccccccctccggcnnnnnaaaacccctgctccctgcgcnnaaaaaannnttncgggacnnaaaaaaaaaaaaaaacctccctctctttgtttataaaaaaaaaaaacaaaaattctgggtgggggggggggaaaaaaaaaaccccaacaccaccccccccccccccccttttttttttttttttgttgtggggggggggggggggggggggggggcccccccccccacccctccc

SEQ ID NO: 31492 - protein, 120 aa, Zea mays
  misc_feature: Ceres CLONE 1407805-F
  misc_feature (75)..(75): Xaa is any aa, unknown, or other
  misc_feature (77)..(77): Xaa is any aa, unknown, or other
  misc_feature (80)..(80): Xaa is any aa, unknown, or other
  misc_feature (95)..(95): Xaa is any aa, unknown, or other
  misc_feature (101)..(101): Xaa is any aa, unknown, or other
  misc_feature (104)..(104): Xaa is any aa, unknown, or other
  misc_feature (105)..(105): Xaa is any aa, unknown, or other
MVIRDGRSALHLHALAFLILAASPCLQVQALVDHRKQVSELGRQPNFELQNMSSSQRDGSHLLGRSKKIPHRTLXGXNLXVRNKIGRRASRFMKXLPKLGXTKXXGRSRLLDSPRPWHTI

SEQ ID NO: 31493 - DNA, 725 bp, Zea mays
  misc_feature: Ceres CLONE 1407806-F
  misc_feature (363)..(363): n is a, c, t, g, unknown, or other
  misc_feature (396)..(396): n is a, c, t, g, unknown, or other
  misc_feature (402)..(402): n is a, c, t, g, unknown, or other
  misc_feature (403)..(403): n is a, c, t, g, unknown, or other
caaagctggagctccccgcggtggcggccgctctagaactagtggatcccccgggctgcaggaattcgcacgagaccattacctagaacatcctaatcgaaaagcattctccaatatccacctcctcctcgcccccctctctctctctaaaagaactgaaaagataagggggaaatcctcaagtgctcgttacataaaccctaacctcgttggattcgcagcataagcccaccaattggaagccctccgatgttccagctgcatgctggagctgagccgtgctcggattgacgaaattttgcatcccttctgtgcttggaccacccgattgaggctgtttctccgagggggcgtgccagcggnttcgcgggccaggtccctcactgtgctatccgncgccgnnatcaggattgtcacgtgagaggtcggcttttggtgggggctggacagcttggagctcattttgcggtctgagtttgaagctcgatgccggggtggtggatgagggaaacccggtcaatttggaaagggttttctggcatttgggggggaccaacctttcctggaaatcttgggggggggggtcgccttgggggaggagaaaaaaggggggccccttgtggccgggcgggggttccccagggtgggatccccggccaacaaggggggggggggggaaccaattggacggggccggcgggacccccccgcccgtggtgaaacga

SEQ ID NO: 31494 - DNA, 752 bp, Zea mays
  misc_feature: Ceres CLONE 1407813-F
  misc_feature (292)..(292): n is a, c, t, g, unknown, or other
  misc_feature (293)..(293): n is a, c, t, g, unknown, or other
  misc_feature (556)..(556): n is a, c, t, g, unknown, or other
aaagctggagctccccgcggtggcggccgcttctagaactagtggatcccccgggctgcaggaattcgcacgagaccattacctaaaacatcctaatcgaaaagttttcttcacccgtccacctcgtcttgcgctcctctgtctcggcgacgactgtgctaccgccgccgccgccgcaagacttcgtcgggcactttgccggcgacgatttcccaccagcccaacaggatcagaggaggtgatggcgaggagtgacagctgcctggcgcgcgtgggtgccggaattgtatcnngtgggcgcggtcggcgtgagccgtcggtaaccttcgtccctaaacccctaaacactaggcttgcagcatcaatccgtccgtgcgaccgttcacccagtcggtgattttttttgttggctggaagtaagattagtgtgcgatttcaggaatcttctcgagctagctagtgctacatccctcggtttgtgtggatagctagcggcagatgtaataactaggtggcttttgttaagagttactagtgcttaggtagcatcatctgncaggtggaagatatcgatgctcgaagttgcagtatgcttgcccccgattgcttgtgctctcacgactgattgctgatgcgcgctggacgtgatgagttgaccttcctgctgattgttactacttgtcatggaaacagtactgtcttgaatcatgcttccatccgacagatggatagtgttgcaatgcctactttct

SEQ ID NO: 31495 - DNA, 744 bp, Zea mays
  misc_feature: Ceres CLONE 1407815-F
  misc_feature: Encodes the peptide sequence at SEQ ID NO. 31496
  misc_feature (366)..(366): n is a, c, t, g, unknown, or other
  misc_feature (367)..(367): n is a, c, t, g, unknown, or other
aagctggagctccccgcggtggcggccgctctagaacaagtggatcccccgggctgcaggaattcgcacgagaccattacctaagaacatcctaatcgaaaaaacctttttcgcagctccaggctccagcgcacagccgccgccgtttcttcatcttcttcgcagagccggcgctccatcttcggctccctcccttacttgcgctcggcacgcaggcggcggcgtgcggcgctgctggctcgggatctcagtgacggcatcagcggattcccctcccgcctctcgccagtcgcctccggtcctccgcacacccgggccggtgatctctctcctcccgccatccggtggatcgtcaacgagccgggnnccccggcggctgcgtcgcgcgtgtactgagggcagctgaaggcgctgctccaccaaggtggccgcgccgctttttgggagcggattatggcctcaaagtgaagcgagctcttagtgccagtctatggaatatgggttactgctgttaaatgtttcatgcttctacattcagcaattgttaggtatgatcgacaatcagattttgcaatccagagccggacgctgtgacagcactatgcagtatcagactctcacgctgatcgtcttgacatacccctgacagcgcgtctagctgctgctgcaaatctcatatcgccctttgtgactcactcagatagcctcctacgtattgagcttgatgccatacaacaaggggag

SEQ ID NO: 31496 - protein, 51 aa, Zea mays
  misc_feature: Ceres CLONE 1407815-F
MEYGLLLLNVSCFYIQQLLGMIDNQILQSRAGRCDSTMQYQTLTLIVLTYP

SEQ ID NO: 31497 - DNA, 751 bp, Zea mays
  misc_feature: Ceres CLONE 1407817-F
  misc_feature: Translation starting site: 467
  misc_feature (243)..(243): n is a, c, t, g, unknown, or other
  misc_feature (548)..(548): n is a, c, t, g, unknown, or other
  misc_feature (637)..(637): n is a, c, t, g, unknown, or other
tccccgcggtggcggccgctctagaactagtggatcccccgggctgcaggaattcgcacgagaccattacctagaacatcctaatcaaaaaattaatttcctgcgatgcacgcaggcgagtttaatttggaggatcaatggtagctagctccagctactagagacatacttgctgctatgcctctgctgcgagcgccacccatgaaggaacaaggccttagcggactacttggtgcgactccnatggattcctgccctcttcgtggcccttccaatatctgcgctgatctacctgagcgtcttcctggggaacacgtggtccgccatgaaatccgagaagcgtcgacagaaggaacaccaggagaacgtagagaggctgagagggtcgtgaagcgtctcaaggagagggatccgaagagggacggcctcgtctgcaccgcgaggaagccatggggtggtcgtgggcatgcgcaacgtggactacaagcgcgccagacgcttcgaggtcgacctctccgcgttgaggacatcctcgagatcgacgccgnagaggatggtcgccaggggtggagtctctcgtcagcatggcccagataaccaaggctacctgccccatgaacctctcgctcgccgtggnctcctgagttggacgaccttaaccgtcggtggtctgataaacggctacggggattttcgggagctctcacgtctacggcctcttctcctgacacgggtgtctcccatgggaggt

SEQ ID NO: 31498 - DNA, 763 bp, Zea mays
  misc_feature: Ceres CLONE 1407819-F
  misc_feature: Encodes the peptide sequence at SEQ ID NO. 31499
  misc_feature (565)..(565): n is a, c, t, g, unknown, or other
aaagctggagctccccgcggtggcggccgctctagaactagtggatcccccgggctgcaggaattcgcacgagaccattacctagaacatcctaatcgaaaactctcgccgcagccgcaccaccagaccgacaaccggccggcttccctcgcccccggcgaggagtgaagacaagccgacaaggcaaaaccatcgcctgtacggtatccaaccgccgtcccgccgcacaaccaaggatagggcgggagagggggatctcgctttcgctccgctgccgcatgcgcaccgcccctcctcatgacaccaactagggcaccaccagcccccttctcgtcgacctccgcgcggtgactctgctgagcatcatacccttatagggcccgacccatggatgtaacttcgaccgctgccgcctccgcctcaggcggggggtaggtggtacacgggcatgtccgcggataacatcaagggcctggtgctcgcgctctcctccagcctcttcatcggcgccagcttcattatcaagaagaagggactcaagaaggccgcatcctccgggcagagnggggggggttggtggctattcttatttatatgagcctcttttggggggggtggcatgataacaatgattgggttgggagaaattgcaaaatttcgcaagcttatgcatttgcaacgggctatttttgtcacctccctctcggggggtcttagcattatttaatcaccgctggggcttgcacatggaaatggctgcggg

SEQ ID NO: 31499 - protein, 49 aa, Zea mays
  misc_feature: Ceres CLONE 1407819-F
  misc_feature (39)..(39): Xaa is any aa, unknown, or other
MSADNIKGLVLALSSSLFIGASFIIKKKGLKKAASSGQXGGGWWLFLFI

SEQ ID NO: 31500 - DNA, 762 bp, Zea mays
  misc_feature: Ceres CLONE 1407820-F
  misc_feature: SWISSPROT Homolog: EC 1.14.13.8 Flavin-containing monooxygenase
  misc_feature (616)..(616): n is a, c, t, g, unknown, or other
  misc_feature (650)..(650): n is a, c, t, g, unknown, or other
  misc_feature (681)..(681): n is a, c, t, g, unknown, or other
  misc_feature (689)..(689): n is a, c, t, g, unknown, or other
  misc_feature (690)..(690): n is a, c, t, g, unknown, or other
  misc_feature (692)..(692): n is a, c, t, g, unknown, or other
  misc_feature (709)..(709): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (743)..(743): n is a, c, t, g, unknown, or other
  misc_feature (744)..(744): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (756)..(756): n is a, c, t, g, unknown, or other
  misc_feature (757)..(757): n is a, c, t, g, unknown, or other
  misc_feature (760)..(760): n is a, c, t, g, unknown, or other
atagctggagctccccgcggtggcggccgctctagaactagtggatcccccgggctgcaggaattcgcacgagaccattacctagaacatcctaatcgaaaaatccgactaaaaagggccagggccagggccttcgcttgcttactactcctgcttaccacactctaccttgtctcttcacgtgcacacgacgcctcccccaatggctgcggtgggcggaggaggaggtgatcgtcgtcggcgcggggcagtcggggctagcggtggcggcgtgcctgtccctgcgcggcgtgcgggcgctggtcctggagcgcgacgactgcgtggggtcgctgtggcggaagcgcgcctacgaccgcctccacctccacctcaccaagaagtactgcgcgctgccgcacgcgccgcacccggacgaggtccccgcgtacctgcaccgcgacgacttcgcgcgatacctggacgagtacgccgcgcgggatctctgacgctggctgcgctcgcctgatggccggtgctggcgttactacaccggaagcgggcatcgccaggagggggccgagcaactaggatgcccgtcatggctaacgagagggggggaagatacctaatgggncggggcaaagaaaaggcccaacaagtcccccccnaaggggccgaagaggagaggcggaccccggncggggggnncngcccttaggggaaaccnggtgggttaggnnncnnnnnnnnnnngnnnnngnncnnnnttnnngnntgnat

SEQ ID NO: 31501 - DNA, 732 bp, Zea mays
  misc_feature: Ceres CLONE 1407821-F
aaagctggagctccccgcggtggcggccgctctagaactagtggatcccccgggctgcaggaattcgcacgagaccattacctagaacatcctaatcgaaaactctcgtccggtatcaggctccttcgccattcgcccgttctacgccagagcccagaggaggcagcaagtcgttctcgcatctcgcgcgcctcgtgaacgaatccctaaccccacaattaaaagcaagcaacccccgctcccccacctgcgctaattaatcacatcacgagatccccttgcccacctccttcgcctcagtcacacgcctcgatctcgcctcgccgcgctcccaccaccgcaccatcccggccgcctcgctcgcgacgcaccaaggtgccctcgtatcccgcggcgcccggattgggttccctccggggatcacgcggcgagcctcgccgctcgagccacaggataatatgttcaatctgtttccttgttcatttaaacgtagagtggccttgaaggatgataattgaagcaaaatgattctctatttcaccatattttgggagatggatgatctgccaggagatggaaggaagatcccagacacacccttcaggaccggaattggccctcccattttggagcaagaagttccagtccctgcccctgacttaacagggaaaggaatttttgattctgcatattcttccctggaatcccaaggggaaggttgtccattccttg

SEQ ID NO: 31502 - DNA, 763 bp, Zea mays
  misc_feature: Ceres CLONE 1407822-F
  misc_feature: Encodes the peptide sequence at SEQ ID NO. 31503
  misc_feature (587)..(587): n is a, c, t, g, unknown, or other
  misc_feature (590)..(590): n is a, c, t, g, unknown, or other
  misc_feature (653)..(653): n is a, c, t, g, unknown, or other
  misc_feature (655)..(655): n is a, c, t, g, unknown, or other
aaagctggagctccccgcggtggcggccgctctagaactagtggatcccccgggctgcaggaattcgcacgagaccattacctagaacatcctaatcgaaaaactaggaaaaacctagacacgaagtccaacccaaatctcaatatcccaaccctccgatccccatttccatccactccgacaccaatcctccgctccgaccaccgccggagaaatggggcggcgccgccggttcgcgcagctggacgatgacgacgacgacgacgaagacgtgcccatcaatttcaagccctcgggtggcgcctcctcctcggacgccaaacccaggaagccccagccgccgccgcagcagcgccgcggagtctccgatgacgacgacgaggacgtggaggaagtgggaacttgaggaggaggaggacgacgagaaggatctcgaggcaatgcgacgggccgaggaggaggagcgccgcgagcagaaggccgagacgaagactcgccgccgcccggggacggcccaagcgccgccgcgaccccgggaagccgaggatgaggagcccgaggagctagagctgcaaacggaggatccncgnggaggaggagatccacggaggcggggcccgtaagctgtaggggacccggtcaagatcactggncnagggggaagaagcagaaagagcactatgcttccttccgagtacgagggcaacagctttcgagctggaggaccccgtgcttctcacgcctgaggacagcaatcagaagc

SEQ ID NO: 31503 - protein, 124 aa, Zea mays
  misc_feature: Ceres CLONE 1407822-F
MTTTTTKTCPSISSPRVAPPPRTPNPGSPSRRRSSAAESPMTTTRTWRKWELEEEEDDEKDLEAMRRAEEEERREQKAETKTRRRPGTAQAPPRPREAEDEEPEELELQTEDPRGGGDPRRRGP

SEQ ID NO: 31504 - DNA, 766 bp, Zea mays
  misc_feature: Ceres CLONE 1407826-F
  misc_feature: Encodes the peptide sequence at SEQ ID NO. 31505
  misc_feature (304)..(304): n is a, c, t, g, unknown, or other
  misc_feature (325)..(325): n is a, c, t, g, unknown, or other
acaagctgggagctccccgcggtggcggccgctctagaactagtggatcccccgggctgcaggaattcgcacgagaccattacctagaacatcctaatcaaaaaatccatcacagctggctagcatacagacgaataatctcttcttcacctcactaacaccagctagcaactctttctctcctgcaataatggccgctcgctcctcctcctcccagccgcagctggtcgcggaggcggcggtcctggcagcggcgctgctgctgctggcggcgggggccgggacggcgtcggcggcggtgagntgcgtcgaggtgacgtcgtcngtggcgccgtgcctcgggtacgcgatgggcagcgcggcgtcgccctccgcggcgtgatggcagcggagtgcgctcgctcaacagccgcgcgtcgtcggcgagaggaccgtcaggccacctgcaactgcctcagaagcatgacggcgcgggctcaggacgagcccatacgaatactcgccgcccgccggagacgccgcaaagggcgccgcgcaccggggtgagtgaggatgaggaccacgaggagctacaccctgatccggtgaacccccggagaaaaggagaaggcagctgcttcgcccgtaagctgaagatcagggccatcagaattctggccccgggcaggaaaagaaaagaagcctagcgtaccctccggcgccgggtccaacgggtccatcttgaaggaccccgtgcttgcccccgctaggggacactacggccagg

SEQ ID NO: 31505 - protein, 63 aa, Zea mays
  misc_feature: Ceres CLONE 1407826-F
  misc_feature (38)..(38): Xaa is any aa, unknown, or other
MAARSSSSQPQLVAEAAVLAAALLLLAAGAGTASAAVXCVEVTSSVAPCLGYAMGSAASPSAA

SEQ ID NO: 31506 - DNA, 764 bp, Zea mays
  misc_feature: Ceres CLONE 1407827-F
  misc_feature: Encodes the peptide sequence at SEQ ID NO. 31507
  misc_feature (716)..(716): n is a, c, t, g, unknown, or other
aaagctggagctccccgcggtggcggccgctctagaactagtggatcccccgggctgcaggaattcgcacgagaccattacctagaacatcctaatcgaaaactatcgctcataaccatagcccacaggccgccggcgcccgccagccgacgtcctcccatttcgctcccctcctccgctgcggtcgagcaaaagttccggccatccggcaatcccccggcacccggcggttcaaatcgtatctgacctgacgcggctacgacgtcgctcctccggtcccttcgatccggtggggtccgtttctttcaagcgcggcctcgctggccgcctcgtggcagtgaccgtcgaaccctctataaatcccgtgccccgagcacccttcctcgatcacacaacccaaagcagccacagcagcctccttcctggcttcctcctctcactctcgctcgtgctgcgctcgctacctcgcttcgcattccattcgaggagagcggtgagaggggaggaaaggcaagatgttcatcgagagcttccgcgtcgagagcccccacgtgcggtacggcccgacggagatcgagtcggagtaccggtacgaacggacggagctggtacacgaggggcaaggacggcgcctcaccgcttgggtcgtccgcccccaagtccgtcaagtacaacttccggaccagaaccgcgtccccaaagctcggggtgatgcnttggggggggtgggggaggcaaacaacgggtccacgcttgacggctgg

SEQ ID NO: 31507 - protein, 83 aa, Zea mays
  misc_feature: Ceres CLONE 1407827-F
  misc_feature: SWISSPROT Homolog: EC 5.5.1.4 Inositol-3-phosphate synthase
MFIESFRVESPHVRYGPTEIESEYRYERTELVHEGQGRRLTAWVVRPQVRQVQLPDQNRVPKARGDALGGVGEANNGSTLDGW

SEQ ID NO: 31508 - DNA, 693 bp, Zea mays
  misc_feature: Ceres CLONE 1407837-F
  misc_feature: Encodes the peptide sequence at SEQ ID NO. 31509
  misc_feature (223)..(223): n is a, c, t, g, unknown, or other
  misc_feature (269)..(269): n is a, c, t, g, unknown, or other
caaagctggagctccccgcggtggcggccgctctagaactagtggatcccccgggctgcaggaattcgcacgagaccattacctagaacatcctaatcaaaaaatccatcacagctggctagcatacagacgaataatctcttcttcacctcactaacaccagctagcaactctttctctcctgcaataatggccgctcgctcctcctcctcccagccgcagntggtcgcggcggcggcggtcctggcagcggcgctgctgctgctgancgcgagggccgggacgacgtcagcggcagtgagctgcagcgaggtgacgtcgtccgtggcgccgtggctcaggtacgcgatgggcagcgcggcgtcgccctacgcagagtgctgcaaaggagtgatctccctcacaagcgcgcgatttgcggaggaggaacgggaagacacctggaaatgggctcagaggatgacgggccggatcgggggggttttttttttcccctaaacccccaaaagcgtctcctcaatcctattccgaaaacagggggttggaaaaaatccggggggaatggtgaaaaaacctgggtgggacccaaaccccccaatagggaattatcttgggttggagccaaccaaagggggttttgtttaattttgtgaacccggggggaaaacccgggtttcaaaaaaggggaacgcg

SEQ ID NO: 31509 - protein, 102 aa, Zea mays
  misc_feature: Ceres CLONE 1407837-F
  misc_feature (12)..(12): Xaa is any aa, unknown, or other
  misc_feature (27)..(27): Xaa is any aa, unknown, or other
MAARSSSSQPQXVAAAAVLAAALLLLXARAGTTSAAVSCSEVTSSVAPWLRYAMGSAASPYAECCKGVISLTSARFAEEEREDTWKWAQRMTGRIGGVFFFP

SEQ ID NO: 31510 - DNA, 745 bp, Zea mays
  misc_feature: Ceres CLONE 1407841-F
  misc_feature: Translation starting site: 263
  misc_feature (488)..(488): n is a, c, t, g, unknown, or other
aaagctggagctccccgcggtggcggccgctctagaactagtggatcccccgggctgcaggaattcgcacgagaccattacctagaacatcctaatcgaaaacacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctctcagctatggttnagatggggccttattcgggatgataataaccttcagcttgaggccaccacacagttccgcagattgctctctaatagagaggagtccccccatcgaagaagatatcaaaacaggtgtagttccaagatttgtgcagtgtctcaccagagaggatttcccccagctgcagtttgaagctgcatgcgatctcacaatattgcttctggcacttagaaaatacaaaggttgctatgaatcatgcacgtgttcctatattg

SEQ ID NO: 31511 - DNA, 731 bp, Zea mays
  misc_feature: Ceres CLONE 1407845-F
  misc_feature (227)..(227): n is a, c, t, g, unknown, or other
  misc_feature (456)..(456): n is a, c, t, g, unknown, or other
catagctggagctccccgcggtggcggccgctctagaactagtggatcccccgggctgcaggaattcgcacgagaccattacctagaacatcctaatcgaaaagcgtttctttaccctaagcttttagctggtccaacgaaaggcacacagcccgacagccgccgctgtttcttcatcttcctcgcagcgccggcgctccttcttccgctccctctccgattcgcgntcggcacgcaggcgacggcggcggcgctcgtgctcgggctctcagcgacgggggccagaacgcagactcggtgacatgcgtcagcgcgcccccttccggctgtcaccaatcgcctcgcgccctcgcctccggtcctccgaacaccgaccggggcactgcgtgcacgcctcccgctcccctcctgcctccagagtagcgtatacggttgtcgtattcggatgctgcagtncgcgccgcgtgtgaccggctgacagccggactgtgcagccccccgctgtgccagcatgtataaaccttaggaatgcttatcgctagcgagctctccaccgcaatgaagagtgcggttagagtcgatgcttgaaccatgagtgtggagagatctgacatacatctgtgaataggcgaacccattcatctgatatagcttttacccggaagtgggagaggcctggttaacttccgagctatctactcttgtccattctgaaacacattacaatttct

SEQ ID NO: 31512 - DNA, 759 bp, Zea mays
  misc_feature: Ceres CLONE 1407847-F
  misc_feature (706)..(706): n is a, c, t, g, unknown, or other
  misc_feature (741)..(741): n is a, c, t, g, unknown, or other
aaaagctggagctccccgcggtggcggccgctctagaactagtggatcccccgggctgcaggaattcgcacgagaccattacctagaacatcctaatcgaaaaaagatctggaatcctttcacgccgccgctctcccctttttccttctctcttcgtcgttgtggttcctgccttcctgcctcggcgcatcgactcgcggagagggacagcacagcgcctcttccccatcctttctccattcccagatcgaaggtccatgtgagtattgcgtgaatcttgcaagctttggctccgctcgcggtttctggttgtcttgctgattggctccctgaatctttgccaagacctgagattcgagagatggaggaaggttagaacacgagtcaggcaccaagcaccgagcatttgcaagatccgcaccggttccaagctacaattgtcccacctattgatcctgtataataccgtttcgcacctgttgccgccgctgctgaatcttctccattacgttggagtgctgaagagaccatccttttggatctgatggagcgctgactatgagcgacagcatcaactcagttgtacctaccagcagatagaagtggtggtatcttttcgagagctattatgagagactgatgcgaggacccactacctagaaaggcgaggaggtctagagagtttatgctctggacatggaacctncaggtgacgtcccgttctactgctgggcaacgtgntgtcgatgatgaactggt

SEQ ID NO: 31513 - DNA, 754 bp, Zea mays
  misc_feature: Ceres CLONE 1407850-F
  misc_feature: Encodes the peptide sequence at SEQ ID NO. 31514
  misc_feature (363)..(363): n is a, c, t, g, unknown, or other
acaagctggagctccccgcggtggcggccgctctagaactagtggatcccccgggctgcaggaattcgcacgagaccattacctagaacatcctaatcgaaaagaatcgaatcgcgaccaaaccaaatcctccaccccggcgcgctgccccatcacccttcccgctgtgctcacgcaccaaaccccactccgttcctcactgcaatccaccgccccagctctttcgcgcaatggcggccgtcgcggcgccggcgccgccaccgccgcggcagctgagcctggaggacctcaaggtggtgtccgtgctcgggcgcggcgccatagggcgtcgtgttccacgtcgtgcacgctcccggggaaccngacgggagggggcgaagggcgccgccgcagccgctgccatggcgctcaaggggatctcgcgctaggcaacgcgacacaagaaggcggccagcgcggaacggatacggccacctacggatctggatcgagcattatgtgctcctgtcgctgcgccacccgctgctcgcttccctgcgaggaatcctcgacaccgacgcgatcgtagacttcgtcatgtagcactacgacggcgggcacctcaactctgtgcgagtctgcatgaccgagaacatgttctccgactccgtcatacgactctacgcgggtgaactggtgctggttatcaagtacctgcacagactccgcgtcacgttcctggacctcaagccctgagaacgtctcatccaggaat

SEQ ID NO: 31514 - protein, 37 aa, Zea mays
  misc_feature: Ceres CLONE 1407850-F
  misc_feature: SWISSPROT Homolog: EC 2.7.11.1 Non-specific serine/threonine protein kinase
MTENMFSDSVIRLYAGELVLVIKYLHRLRVTFLDLKP

SEQ ID NO: 31515 - DNA, 703 bp, Zea mays
  misc_feature: Ceres CLONE 1407852-F
  misc_feature (337)..(337): n is a, c, t, g, unknown, or other
acaagctggagctccccgcggtggcggccgctctagaactagtggatcccccgggctgcaggaattcgcacgagaccattacctagaacatcctaatcgaaaacattaattaacctctctccttcctcgccccttcccctccacgactccactaccaccaccttcaccttgtctcccacaaccgccgcgcgcaagccctagcccgatctcgccggcgacagacaccagatctcgccgcccgttgcgcgccgatacgcgccccgccggattcaccgctcctcgcgctgcagcacgcccgggcctgggttactgccgtgacatggtagtattgaataantttggaggttgtcacatcacacaagcatatgttgtgatttgcgatgccgagaaatgaacagtgtaggggcggagcaccaggacatgaaagcatgccggattcgggcaccgaggggttgtaaaacccaggggaccaagggtttggctttgggttggggcgccctaagggggccttggtaacccccgggggtttccccagggaatttttggtttagggggtggcccccctaaaggggtgggtacccgggtggtctcggaagaaaataaaaaaaaattttccccgggggttaaaaggaacttttttccggcgcgggggttgaaaaaaaacccaaaattcttttttttttttaacccccctttttttttt

SEQ ID NO: 31516 - DNA, 740 bp, Zea mays
  misc_feature: Ceres CLONE 1407855-F
  misc_feature: Encodes the peptide sequence at SEQ ID NO. 31517
  misc_feature (537)..(537): n is a, c, t, g, unknown, or other
  misc_feature (547)..(547): n is a, c, t, g, unknown, or other
  misc_feature (548)..(548): n is a, c, t, g, unknown, or other
  misc_feature (578)..(578): n is a, c, t, g, unknown, or other
aaaagctggagctccccgcggtggcggccgctctagaactagtggatcccccgggctgcaggaattcgcacgagaccattacctagaacatcctaatcgaaaagatctccccaatccgaccagaccggcaggcaccttcgactcgagcggagcaggcgaggcagagatggcgctgcgacgggcgctcctcagatcggtcaacttctcccccgacagcaaggctgcaattgagtacttttattctttctcaagggcacagtctgcttgttctctcaatggtgctggtctttgtcctgctagtagatcatttagcacccaggctgccactacgtcaagcacaccacagcctccacctccaccaccccctccagagaagactcactttggtggtctcaaagatgaggatcgcattttcaccaacctctatggtctgcatgacccttttctgaaaggcgcggtgaagagaggtgactggtataggaccaaggatttggtgattaagggggcagactggatagttaatgaatgaagaatcangtctttcggnnttcgggaagggtgcaggtttttcctctggntctgaatggtctttatggcccaggtttctgatggacgccctccttatcttggtgttaatgctgatgaaagtgagcctggaacttgcaaagatagagaatcatgcgccagacccccacagcttctggaagatgctttattgcttgagttggaatgaagcatct

SEQ ID NO: 31517 - protein, 120 aa, Zea mays
  misc_feature: Ceres CLONE 1407855-F
  misc_feature: SWISSPROT Homolog: EC 1.6.99.5 NADH dehydrogenase (quinone)
MALRRALLRSVNFSPDSKAAIEYFYSFSRAQSACSLNGAGLCPASRSFSTQAATTSSTPQPPPPPPPPEKTHFGGLKDEDRIFTNLYGLHDPFLKGAVKRGDWYRTKDLVIKGADWIVNE

SEQ ID NO: 31518 - DNA, 773 bp, Zea mays
  misc_feature: Ceres CLONE 1407857-F
  misc_feature: Translation starting site: 183
  misc_feature (313)..(313): n is a, c, t, g, unknown, or other
  misc_feature (371)..(371): n is a, c, t, g, unknown, or other
  misc_feature (434)..(434): n is a, c, t, g, unknown, or other
  misc_feature (435)..(435): n is a, c, t, g, unknown, or other
  misc_feature (460)..(460): n is a, c, t, g, unknown, or other
  misc_feature (471)..(471): n is a, c, t, g, unknown, or other
  misc_feature (499)..(499): n is a, c, t, g, unknown, or other
accagctggagctccccgcggtggcggccgctctagaactagtggatcccccgggctgcaggaattcgcacgagaccattacctagaacatcctaatcgaaaaaactacggtaactcgtctgctcgcatttcctcccaatccatcccgcctccaaacccgaactccaagtcgccccgcatcgatggcgcccaaggccgagaagaagcccgcggcgaagaagccggcggaggaggagcccgcggccgagaaggcgccggccgggaagaagcccaaggcggagaagcgtgtcccagcgggcaagtccgccggaanggagggcggtgaggggaaagaggggccggaagaagggaagaagagcgtggagacttancagatctacatttttcaaggtgctgaaagcagtgcacccggacatcggcatttcctccaaggnncatgtcatcatgaaactcttcatcnacgacatcttncagaagctcgcttgccgaagccgcaagncttcgggcggaacaaccagaagccaacatcccctcccgggagaaccaaaatccggggggcctgtcttccccggggagtttgccaagcacccgtttccggaggaaccaaggccggcccacaattcccccgcccaaggtggcaaaccccccggggggggttttccccgattttcccgggtctttttagaataagaggggttggggggcgggccctcttttgaaaatgtttttttgggaaaaaaaacacggtttttatcccccgtggtgttaaaaaa

SEQ ID NO: 31519 - DNA, 741 bp, Zea mays
  misc_feature: Ceres CLONE 1407858-F
  misc_feature (1)..(1): n is a, c, t, g, unknown, or other
  misc_feature (406)..(406): n is a, c, t, g, unknown, or other
  misc_feature (434)..(434): n is a, c, t, g, unknown, or other
ncaagctggagctccccgcggtggcggccgctctagaactagtggatcccccgggctgcaggaattcgcacgagaccattacctagaacatcctaatcaaaaagcggcggtgttgacccacccacccgttcctcccccaccccatcagcgctggaggcggcggtgcgtaagtcccccggacccttcggcggcggcggcggcgcgcggttatgccgagaggctcccaggtttcatcatcgtgctctgctggagttatagcattttcagcaaggatatggagtacaccccctgcacagcaagttcctctgtatcccacatctcgctgctcgaggaagttcttggctggaggttttgtctttacggagacttcctgatcatctcttttgtcactgcacttgcagatcangctacgcttagtgactggctttgctggncccatgctgtcagacatagaggtggccagtgatttacactatacagtgcagctgtagcacatttattggagcagggggggatcgggtcctcgggcaacttccagaattctttggctttggggttaacagcccggaaaggttcccttaaaaatccttgggcaatgggtttaaagttaaaggttgccttccaataagggcaaggggggggttttccttttggggaattttcttcacccccccgggaatttcccggaggggcccaaagtgggggggggttggacaacctcctcccccacccttttggggg

SEQ ID NO: 31520 - DNA, 697 bp, Zea mays
  misc_feature: Ceres CLONE 1407859-F
  misc_feature: Encodes the peptide sequence at SEQ ID NO. 31521
  misc_feature (331)..(331): n is a, c, t, g, unknown, or other
  misc_feature (337)..(337): n is a, c, t, g, unknown, or other
  misc_feature (343)..(343): n is a, c, t, g, unknown, or other
  misc_feature (346)..(346): n is a, c, t, g, unknown, or other
caaagctggagctccccgcggtggcggccgcttctagaactagtggatcccccgggctgcaggaattcgcacgagaaccattacctaaaacattcctaatcgaaaaaaagaagcgtgcagaagcgagacgcgtcgcctcctcccttcccccaccccgccgccgccctcgcgtccgtccgtccgtccgttattagggttcggtcgccgccatggcgatcctctcggcgctcgccaccgaggtgctcatccccgtcgccgccgtcatcggcatcgccttcgccgtcgtgcagtggggtggtcgtgtcgcgcgtgaagctctccccgggcgcgnccgcgntggcgnggncaaagccggctacgccactccctcatcgaggagggaggaggggctcaacgaccacaacgtcgtcgtcagtggcgccgagatccagaacgccatctcggaagagcaacattcgtttcttttcacgagtacaaaatggtgggaatcttcatgctatccttcgccgggtgggggacttcccccttcccgggggcccggggtgggggggattttccccccaaaaaaaccccccccccctggcccaaattttttaggggaaaaaatattttgaaaccccgggcttttacccgggaccttttaaaaccggggggccttttgtgttgggggccacaaccctccctgggggcctggggt

SEQ ID NO: 31521 - protein, 134 aa, Zea mays
  misc_feature: Ceres CLONE 1407859-F
  misc_feature: SWISSPROT Homolog: EC 3.6.1.1 Inorganic diphosphatase
  misc_feature (41)..(41): Xaa is any aa, unknown, or other
  misc_feature (43)..(43): Xaa is any aa, unknown, or other
  misc_feature (45)..(45): Xaa is any aa, unknown, or other
  misc_feature (46)..(46): Xaa is any aa, unknown, or other
MAILSALATEVLIPVAAVIGIAFAVVQWGGRVAREALPGRXRXGXXKAGYATPSSRREEGLNDHNVVVSGAEIQNAISEEQHSFLFTSTKWWESSCYPSPGGGLPPSRGPGVGGIFPPKKPPPPGPNFLGEKIF

SEQ ID NO: 31522 - DNA, 737 bp, Zea mays
  misc_feature: Ceres CLONE 1407863-F
  misc_feature: Encodes the peptide sequence at SEQ ID NO. 31523
caaaagctggagctccccgcggtggcggccgctctagaactagtggatcccccgggctgcaggaattcgcacgagaccattacctagaacatcctaaaaaaaaaccaaaacctccactcttcctcccaccaaggcaccaacccgacgcaaagccgccggctttccccgatggcgacgacgatgtcagtttcggcggtgtccccgcccgccgcggctgtcacgcggccccggacgatggtctgcgtgccggcgacggcgcgggcgccgcgggagatggcggctgagctggccgccgccgccgcgctcggcgccgacgtggcggagcttcgcctcgactgcctcgccggtttcacgccgcgcagggacctgcccgtcatcctcgccaagccccgtccgctccccgccctcgtcaccttcaggcccaagtggggaaggaggcgaatacgaaggcgatgacgaatcccggtttgaggctctgctattggcaatggagctgggagctgaatatgtggatgtcgagcttaaggtggatgacaatttatgacacttatttctgagaggagaactgataactgtaaacttatagtgtcatcccacaactatgagaccactccatcgtccgaggaacttgcaaatttggggcctcaaattcagcaacggagggctgatatcgtggaaaatactacaaccgctacttgaaattggggagggggaaaaaagttttcaatactggtcaa

SEQ ID NO: 31523 - protein, 95 aa, Zea mays
  misc_feature: Ceres CLONE 1407863-F
MATTMSVSAVSPPAAAVTRPRTMVCVPATARAPREMAAELAAAAALGADVAELRLDCLAGFTPRRDLPVILAKPRPLPALVTFRPKWGRRRIRRR

SEQ ID NO: 31524 - DNA, 672 bp, Zea mays
  misc_feature: Ceres CLONE 1407865-F
  misc_feature: Encodes the peptide sequence at SEQ ID NO. 31525
  misc_feature (250)..(250): n is a, c, t, g, unknown, or other
  misc_feature (448)..(448): n is a, c, t, g, unknown, or other
  misc_feature (489)..(489): n is a, c, t, g, unknown, or other
caaagctggagctccccgcggtggcggccgctctagaactagtggatcccccgggctgcaggaattcgcacgagaccattacctagaacatcctaaaaaaaaaggaattctgccttcttctctcatcttcctgctcaacatcagtagcagctttagctgtagcagcgccaccggccaccgccacgctatggccaccacgttgcacaagcccctgggggcgatcaccgttgacgacctcgccgcggcggcngcctgggtcggacgccaccgcgctccacgcagcgctccggcgcgcgctcgactcgcacggacccaccgaagtgtggggcgagctctgccggtccgtggctctgtccgtctgtccccttcgccgtccaccggatgctctactacggttggcttcgccgggttcccgtctcccacgccgccgcctggacgcccgaccccnagggaggctgtcttgaccaatgtcggccgtgtcctcgaggngcgtggtagggacttcatcggcgacgcgtacaaggatcccatcaccagcttcccgacctccccagttctccaacgagaaacccagagcgaactggaaaatggtattggaggatatgggtattccattcagcggaaagccatccggcatctgaagaaaaaaactgcaaatccggggggcgagtt

SEQ ID NO: 31525 - protein, 161 aa, Zea mays
  misc_feature: Ceres CLONE 1407865-F
  misc_feature (101)..(101): Xaa is any aa, unknown, or other
MATTLHKPLGAITVDDLAAAAAWVGRHRAPRSAPARARLARTHRSVGRALPVRGSVRLSPSPSTGCSTTVGFAGFPSPTPPPGRPTPREAVLTNVGRVLEXRGRDFIGDAYKDPITSFPTSPVLQRETQSELENGIGGYGYSIQRKAIRHLKKKTANPGGE

SEQ ID NO: 31526 - DNA, 753 bp, Zea mays
  misc_feature: Ceres CLONE 1407866-F
  misc_feature (260)..(260): n is a, c, t, g, unknown, or other
  misc_feature (332)..(332): n is a, c, t, g, unknown, or other
  misc_feature (333)..(333): n is a, c, t, g, unknown, or other
  misc_feature (349)..(349): n is a, c, t, g, unknown, or other
  misc_feature (350)..(350): n is a, c, t, g, unknown, or other
  misc_feature (352)..(352): n is a, c, t, g, unknown, or other
  misc_feature (364)..(364): n is a, c, t, g, unknown, or other
  misc_feature (365)..(365): n is a, c, t, g, unknown, or other
  misc_feature (372)..(372): n is a, c, t, g, unknown, or other
  misc_feature (412)..(412): n is a, c, t, g, unknown, or other
  misc_feature (514)..(514): n is a, c, t, g, unknown, or other
aaagctggagctccccgcggtggcggccgctctagaactagtggatcccccgggctgcaggaattcgcacgagaccattacctagaacatcctaatcgaaaaagcaggagaagagagacgacacagcagctttttgggtttccccttccctttccccgcgcggtgatcgcagggttctccgcgagcgaggcagagcactgcgcgtcctccgtgacttcctggtgatcgctgggggttctggacgttggtgtttcatttgngttggttggtgggtggcagcagccgtggcgagatggacctgatgatgccggtgacgggaagagagtggggcnncccccggaagaagaannanaaagaagaaccnngaacgcngaacgcggacgctcccgcggcccgatggaggggctgcacngaggtcggggccaccgccccgttcctgaccaagacgttcgaacctgggtgggccgacccggcccacccgacgaggtcattctcctgggggccgcgcccggcnaccagttttcgtgggtctggggatccccacgtgtttcgcccgccgtgcttgctccccagggttctttaagcacaacaacttcctccagctttgtgcgccagctgaacacctatctagatggaccagggaaagggaatgaacgaagctactacagcctacaagaaagaaacaacctggcttgtttgtcctaaagataaagaagactcactccctttgatcaccactcaccaccaaggaaa

SEQ ID NO: 31527 - DNA, 722 bp, Zea mays
  misc_feature: Ceres CLONE 1407867-F
  misc_feature: Encodes the peptide sequence at SEQ ID NO. 31528
  misc_feature (722)..(722): n is a, c, t, g, unknown, or other
caaagctggagctccccgcggtggcggccgctctagaactagtggatcccccgggctgcaggaattcgcacgagaccattacctagaacatcctaatcgaaaacacagcaagccagcagagcagaaagcagccgcagccccagcccccacaagacgaggcaacaatggcgctagaagcagccaccgccccccgcgcactcctcgccgcgtgcctcgtcctgctggtcctcggcggcggcacaggcccgtcgtcggtgctgcgcggcgccggggcgcaggccggaggtcagtgcctgccgcaactgaaccgcctcctggagtgccgcgcgaacatgtcgtccggcgggccggggaccagagggtactggtgcatcctggtgagctccgtgtcttacgggtgcgcatcgcggactggcacaccacgaagagcctgcccggccggtgactgcgcgcgcatgccaagtgcttcgcgtgaaccaagatcctgatacacgaggtgcatagaatgccatgacgctacaagcagggatgatgccttctacaggcacaagatgcccacaatgattaccaagatagacggccgcggccaatgtcattaagactaaggacgggaacctgtggacttagcaaaaggccttgccaggccagcttcctacacatcaaggaacttgggatgggggttttggggcccggccacctttgatggagaggacgggacttcn

SEQ ID NO: 31528 - protein, 107 aa, Zea mays
  misc_feature: Ceres CLONE 1407867-F
MALEAATAPRALLAACLVLLVLGGGTGPSSVLRGAGAQAGGQCLPQLNRLLECRANMSSGGPGTRGYWCILVSSVSYGCASRTGTPRRACPAGDCARMPSASREPRS

SEQ ID NO: 31529 - DNA, 737 bp, Zea mays
  misc_feature: Ceres CLONE 1407872-F
  misc_feature: Translation starting site: 356
  misc_feature: Pfam Name: UPF0052 Pfam Description: Uncharacterised protein family UPF0052
  misc_feature (544)..(544): n is a, c, t, g, unknown, or other
  misc_feature (557)..(557): n is a, c, t, g, unknown, or other
  misc_feature (578)..(578): n is a, c, t, g, unknown, or other
  misc_feature (589)..(589): n is a, c, t, g, unknown, or other
caaagctggagctccccgcggtggcggccgctctagaacaagtggatcccccgggctgcaggaattcgcacgagaccattacctagaacatcctaatcaaaaaagattaccgccgcggacgcgcgccggtcgtttccttggcgcggcccgccgcgctgcttcttccgcagaacatccgcccgccccccttctacttccaccctaccggagagaggtcggaatgacactcgtcgcgagccctcgctgcaacataaccccgccccaagactccgcttgaggaagacgctgcctactccgcgcgccgagatctgcagcgtccaggcccccgccgtgacgtctccgccgcagccgcgccatggccgtatacggaggctggcactctgctgccgcaggcgcagacactgatggaggcgctccagctcctcacgtgcccccgtcgctgctcgttttctcaggcgatacagcaatttaacgttgatggttgagaattgaagacagtcactactcgagtcgcgcacgtgctccctgattctgatgatggagnaagcactgctganaatgtgcgtgtgctttgcggncctgctgtggnaacataagaatcagatggtttgaggtgtctgatgaaacaatgcaaaagctctttctgttcgaaaatgctggggcatcgtttgcctattggatccttcgaagcaaagtgggaatggtaccaaattgtaaaagagaccccgttaatgggg

SEQ ID NO: 31530 - DNA, 693 bp, Zea mays
  misc_feature: Ceres CLONE 1407874-F
  misc_feature: SWISSPROT Homolog: EC 1.14.11.20 Desacetoxyvindoline 4-hydroxylase
  misc_feature (144)..(144): n is a, c, t, g, unknown, or other
  misc_feature (351)..(351): n is a, c, t, g, unknown, or other
  misc_feature (352)..(352): n is a, c, t, g, unknown, or other
  misc_feature (420)..(420): n is a, c, t, g, unknown, or other
  misc_feature (503)..(503): n is a, c, t, g, unknown, or other
aagctggagctccccgcggtggcggccgctctagaactagtggatcccccgggctgcaggaattcgcacgagacctttacctagaacatcctaatcgaaaaatcccagttggaagggcagccaataaggtaaggggtgacgaanatggctcccacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgccctctgcgtcgtcgccaccctccggnngcgcatcccggtggtggacctctcggtgacgcggcgcgaggacctagtcgagcaggtgaggcacgcgnccgggacggtgggcttcttctggctggtgaaccacggcgtggcagaggagcttgatggcggcatgctccgcggggtgcgcagntcaacgaggggccccgtgaagggcgaacaggccctctactccagggaactgggtcgaaacctgggcttccccctccaacttcgaccctcttcaagggcgcttgcggccgactggcgccaccggttcttttctgggaggggggctccaaacccgcccccccggggaaggagctgcccgaacccactgagga

SEQ ID NO: 31531 - DNA, 706 bp, Zea mays
  misc_feature: Ceres CLONE 1407876-F
  misc_feature: Encodes the peptide sequence at SEQ ID NO. 31532
aagctggagctcaccgcggtggcggccgctctagaactagtggatcccccgggctgcaggaattcgcacgagaccattacctagaacatcctaatcgaaaaacacccgcatcccacaacccccgagctcagcttagctccactccagctcccaatcggagtcgtgaccagagcgcgagagctagctaaagggccgtgaaaatggcgatcaataggatcgccctggggagccaccaggaggtgtaccacccgggcgccctcaaggcggggttcgctgagttcatctccaccctcatcttcgtcttcggcggccaggggtccggaatggccttcagaaaggtgaccggggggggcccgacgaccccggggggcctgatcgcggaggggggggggcacgcgttccccgctgttcttggggggtgtctgtgggcccaaacctctccgggggggacgtggaaccctgccgtggacttcgggggccttcgggggggggaaaaatcccccctggttcggggggctcctttgaatgggggggggcaaacttgctgggggcccccccggggggggtgttttcctgctccccctttttcgaaagggggggggagaggcccccggcacccctttgggatttaaagggcggtgtttagtgggggaaaggcccctcttttcttcaaaaatacaaaaaaaacccttccggcggtggggga

SEQ ID NO: 31532 - protein, 143 aa, Zea mays
  misc_feature: Ceres CLONE 1407876-F
MAINRIALGSHQEVYHPGALKAGFAEFISTLIFVFGGQGSGMAFRKVTGGGPTTPGGLIAEGGGHAFPAVLGGCLWAQTSPGGTWNPAVDFGGLRGGEKSPLVRGAPLNGGGQTCWGPPRGGCFPAPPFSKGGGRGPRHPFGI

SEQ ID NO: 31533 - DNA, 594 bp, Zea mays
  misc_feature: Ceres CLONE 1407878-F
  misc_feature (212)..(212): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (228)..(228): n is a, c, t, g, unknown, or other
  misc_feature (234)..(234): n is a, c, t, g, unknown, or other
  misc_feature (236)..(236): n is a, c, t, g, unknown, or other
  misc_feature (237)..(237): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (280)..(280): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (346)..(346): n is a, c, t, g, unknown, or other
  misc_feature (348)..(348): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (462)..(462): n is a, c, t, g, unknown, or other
  misc_feature (472)..(472): n is a, c, t, g, unknown, or other
  misc_feature (493)..(493): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (519)..(519): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (541)..(541): n is a, c, t, g, unknown, or other
  misc_feature (545)..(545): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (556)..(556): n is a, c, t, g, unknown, or other
  misc_feature (557)..(557): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
aaagctggagctccccgcggtggcggccgctctagaactagtggatcccccgggctgcaggaattcgcacgagaccattacctagaacattctaatcgaaaaatctcgcccgccgttctcgtccttgtagatctcctcgcacctcgcccattcgcttcaccaagggtttaagaccggcggcgatggcggcgaagctggcgcagctgcgcacnacaggnnntaacgcgntggcgngnncggagttcgccctcgannnagcacggctggctcccttactacnaaggagggtattgggaaaaaaaaaagggnnnnntttggtttttccccccccccccccgaaaaagananaggcggnnnggggattttcctccaaaaagtttttttttttccccccccccccggaagaaaaaaaatttcttttatttttttgtaggggaatgtggttggtgcaaaacaaaaaanaagggagggnagaagaaaaaaaagaaaaggnggaaagannnnnnnnnnnagaggggngaaagagggcnnnnncgnnncncccncnnnnnnnngnncnnnnnncgnnnnnnnnnnnncggggggagggggggg

SEQ ID NO: 31534 - DNA, 674 bp, Zea mays
  misc_feature: Ceres CLONE 1407880-F
  misc_feature: Encodes the peptide sequence at SEQ ID NO. 31535
  misc_feature (510)..(510): n is a, c, t, g, unknown, or other
aaagctggagctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcaccggcatgctcatccagctgacctacgtggcgctcttcatcctctgcntccgcgggggcggtgcgccgcagggtcgtgctcctgttcgccgccgaggtcgccttcgtcgtcgccttggccgcgctggtgctcaccctggcgcacacgcacgagcgcaggtccatgctcgtcggcatcgtctccgtcttcttcggcaccggcatgtacgctgc

SEQ ID NO: 31535 - protein, 148 aa, Zea mays
  misc_feature: Ceres CLONE 1407880-F
  misc_feature (9)..(98): Pfam Name: MtN3_slv Pfam Description: MtN3/saliva family
  misc_feature (94)..(94): Xaa is any aa, unknown, or other
MVSADTIRTAIGVIGNGTALVLFLSPVPTFVGIWKKRAVEQYSPIPYVATLLNCMMWVLYGLPLVHPHSMLVVTINGTGMLIQLTYVALFILCXRGGGAPQGRAPVRRRGRLRRRLGRAGAHPGAHARAQVHARRHRLRLLRHRHVRC

SEQ ID NO: 31536 - DNA, 740 bp, Zea mays
  misc_feature: Ceres CLONE 1407882-F
  misc_feature (322)..(322): n is a, c, t, g, unknown, or other
  misc_feature (323)..(323): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (345)..(345): n is a, c, t, g, unknown, or other
  misc_feature (347)..(347): n is a, c, t, g, unknown, or other
  misc_feature (348)..(348): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (362)..(362): n is a, c, t, g, unknown, or other
  misc_feature (363)..(363): n is a, c, t, g, unknown, or other
  misc_feature (368)..(368): n is a, c, t, g, unknown, or other
  misc_feature (369)..(369): n is a, c, t, g, unknown, or other
  misc_feature (379)..(379): n is a, c, t, g, unknown, or other
  misc_feature (389)..(389): n is a, c, t, g, unknown, or other
  misc_feature (402)..(402): n is a, c, t, g, unknown, or other
  misc_feature (403)..(403): n is a, c, t, g, unknown, or other
  misc_feature (408)..(408): n is a, c, t, g, unknown, or other
  misc_feature (417)..(417): n is a, c, t, g, unknown, or other
  misc_feature (448)..(448): n is a, c, t, g, unknown, or other
  misc_feature (449)..(449): n is a, c, t, g, unknown, or other
aaagctggagctccccgcggtggcggccgctctagaactagtggatcccccgggctgcaggaattcgcacgagaccattacctagaacatcctaatcgaaaaaattcgtcttcttccacaaactccaaaaccctagcgccgccgccgccatgtcctcgtctccgtccccggcgaaccgccgtccccagggcccgctttggcgctggggctggagtcctcggcgaacaagatcggtatcggcgtggtctccctctcgggtgacatcctctccaacccgcgccacacctacgtgaccccgccgggccatggcttcccttcccgnngagacgcgcagnnnacactcgngnnactnnnctcctctnnctcgnngcgggttcgnttgagtccgntgtgggcccccgnntgacntcgcatggntctggctaccctaaaagcccccgggaatggnncggccttttccaggttcgcccaaaaaaaccgccccgggggttttccctttgtatttgaagggaaccttttcggtgggggggaaaaccccttgggttttgggcaatttaaagaggggccccgggggccacagtggggcccggggggaccccccggttgacttttattcttccccggggggaaaaaccccgggttttcccccctaccggggggggggggggaaaaggaattttttcggaaaaaattttttttattttccccgggaaaaatcttttttacatatttttccgggg

SEQ ID NO: 31537 - DNA, 653 bp, Zea mays
  misc_feature: Ceres CLONE 1407884-F
  misc_feature: Encodes the peptide sequence at SEQ ID NO. 31538
  misc_feature (504)..(504): n is a, c, t, g, unknown, or other
  misc_feature (505)..(505): n is a, c, t, g, unknown, or other
aaagctggagctccccgcggtggcggccgctctagaactagtggatcccccgggctgcaggaattcgcacgagaccattacctagaacatcctaatcgaaaaagccgcatcccttctttcattcgccgccgccgcctcctctctgctgccgtcgccatggggagaaggcctgcgagatgctatcgccaaatcaagaacaagccataccccaagtccaggtactgccgtggtgtccctgaccccaagattaggatctacgatgttggcataaagagaaagggtgttgatgagttcccctactgtgtgcaccttgtctcttgggagaaggagaatgtctccagtgaggctcttgaggctgcccgtattgcctgcaacaagtacatgaccaagtctgcaggaaaggatgccttccaccttcgggtccgggttcaccccttccatgtccttcgtatcaacaagatgctttcgtgtgctggggctgataggctcagactggaatgaggnngtgctttggcaagctcaggccactgtggctagggtgacaatggtcagaacctcctttctgttccatgaaggaacaacatgctgccaatggcagtggaagctctggaacgccccaggttcaggttcttggccccaaaaaaattttggaa

SEQ ID NO: 31538 - protein, 114 aa, Zea mays
  misc_feature: Ceres CLONE 1407884-F
  misc_feature (5)..(115): Pfam Name: Ribosomal_L16 Pfam Description: Ribosomal protein L16
MGRRPARCYRQIKNKPYPKSRYCRGVPDPKIRIYDVGIKRKGVDEFPYCVHLVSWEKENVSSEALEAARIACNKYMTKSAGKDAFHLRVRVHPFHVLRINKMLSCAGADRLRLE

SEQ ID NO: 31539 - DNA, 646 bp, Zea mays
  misc_feature: Ceres CLONE 1407887-F
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (217)..(217): n is a, c, t, g, unknown, or other
  misc_feature (219)..(219): n is a, c, t, g, unknown, or other
  misc_feature (336)..(336): n is a, c, t, g, unknown, or other
  misc_feature (373)..(373): n is a, c, t, g, unknown, or other
ttagaactggtgggtcccccgggctgcgggaattcgcacgagaccattacctagaacatcctaatcgaaaaacgggtcaccagtcaccacatccctccctccctggcatttgtttggttgttcctctcgcagtctcgctcgccaccaggcagcaggcatcccaatctcgcgagagccagtagcggcggcgggcggcnnnnnnnnnncnnnnnntccngntccccttccatgggcccccccggagggcgcccggccccccgggggcgcgggccgcgccccgccggcccccgcggccccgcggggcggcgggggccccccggcgccccgggccccggncgccgccccccccgcccgcgcggggcgggggcggggngcgcccccggcgggctagcgccgggggggctgccgtggggggtcgcgcggcgccgccccggcggcgcgcccgcgggggcgctccgcggcgggggggcccgcccgccgccggccccgcgcgcgctggtgtgcccccgagcgtcgccccgcgggcctcaccccccctccccgccccccggctcgcctcctggcgccaccgcggcgcccctgcgcccggccgccccgccgcgacccccccccgcccccggcgggtggccggaggggccccaacgcc

SEQ ID NO: 31540 - DNA, 698 bp, Zea mays
  misc_feature: Ceres CLONE 1407888-F
  misc_feature: Encodes the peptide sequence at SEQ ID NO. 31541
  misc_feature (662)..(662): n is a, c, t, g, unknown, or other
  misc_feature (698)..(698): n is a, c, t, g, unknown, or other
aaagctggagctccccgcggtggcggccgctctagaactagtggatcccccgggctgcaggaattcgcacgagaccattacctagaacatcctaatcgaaaacagatcaggatccattaacacccctacgtacgcctttcctctggaaacccttctctcgcctgcctctcccccgccgcgccgccacttcccctctcccgtcaactccggcttccgcgcgaggtcgagctagcgtttggagttctcgagacctgctgtgatggcgacagagcaagcggcggaaaactacacggtggaggacctcgtggccctgaacccctacaaccccgacatcctcaacgacctcgagaagttcgtcaatgagcaggtctcatctcagacatataacttggatgcaaatctcagccttcttcgcttgtaccagtttgagccagaaaggatgagcatacagattgtggcccacatactgattaaggctctcatggcaatgccagcccctgacttcagtttgtgcttattcttaatccctgaacatgtgcaagtggaggagcaattcaaggtattgatagttctttctcactacctagagactggctaggtcagtcaattttggggatgagcagcaaagaaccggccacatatcggaagcagtggcagggttncgaacaagcaaatccatctatggcgattcatggtan

SEQ ID NO: 31541 - protein, 112 aa, Zea mays
  misc_feature: Ceres CLONE 1407888-F
  misc_feature (19)..(113): Pfam Name: SAC3_GANP Pfam Description: SAC3/GANP/Nin1/mts3/eIF-3 p25 family
MATEQAAENYTVEDLVALNPYNPDILNDLEKFVNEQVSSQTYNLDANLSLLRLYQFEPERMSIQIVAHILIKALMAMPAPDFSLCLFLIPEHVQVEEQFKVLIVLSHYLETG

SEQ ID NO: 31542 - DNA, 706 bp, Zea mays
  misc_feature: Ceres CLONE 1407899-F
  misc_feature: Encodes the peptide sequence at SEQ ID NO. 31543
  misc_feature (308)..(308): n is a, c, t, g, unknown, or other
  misc_feature (332)..(332): n is a, c, t, g, unknown, or other
  misc_feature (335)..(335): n is a, c, t, g, unknown, or other
  misc_feature (386)..(386): n is a, c, t, g, unknown, or other
aaagctggagctccccgcggtggcggccgctctagaactagtggatcccccgggctgcaggaattcgcacgagaccattacctagaacatcctaatcgaaaaacagcgccaagggcaccaccagcaaggaccaagacagagcacagcgcagctcgtcggcctctcgacgccggttgctgcaaccaccgcctttattgcccacgcgggccgtggcggaagaagcaagaaaacacgcccatgggagtcgccgcagcatcggcagcgggctacggatttcagggcgacgacgacgttgacagcctcagggncgacgagctcaggcttgcttgccnggncacggaggaaggagaggcccgagagtcccagaacagggcgcgccgccgcgncgtcaacgcccagaggcaagaagcgcgacgtcgtcgccagcagcgggccgaagatgccccaaggaagccgactgggagaacggacaccaatgcgggcccgccccggccgccaagttcaatttggggggaatgcccccggtgaagtcctaaacagaaaagctgcttcccaaaaaagggggggggcaaaaaaaaagccggcggaaacgcttgggggaagaagcccccgccccccgggggtttttttcttaaaaggggaaatggaacccccccccctaccttcggagggggggccctaaaagttgcaaagggttaccccgggg

SEQ ID NO: 31543 - protein, 96 aa, Zea mays
  misc_feature: Ceres CLONE 1407899-F
  misc_feature (24)..(24): Xaa is any aa, unknown, or other
  misc_feature (32)..(32): Xaa is any aa, unknown, or other
  misc_feature (33)..(33): Xaa is any aa, unknown, or other
  misc_feature (50)..(50): Xaa is any aa, unknown, or other
MGVAAASAAGYGFQGDDDVDSLRXDELRLACXXTEEGEARESQNRARRRXVNAQRQEARRRRQQRAEDAPRKPTGRTDTNAGPPRPPSSIWGECPR

SEQ ID NO: 31544 - DNA, 689 bp, Zea mays
  misc_feature: Ceres CLONE 1407905-F
  misc_feature: Encodes the peptide sequence at SEQ ID NO. 31545
  misc_feature (573)..(573): n is a, c, t, g, unknown, or other
  misc_feature (574)..(574): n is a, c, t, g, unknown, or other
  misc_feature (636)..(636): n is a, c, t, g, unknown, or other
  misc_feature (648)..(648): n is a, c, t, g, unknown, or other
ggagctccccgcggtggcggccgctctagaactagtggatcccccgggctgcaggaattcgcacgagaccattacctagaacatcctaatcgaaaacttttcctagggtttcgtcgcttccagccgccgccgcgtccgcctcgccaagcgcagcagccgccgcagcacatctctctctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaaggcgcagtgcccgatcgtcgagcgcctcacaaactccctcatgatgcacgggcgcaacaacggcaagaaggtcatggctgtccgcatcatcaagcataccctggagatcattcacctgctcaccgatgccaaccccatccaggtcgtcgtcgacgcgatcatcaacagtggaccccgtgaggatgccaccgtattgttccgctggtgttgnnaaggaaggcaagccgtggatatctcacccctgagggaggtggaaccaggccatctacctccntcaccactgtgnccaagggagagtgctttcccggaacatcaaaaaccattgcc

SEQ ID NO: 31545 - protein, 166 aa, Zea mays
  misc_feature: Ceres CLONE 1407905-F
  misc_feature (44)..(147): Pfam Name: Ribosomal_S7 Pfam Description: Ribosomal protein S7p/S5e
  misc_feature (128)..(128): Xaa is any aa, unknown, or other
  misc_feature (129)..(129): Xaa is any aa, unknown, or other
  misc_feature (153)..(153): Xaa is any aa, unknown, or other
MAEVEQQQDTPKLFNRWTFDDVQVNDISLNDYLAVNATKHAMYLPHTAGRYSKKRFRKAQCPIVERLTNSLMMHGRNNGKKVMAVRIIKHTLEIIHLLTDANPIQVVVDAIINSGPREDATVLFRWCXXGRQAVDISPLREVEPGHLPPSPLXPRESAFPEHQKPL

SEQ ID NO: 31546 - DNA, 661 bp, Zea mays
  misc_feature: Ceres CLONE 1407908-F
  misc_feature: Translation starting site: 159
  misc_feature (519)..(519): n is a, c, t, g, unknown, or other
  misc_feature (615)..(615): n is a, c, t, g, unknown, or other
  misc_feature (661)..(661): n is a, c, t, g, unknown, or other
aagctggagctccccgcggtggcggccgctctagaactagtggatcccccgggctgcaggaattcgcacgagaccattacctagaacatcctaatcgaaaaatcacacatattattgagaccaactagcaacatagaaagcacaatagtgtaccaacaatggcagccaaaatattttgcctccttatgctccttggtctttctgcaagtgctgctacggcgaccattttcccacaatgctcacaagctcctatagcttcccttcttccctcgtacctctcaccagcggtgtcttcggtatgtgaaaaccaattcttcaaccctacaggatccaacaggcaattgcagctggcatcttacctttatcacccttgttcctccaacatcatcagccctattacagcagttacctttggtgcatttattggcacaaaacatcagggcacaacaactacaacaacttgtgctagcaaaccttgctgcctactctcagcaacatcagtttcttccattcaccaanctagctgcattgaactctgctttctatttgcaacaacaacactaccattcagccagctatctgctgcctacccccagcaatttcttccattcaccnactgacagcattgaactctcctgcttattacagcagcaacaactan

SEQ ID NO: 31547 - DNA, 655 bp, Zea mays
  misc_feature: Ceres CLONE 1407909-F
  misc_feature (245)..(245): n is a, c, t, g, unknown, or other
  misc_feature (259)..(259): n is a, c, t, g, unknown, or other
  misc_feature (275)..(275): n is a, c, t, g, unknown, or other
aaagctggagctccccgcggtggcggccgctctagaatagtggatcccccgggctgcaggaattcgcacgagaccattacctagaacatcctaatcgaaaaaggaagtaggggctcccttctccagttctccttgcttgcgtcttcccggtcccgtctgcgtgcgtgcgatcgacgcagaggcgcgggcgctcgcaccaagccgatccgatgggcttcatgcgctcccgctcaaatgcatcttcntggcatggggagtngctccctaacatttanggaagaacgttttgccaaagctcccaaaatggaaaaagacatcccgaattgtttcttccaaatcgaaaaaagcaaaagcggtttttggggaaaaacagggcccccaccggaaggtttggtgttttctgggccctcttcccaaaaaaggacgcccaaatggccgtaagaaattttattttttgccccggggaaaaggggaaaaaaaaaaatttttttttttgggggggggcccccggaaaaaccccccaatcggggggaaaaggtttttctccccccccctagaagggcgccctaagaagtggggttcgcgggggttcccccaaaaaaaaaaaaggggggggcccccccctcccgagggggggatttttgttttttttttt

SEQ ID NO: 31548 - DNA, 693 bp, Zea mays
  misc_feature: Ceres CLONE 1407912-F
  misc_feature: Encodes the peptide sequence at SEQ ID NO. 31549
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (398)..(398): n is a, c, t, g, unknown, or other
  misc_feature (408)..(408): n is a, c, t, g, unknown, or other
  misc_feature (434)..(434): n is a, c, t, g, unknown, or other
  misc_feature (435)..(435): n is a, c, t, g, unknown, or other
  misc_feature (442)..(442): n is a, c, t, g, unknown, or other
  misc_feature (443)..(443): n is a, c, t, g, unknown, or other
  misc_feature (456)..(456): n is a, c, t, g, unknown, or other
  misc_feature (457)..(457): n is a, c, t, g, unknown, or other
  misc_feature (478)..(478): n is a, c, t, g, unknown, or other
  misc_feature (530)..(530): n is a, c, t, g, unknown, or other
  misc_feature (531)..(531): n is a, c, t, g, unknown, or other
  misc_feature (548)..(548): n is a, c, t, g, unknown, or other
  misc_feature (564)..(564): n is a, c, t, g, unknown, or other
  misc_feature (565)..(565): n is a, c, t, g, unknown, or other
aaagctggagctccccgcggtggcggccgctctagaactagtggatcccccgggctgcaggaattcgcacgagaccattacctagaacatcctaatcgaaaaagtaacaacattaatcacccactctactactcgaagttactaccagcagcttgcttcaacagtagaagagagcgagaggatggcgtcaccgaagccctcgtcggcggccctgctcctcctggcggcggcggccgtgctggcgctggcgcgcgcggacctgacgcacgacaactgcgtgaagaacaagaaggtgacggtgcagaacctgtgcagccacgacgtgacgctgacgcttggagccgctggcacnnnnccggcggctggtcgcgggcacctacacgctgcacccggcgagncacgcgaggntccccgtgggcttggtggaccggggnncctgggnngcgcccgacgcgnnccaggtggagtcccacggccnggggtcgagggggggtccttctaactgggccccaaacgggcagccgggcagnnggggtcccggtctccgnaaccccgcacgggtcnncccgttggagggcgttttcccccccccgtcggttgggccatccaggggcccgtggtccggggaccagtggcccaggggggactggcgaacgtccaagaagatgaaaatatctactggaaccggagggg

SEQ ID NO: 31549 - protein, 106 aa, Zea mays
  misc_feature: Ceres CLONE 1407912-F
  misc_feature (58)..(58): Xaa is any aa, unknown, or other
  misc_feature (73)..(73): Xaa is any aa, unknown, or other
  misc_feature (76)..(76): Xaa is any aa, unknown, or other
  misc_feature (85)..(85): Xaa is any aa, unknown, or other
  misc_feature (88)..(88): Xaa is any aa, unknown, or other
  misc_feature (92)..(92): Xaa is any aa, unknown, or other
MASPKPSSAALLLLAAAAVLALARADLTHDNCVKNKKVTVQNLCSHDVTLTLGAAGTXPAAGRGHLHAAPGEXREXPRGLGGPGXLGXARRXPGGVPRPGVEGGSF

SEQ ID NO: 31550 - DNA, 679 bp, Zea mays
  misc_feature: Ceres CLONE 1407915-F
  misc_feature: Translation starting site: 252
  misc_feature: SWISSPROT Homolog: EC 6.3.2.19 Ubiquitin--protein ligase
  misc_feature (12)..(12): n is a, c, t, g, unknown, or other
gctcaagaactngtgggtcccccgggctgcgggaattcgcacgagaccattacctagaacatcctaatcgaaaagattaaaataatacgcagcagccgattgcactcgaccaagagaagcaacgactgcatctctggtctcccacgcctataatcccattcccctccttcaaagccctgcggcgatttcgattcttcccttctatctccaggtatacccatcggagcagcactgacaaaaattctccagatatggcaagcaaaaggattcagaaggaactcatggatctccaaaaggacccacccgacatcatgcagtgcagggcctgctggagaggatctattccactggcagggcacaatcgtgggtcctagtgacagcccctatgcaggcggggttttctttattaatatccattttcctcctgactacccctttaagcctccaaaagtgaacttccaaacaaaggttatcacccaaacatcaactctaatggggagcattttgccttgatatcctcaaggagcaagggaggccctggactgaccatatcaaagggccctcctctccatccagttcggtcctcacccgaccccaaacccggaacaacccccttggccctggaaaatcgcccacgtggaacaaaaacccggaggcgacggcttccgaggaaagctgg

SEQ ID NO: 31551 - DNA, 754 bp, Zea mays
  misc_feature: Ceres CLONE 1407918-F
  misc_feature: Translation starting site: 225
  misc_feature: Pfam Name: PMSR Pfam Description: Peptide methionine sulfoxide reductase
  misc_feature: SWISSPROT Homolog: EC 1.8.4.11 Peptide-methionine-(S)-S-oxide reductase
  misc_feature (509)..(509): n is a, c, t, g, unknown, or other
  misc_feature (606)..(606): n is a, c, t, g, unknown, or other
atagctggagctccccgcggtggcggccgctctagaactagtggatcccccgggctgcaggaattcgcacgagaccattacctagaacatcctaatcgaaaagccatcagattgggagactcacttcactcactcgggagtcgggtcctcctcgactcagctcctccacaaacaaagccaccaccatcccaacccaaacacatcggccgaccacgggcgccgccatgtccaccgctgacgcggcgagcccggccctggcgccggactgggacgcgccggcgggcgaaggcctggccctggcccagttcgccgcgggctgcttctggagcgtggagctggtgtaccagcgcctcccaggcgtggcgcgcacggaggtggggtactcgcagggccaccgccacgcccccacctaccgcgacgtctgcggcaacggcacgggccacgaccgaggtggtccgcgtgcactacgaccccaaggcctgccccctacgacgtccctcctcgacgtncttctgggccaagcacaaccccaccacgctcaacagacggggcaacgacgtcgggacgcagtaaccgggtcgggcatctactactacaccgcagaancaggaaacgctggcgcgcgagatcctgggtgcgaaccagaaaggaggggcaggacgcgattcgtccacgagggtctggcggggggcgagggttctacccccgccggggagtacaaccggatgtacctcgagaaggggggggcagcccc

SEQ ID NO: 31552 - DNA, 733 bp, Zea mays
  misc_feature: Ceres CLONE 1407919-R
  misc_feature: Encodes the peptide sequence at SEQ ID NO. 31553
tgatcctttaagcccttgagagccccgtatatcctaaaaaaaaaaataagagccccccttttcaaatggggtccgggccccccctcgaggtcgacggtatcgataagcttttttttttttttttttgatgttcagccttcatgccctattttatatctttgttgatctaactggataaagacttggcctctactagcaggtctcctatgtaaaattccacgatagcaggacgaagcagccaccaactgtttaactggcacgagaaagaaaacttccccatacccttacacactacccaaaggcaaaattattctggagaggccaccctcacccaaaaaaagaagttttaatctaaaaaaaccgacctacttgtcccctcctttctcggcctgcgcgactgcgaggaaatcatccctctccaagttgtccggggccaattggccccaccggggacagcaaaaaaatcgcgtcttgtaccgtcgcccccttgtgccttaaaccacgaacacagccaaggtggagacacccaacatggccagcatctattataagaggtccagcctgcttctcccgaggttggtcccgatccacgtgcccaacccgggcaaggttcccatggcgactatgatgcaaccctccggaacgtcaaaaactccccgtttgaagcacgaccccggtaatcaagcccctccactccatggaaccttgaccccccactcgaggagggcccccc

SEQ ID NO: 31553 - protein, 67 aa, Zea mays
  misc_feature: Ceres CLONE 1407919-R
MASIYYKRSSLLLPRLVPIHVPNPGKVPMATMMQPSGTSKTPRLKHDPGNQAPPLHGTLTPHSRRAP

SEQ ID NO: 31554 - DNA, 665 bp, Zea mays
  misc_feature: Ceres CLONE 1407919-F
tccccgcggtggcggccgctctagaactagtggatcccccgggctgcaggaattcgcacgagaccattacctagaacatcctaatcgaaaagaactcacagcataatcgtatctgtcctcttacatcgccgtcgtcgctgccgcctcctcttggatatgctagccgcctcttctctgatgcaacccctgtactggacgagctacgcacacctgtagctgctgctacggcatggctacataggcgatctggagcacgtcaaggagcacacagctgcgaagactacggtgaagctgaacgcttcctgaataaaccggcggatattacgacaccgtatgatgtatgtgcaacgagatgaacctgtgcacggagatgattcatccatcgcgccagatgggctacatcgtgataatgacgacggatgtcattatggaccatgacctctcccactccaagaatgctaccgcagaagaccatattcatgcttacattgaacacgggtcgtcctcgacgacagatgcctcgacgacatcaagagatggccgttagctcaccatcgacatctccgccacaatcgccgccacgggcgtgagcttgctgacggtagacaccacgatgccgaacatgcttccgccgaactactgtaacacctgcgggacgcataaga

SEQ ID NO: 31555 - DNA, 759 bp, Zea mays
  misc_feature: Ceres CLONE 1407922-F
  misc_feature: Encodes the peptide sequence at SEQ ID NO. 31556
  misc_feature (348)..(348): n is a, c, t, g, unknown, or other
  misc_feature (351)..(351): n is a, c, t, g, unknown, or other
  misc_feature (417)..(417): n is a, c, t, g, unknown, or other
  misc_feature (452)..(452): n is a, c, t, g, unknown, or other
  misc_feature (499)..(499): n is a, c, t, g, unknown, or other
  misc_feature (526)..(526): n is a, c, t, g, unknown, or other
  misc_feature (532)..(532): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (746)..(746): n is a, c, t, g, unknown, or other
aaagctggagctccccgcggtggcggccgctctagaactagtggatcccccgggctgcaggaattcgcacgagaccattacctagaacatcctaatcgaaaagacgccgccccgttcgcctccgtcgccgccgccatcgccaccgccgaaccatggagaccacggagccgtcgcgtggcaccaagcgccctctcaccgccactgcaggcgatgacgacgatgctggcctggagcgcaagccgcggttccctaaggggaagaaggcaagtaccgcgacgtcggtgcggagggaggcccctctggcaacgctgtggacctcgacagcatgctgaatccggagcttgcgcnggngagcggcgggcgcggcagcgccacggccagctcaaggagggagacgacgcgaagggaggtgccgcntgaggtgagggggcttcgaagtccgctacaacgancagtgttaactttgttgacgatggtatacgggatagagccgtttaancttggagcgagaaaaggggaagaaggntatttncgatgagaatggggaactttgtggagtatgcaagaggcaatgagattaaggatgcttgggtggcannnggggggaaagttgacccaacatattgctgcaaggttcagaacaaaggcaaagagaaagtagaacgagtttgaagacctctcttccgatggacattgggaagctaaaaaggcagatagcaaacttgcttgagccaggagaaacgatnatgcagccttgaa

SEQ ID NO: 31556 - protein, 59 aa, Zea mays
  misc_feature: Ceres CLONE 1407922-F
METTEPSRGTKRPLTATAGDDDDAGLERKPRFPKGKKASTATSVRREAPLATLWTSTAC

SEQ ID NO: 31557 - DNA, 715 bp, Zea mays
  misc_feature: Ceres CLONE 1407925-F
  misc_feature: Encodes the peptide sequence at SEQ ID NO. 31558
  misc_feature (258)..(258): n is a, c, t, g, unknown, or other
  misc_feature (360)..(360): n is a, c, t, g, unknown, or other
  misc_feature (406)..(406): n is a, c, t, g, unknown, or other
tggagctccccgcggtggcggccgctctagaactagtggatcccccgggctgcaggaattcgcacgagaccattacctagaacatcctaatcgaaaacttcagtaatcagtgctcgctagcccaccacgccctgaacctagcccggacaccagccagaacaggccatgtccatgggctccccggtgcagctcaggcggctgaagcctctgtaccagttcgtggtgaacaacatcctggccatcgtggccgtgccgctncgccaccgcggtcctgctcaaggcgtcgtcgctcgggcccgaggagatcctggcgctccggccggcgcacctgttcctggccgcgttcctgcctgccgcggncacggtgctgtacctgatgctccggccgcgcacggtgtacctggtngactacgcgtgcttccgcaccagccccaactgccgcgtcccgttcgcgacgttcctggagcactcccgcgtgtggacgggcttcgacgagcgcagcgtccggttcatgacgcgcctgctggagcggtcggtgctccgagaggagacctgtctgccgtagcacacaaatacataccaccgtctcgggacctggagtcctcccgcgccgaggtcgaagtcagcattctctcgggcaaacgcggactggtccgacaaaacgctgttcccgccggtgactcgacctcctgcggaaaaactgcagcctgtccag

SEQ ID NO: 31558 - protein, 62 aa, Zea mays
  misc_feature: Ceres CLONE 1407925-F
  misc_feature: SWISSPROT Homolog: EC 2.3.1.119 Icosanoyl-CoA synthase
MLRPRTVYLVDYACFRTSPNCRVPFATFLEHSRVWTGFDERSVRFMTRLLERSVLREETCLP

SEQ ID NO: 31559 - DNA, 736 bp, Zea mays
  misc_feature: Ceres CLONE 1407927-F
  misc_feature: Encodes the peptide sequence at SEQ ID NO. 31560
tggagctccccgcggtggcggccgctctagaactagtggatcccccgggctgcaggaattcgcacgagaccattacctagaacatcctaatcaaaaacccagatctcatctgcgacgacctcctccctcccgatcccgctccgtctccccccaccgccaccgctgccgctgccgcctcccccaccgaggtcttgtcttcggcgatccagccggagcccgcggcggcgacgatgtacgggtgggagatgctgtcgttcaacatacacgatgggttcctggaggccatcgtgcggggcaaccgctcgggcctcctcaccgccgccgactacaacaacctctgccagtgcgagaccctcgacgacatcaagatgcacctcaccgccgccgagtacgggccctacctccagaacgaaccttcacccttgcacacaacgacatttgtggagaagtgcactcttaaactagtcgatgagtacaagcacatgctgtgccaggccactgaaccactatctacgtttttgcagtatataacttatgggcacatgagttgacaatgttgtccttattgtaactgggcactgcagggagagagatgttacgaacttttggagaaatgccacccattggggcatgtttgacagcatttgcatcacttgctgttgctcaaacatggcggggcttttaatagattgggttctaagcggatacacactgggcccttacgtctcagagggat

SEQ ID NO: 31560 - protein, 106 aa, Zea mays
  misc_feature: Ceres CLONE 1407927-F
  misc_feature: SWISSPROT Homolog: EC 3.6.3.14 H(+)-transporting two-sector ATPase
MYGWEMLSFNIHDGFLEAIVRGNRSGLLTAADYNNLCQCETLDDIKMHLTAAEYGPYLQNEPSPLHTTTFVEKCTLKLVDEYKHMLCQATEPLSTFLQYITYGHMS

SEQ ID NO: 31561 - DNA, 671 bp, Zea mays
  misc_feature: Ceres CLONE 1407928-F
  misc_feature: Encodes the peptide sequence at SEQ ID NO. 31562
  misc_feature (289)..(289): n is a, c, t, g, unknown, or other
cgcggtggcggccgctctagaactagtggatcccccgggctgcaggaattcgcacgagaccattacctagaacatcctaatcgaaaatagggtttctcgcgcggcgctccgctccccgccctcctccgctccgcgcccgatcgcctcttcatctacctcctcaaagcttcgactgttccacacccccacccatatcaacccctttcccctttagctccttcccaccgatacgcccgccgcgtgaagcattcgttagccgagccgccgcaaccatgtcgtcgttctgggngtgtggaagtgaagcccgggaagccctacactctcacccatggcgacttcgccggccgcctgcgcctcacccagggacgctaggggggttgatgtcggcaaggggggagaaggctaccggcgtgaaagaggtgtgtgcttacagtgcagtgcgaagaacagaggatcccgttttttctttgcgtcctcatggccggagcagtcggagacatgccacctggagctagaatttggaggaggaagtcaccttctcagtgattgggccaaggagcatccacctcgctggatactatatgactgatgcgtgtggggaagataggagtgacggtgattcttggagcgattctcttcaaagttatatgaggatggttccttgcaggaga

SEQ ID NO: 31562 - protein, 80 aa, Zea mays
  misc_feature: Ceres CLONE 1407928-F
  misc_feature (6)..(6): Xaa is any aa, unknown, or other
MSSFWXCGSEAREALHSHPWRLRRPPAPHPGTLGGLMSARGEKATGVKEVCAYSAVRRTEDPVFSLRPHGRSSRRHATWS

SEQ ID NO: 31563 - DNA, 656 bp, Zea mays
  misc_feature: Ceres CLONE 1407932-F
  misc_feature: Encodes the peptide sequence at SEQ ID NO. 31564
  misc_feature (341)..(341): n is a, c, t, g, unknown, or other
  misc_feature (394)..(394): n is a, c, t, g, unknown, or other
  misc_feature (440)..(440): n is a, c, t, g, unknown, or other
  misc_feature (441)..(441): n is a, c, t, g, unknown, or other
  misc_feature (593)..(593): n is a, c, t, g, unknown, or other
tggagctccccgcggtggcggccgctctagaactagtggatcccccgggctgcaggaattcgcacgagaccattacctagaacatcctaatcaaaaaaccatcaccgcctcgtgtgcagcgtgctcgcccacctcctctgtcgacactcagggtactgacgcaccaccccgaagccctcccgccgcgctcgcagggtgttcgacccttcgcccgcgcgccctcacgacatgcctcctccgtctccgccgccgccaaggccgccgcggcgttcgcgcacaaggtccagaaggagctggccgcgccggcgcagcgccgcgcgggcttgacccgccggaccagncgttgcagcgtgcgcgccgtcgcttcgcccgcgcgcgccctgtcgccaccggnctcggtgaagagcgcgatgacgatgacggagaaatactgggcgcgnncgtcggagcgcgcggcgctggagcccggggagaacgtgggggtcgacgtcgacgggctcatgaacgacgacgtctgcgggccccggggcttcgacatcttcagaaagaggtcggggaggacggcggggtctgggaccggaggaattcggcgnatcccgggcccacaactcttcccaggcgagggcggggccaaaggaaaggtgaaatccctcggg

SEQ ID NO: 31564 - protein, 82 aa, Zea mays
  misc_feature: Ceres CLONE 1407932-F
  misc_feature (11)..(11): Xaa is any aa, unknown, or other
MTMTEKYWARXSERAALEPGENVGVDVDGLMNDDVCGPRGFDIFRKRSGRTAGSGTGGIRRIPGPQLFPGEGGAKGKVKSLG

SEQ ID NO: 31565 - DNA, 681 bp, Zea mays
  misc_feature: Ceres CLONE 1407934-F
  misc_feature: Encodes the peptide sequence at SEQ ID NO. 31566
  misc_feature (358)..(358): n is a, c, t, g, unknown, or other
  misc_feature (368)..(368): n is a, c, t, g, unknown, or other
  misc_feature (399)..(399): n is a, c, t, g, unknown, or other
ctctagaactagtggatcccccgggctgcaggaattcgcacgagaccattacctagaacatcctaatcgaaaaaccagctttccccttctctccggtccgggaatcggaagctcagggcagaagccatggggcagacgcatcttttgttgctcgcttgtttctgggtcctgtcaacatgctccttgctacttgatgcttcctccgatggactgttaagaatcaacctgaacaagaagagactggacaaggaagctttgactgctgcgaaattggcgaagaaggagagccaccttcgaaggtctgtgggtgctgaccagtatctcagtgccctcactgatgacatagtccctttggacnactacctggnacaccagttactttggacagatcagcatcgncacgccaccacaggactttcacagggatattcgacactggaagctccaacttggtgggttccctcatcccagggctaactttccgaaaggggggctactttaccccacgaatacaagtcaaccaagtcgaagactaaccccaaaaaaggggaatctttgacgaaaaaatatggggtctggggaaatacgctgtgtttttccagggagaacaaagggttggtgtggaacccctggggtgggaaaatcaaatatttttgtggacaccccggaaacacccccatg

SEQ ID NO: 31566 - protein, 116 aa, Zea mays
  misc_feature: Ceres CLONE 1407934-F
  misc_feature (78)..(78): Xaa is any aa, unknown, or other
  misc_feature (81)..(81): Xaa is any aa, unknown, or other
MGQTHLLLLACFWVLSTCSLLLDASSDGLLRINLNKKRLDKEALTAAKLAKKESHLRRSVGADQYLSALTDDIVPLDXYLXHQLLWTDQHRHATTGLSQGYSTLEAPTWWVPSSQG

SEQ ID NO: 31567 - DNA, 725 bp, Zea mays
  misc_feature: Ceres CLONE 1407935-F
  misc_feature (266)..(266): n is a, c, t, g, unknown, or other
  misc_feature (267)..(267): n is a, c, t, g, unknown, or other
  misc_feature (292)..(292): n is a, c, t, g, unknown, or other
  misc_feature (306)..(306): n is a, c, t, g, unknown, or other
  misc_feature (368)..(368): n is a, c, t, g, unknown, or other
caaagctggagctccccgcggtggcggccgctctagaactagtggatcccccgggctgcaggaattcgcacgagaccattacctagaacatcctaaaaaaaaaggaattctggccttcttctctcatcttcctgctcaacatcagtagcagctttagctgtagcagcgccaccggccaccgccacgctatggccaccacgttgcacaagcccctgggggcgatcaccgttgacgacctcgccgcggcggcgccctgggtcggacgnncacgcgctccacgcagggctccggngcgcgctcgactcnacggaccccacgaagtgtgggcgagctctgccggccgtgctctggtcgtctgtccccttcgncggcaacggatgcttaattacggttggtttggcggggtcccggttccaaggcgccgcctgaaccccaaacccaagggaggtggtttgacaagggggcccggggccttaggggggggggaaaggaattttctcgggggggggaaagagaggtctcttaccgttttccaaaaccccaaaggtctccaaaaaaacccaagggggggggggaaggggtttttggggagatgggccctcactttggggggagcaccccccccctttgtgaaagaaaaaaaacacattattgggggggggggggggacacccccccgcccactcccccccctcgcttttttttgtgtgaccacccccacgcga

SEQ ID NO: 31568 - DNA, 763 bp, Zea mays
  misc_feature: Ceres CLONE 1407936-F
  misc_feature: Encodes the peptide sequence at SEQ ID NO. 31569
  misc_feature (309)..(309): n is a, c, t, g, unknown, or other
  misc_feature (323)..(323): n is a, c, t, g, unknown, or other
  misc_feature (358)..(358): n is a, c, t, g, unknown, or other
  misc_feature (388)..(388): n is a, c, t, g, unknown, or other
  misc_feature (396)..(396): n is a, c, t, g, unknown, or other
caaagctggagctccccgcggtggcggccgctctagaactagtggatcccccgggctgcaggaattcgcacgagaccattacctagaacatcctaatcgaaaaaggcaacacagcaatcagcagaaaaacatctccttggccttccatccatatgatccatccctccaggctccagctaactccaaactaccctctggttcgactcgcgttcgcatcgcaagcagcagcgtaccatcgaggcaatggcggtgatggccgaagtagtgtcgaccaccggcgcggcgctccggagcccggccacgcagcanccggcggcggcggncgcggcgaagggcaccgacgctgagaagctccagntcatcgaggacatgaccctccacgtggacnccgtgcangagcgcgtgcttgggggaaaatccttcgcccggaacgcggaacaccgagtaccctctcaagcaggtgggggcttcgcccggggttaaaggaccgggccaccttccgcggcaaagggccccataggggaaaataaaaggacctggaacccgaacattccgggaaattgccccaaagggaaacgctcgcccatcccgggggggggaacccgggggtctccaatttcccccccaatttccggaaattcgggggggaaaagggaaatctttggccccccttctggggaaagggtccacccccccccatttttgtaaaacccccccaaaaccccctttaaacccggaccgggccggggaatggaaaaaggga

SEQ ID NO: 31569 - protein, 79 aa, Zea mays
  misc_feature: Ceres CLONE 1407936-F
  misc_feature (22)..(22): Xaa is any aa, unknown, or other
  misc_feature (27)..(27): Xaa is any aa, unknown, or other
  misc_feature (39)..(39): Xaa is any aa, unknown, or other
  misc_feature (49)..(49): Xaa is any aa, unknown, or other
  misc_feature (51)..(51): Xaa is any aa, unknown, or other
MAVMAEVVSTTGAALRSPATQXPAAAXAAKGTDAEKLQXIEDMTLHVDXVXERVLGGKSFARNAEHRVPSQAGGGFARG

SEQ ID NO: 31570 - DNA, 649 bp, Zea mays
  misc_feature: Ceres CLONE 1407937-F
  misc_feature: Encodes the peptide sequence at SEQ ID NO. 31571
  misc_feature (305)..(305): n is a, c, t, g, unknown, or other
  misc_feature (446)..(446): n is a, c, t, g, unknown, or other
  misc_feature (452)..(452): n is a, c, t, g, unknown, or other
tccccgcggtggcggccgctctagaactagtggatcccccgggctgcaggaattcgcacgagaccattacctagaacatcctaatcgaaaaatgtaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactggggggcctcgcggtcccatcctgctggaggactaccacctgantcgagaaggtggcgcacttcgcgcgcgagcgcatcccgggagcgcgtggtgcacgcgcgcggggcctccgccaaggctttcttcgaggcacccacgacgtgaccgtcgctgacgtgcgccgacttcctgcgcgcgcccggngtgcgnacgccccgtgatcgtgcgctcctcgacggtgtcccccgagcgggggtccccggaagagatcccggacccgggggggtttcccgtggaattctacccccgcgggggaaactgggaccctgctgggaaacaacttcccccgtcttcttcatcccgcgagggatccggttccccgacgtgatccccgtcgttaaggccca

SEQ ID NO: 31571 - protein, 84 aa, Zea mays
  misc_feature: Ceres CLONE 1407937-F
  misc_feature: SWISSPROT Homolog: EC 1.11.1.6 Catalase
  misc_feature (48)..(48): Xaa is any aa, unknown, or other
MDPTKFRPSSSHDTTVTTTNAGAPVWNDNEALTGGPRGPILLEDYHLXREGGALRARAHPGSAWCTRAGPPPRLSSRHPRRDRR

SEQ ID NO: 31572 - DNA, 735 bp, Zea mays
  misc_feature: Ceres CLONE 1407943-F
  misc_feature: Encodes the peptide sequence at SEQ ID NO. 31573
  misc_feature (515)..(515): n is a, c, t, g, unknown, or other
  misc_feature (516)..(516): n is a, c, t, g, unknown, or other
  misc_feature (586)..(586): n is a, c, t, g, unknown, or other
  misc_feature (606)..(606): n is a, c, t, g, unknown, or other
  misc_feature (615)..(615): n is a, c, t, g, unknown, or other
  misc_feature (628)..(628): n is a, c, t, g, unknown, or other
  misc_feature (629)..(629): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (681)..(681): n is a, c, t, g, unknown, or other
  misc_feature (703)..(703): n is a, c, t, g, unknown, or other
  misc_feature (735)..(735): n is a, c, t, g, unknown, or other
aaagctggagctccccgcggtggcggccgctctagaactagtggatcccccgggctgcaggaattcgcacgagaccattacctagaacatcctaatcaaaaatcgctctctcctttgcacccctagctagctagtactactgctgctcctccgacttgctcttcgcgcagcaggacggagaaacaagaaccatccctccccctaccggctaccgctgctactcatggtcgcgcgcactgcctcctggtgccgccgcgtatgatccagacatgaatagggcgcacagcagcagctcccagctcatcaacgagaagctcgtggaacaccggatctccactgcgaagcactgcccccactgcggcgagaaaatcgacagcaaaccggattgggtggggctgccggcaggcgtcaagttcgatccaactgaccaggagctgatcgagcacctcgaggcgaaagtgaaggatgaaggctcgagatctcacccctctcatcgacgagttctacccacatannatggggggaggacggcatatgttacacccaccccgagaaacttccaggtgtggacaagggatggcctaangcagcacttctttcacgggncgtccaggnctacacgacgggnncggggaaaaaaggaggagattcgacnnnnngatgcgcgttcacaaagggggnaaaacgaggtggcacagacgcnaagacccgcccccgtggatggtgacggccccn

SEQ ID NO: 31573 - protein, 155 aa, Zea mays
  misc_feature: Ceres CLONE 1407943-F
  misc_feature (82)..(82): Xaa is any aa, unknown, or other
  misc_feature (83)..(83): Xaa is any aa, unknown, or other
  misc_feature (106)..(106): Xaa is any aa, unknown, or other
  misc_feature (113)..(113): Xaa is any aa, unknown, or other
  misc_feature (116)..(116): Xaa is any aa, unknown, or other
  misc_feature (120)..(120): Xaa is any aa, unknown, or other
  misc_feature (129)..(129): Xaa is any aa, unknown, or other
  misc_feature (130)..(130): Xaa is any aa, unknown, or other
  misc_feature (138)..(138): Xaa is any aa, unknown, or other
  misc_feature (145)..(145): Xaa is any aa, unknown, or other
MNRAHSSSSQLINEKLVEHRISTAKHCPHCGEKIDSKPDWVGLPAGVKFDPTDQELIEHLEAKVKDEGSRSHPSHRRVLPTXXGGRTAYVTPTPRNFQVWTRDGLXQHFFHGXSRXTRRXRGKKEEIRXXDARSQRGXNEVAQTXRPAPVDGDGP

SEQ ID NO: 31574 - DNA, 701 bp, Zea mays
  misc_feature: Ceres CLONE 1407945-F
  misc_feature: Encodes the peptide sequence at SEQ ID NO. 31575
  misc_feature (412)..(412): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (520)..(520): n is a, c, t, g, unknown, or other
  misc_feature (521)..(521): n is a, c, t, g, unknown, or other
aaagctggagctccccgcggtggcggccgctctagaactagtggatcccccgggctgcaggaattcgcacgagaccattacctagaacatcctaatcgaaaaatccgctcgtccttcagccgctcccaaccctagccacgcaggaactcacagccccgccgctcctcgcctccatcccaccctcttgttccccactttgcgttgtgccacgacgctccgggcatgcatggaggccgcaatagatccaggagatcgcttgggggcggcgggcaggcaaaggaggtcactcgctgggtttgctagcgtgggggacactagtgcgacagcttgtacaaggcgacgagactgcacggcgtgctcctggaggtggcgcatgtgcccttcctcaaggaccgctatgcactgtgcctgncagctcgagtgcatccagttcggcatcattcgctcctgctccgacctcgtcacggggnnnaaggcgttgtggccctgcaagtccatcgccaagccccaacatcgcgcnnctcaaagccggggtacgaggaccgcgcgattccgtgcacctcatcatgaactctgcggcccgtgggggggggaggctcttcccatcgcctgcagggagcgcgactgcttctccgaaacggagagagagtcctcccaatggagaggcaaaatacgaaccgggaaaattgtgaccatatttt

SEQ ID NO: 31575 - protein, 158 aa, Zea mays
  misc_feature: Ceres CLONE 1407945-F
  misc_feature (62)..(62): Xaa is any aa, unknown, or other
  misc_feature (82)..(82): Xaa is any aa, unknown, or other
  misc_feature (99)..(99): Xaa is any aa, unknown, or other
MEAAIDPGDRLGAAGRQRRSLAGFASVGDTSATACTRRRDCTACSWRWRMCPSSRTAMHCAXQLECIQFGIIRSCSDLVTGXKALWPCKSIAKPQHRAXQSRGTRTARFRAPHHELCGPWGGEALPIACRERDCFSETERESSQWRGKIRTGKIVTIF

SEQ ID NO: 31576 - DNA, 692 bp, Zea mays
  misc_feature: Ceres CLONE 1407946-F
  misc_feature (437)..(437): n is a, c, t, g, unknown, or other
tccccgcggtggcggccgctctagaactagtggatcccccgggctgcaggaattcgcacgagaccattacctagaacatcctaatcgaaaagtccctccactcctcccgtcgagcacttggcactgccaatggcggcagccgcccacaccccttcgatgcgcgcaagccgcctcctttcctcctgagatcgacgcacctcctcctctcgtactccattcccgctccaagttcgtttcttcggcaccgagccatcgcacggccgcccccgcatctcgtcctgctctcaggtccttggcctccgccgttcttcgacaggggcgcgccccggtgcccactccgcgaaatccgagtcccttgtgcagctccgtaagggtggaagagatccatcaggcggtgagcggtaggaggcgcccgtacaactggaggggacgggcanatggcgggccgtggcaggcccactctgcacgtggtcggtcgcccgcgtgcttggtctgcggtttgcgaccgcagaagagtacaagcagaagcattgctgccccggcgaaagcggggcttggggggccggcgtcttggttcgggcctgcgccgccgcctcgggagcgcgggggggtcccggcttgggcggctctgggagggggctataggctggtggccttacaggcttgaaaagaagtgtcatttgaaaagaaga

SEQ ID NO: 31577 - DNA, 660 bp, Zea mays
  misc_feature: Ceres CLONE 1407950-F
  misc_feature: Translation starting site: 227
  misc_feature: SWISSPROT Homolog: EC 3.6.3.14 H(+)-transporting two-sector ATPase
  misc_feature (391)..(391): n is a, c, t, g, unknown, or other
tccccgcggtggcggccgctctagaactagtggatcccccgggctgcaggaattcgcacgagaccattacctgaacatcctaatcgaaaaataatttcgtcttcttccctctcccaccggtgtcctcgcctcgcctatccgatctgccacctcgccgtctcgcacgttcctttccccaactccccagcgcctctccgcgccgcgatccagatccaggttgttcagcatgggtctggtgaaggaaggcgtcgacatggaggagggaaccctagagatcggcatggagtacaggactgtatctgggtgtggacgggcctctggttatcttggataaagtaaagggcccaaagtaccaagaaattgtaaacatccgaacttggagatggcaccnctcgccgaggtcaagtccttgaagttgatggagaaaaagctgttgtgcaggcttttgaaggaacttctggaatagacaacaaatacacaaccgtgcagtttacaggcgaggcctggtgctacggtgagagctgtctcactgagtcacgaggtcacgggatcgaaacagtctctccgcatttgcggaagaaggcttgggctgggtttattccttccctaaaaccccactcatgggggaagcccctggaaaggggccttcccctttttacg

SEQ ID NO: 31578 - DNA, 763 bp, Zea mays
  misc_feature: Ceres CLONE 1407952-F
  misc_feature: Encodes the peptide sequence at SEQ ID NO. 31579
  misc_feature (288)..(288): n is a, c, t, g, unknown, or other
  misc_feature (347)..(347): n is a, c, t, g, unknown, or other
  misc_feature (392)..(392): n is a, c, t, g, unknown, or other
  misc_feature (510)..(510): n is a, c, t, g, unknown, or other
  misc_feature (518)..(518): n is a, c, t, g, unknown, or other
  misc_feature (523)..(523): n is a, c, t, g, unknown, or other
  misc_feature (674)..(674): n is a, c, t, g, unknown, or other
aaagctggagctccccgcggtggcggccgctctagaactagtggatcccccgggctgcaggaattcgcacgagaccattacctagaacatcctaatcgaaaaaattccccattcaccaatccccagtattgtagtaggggggaaaaacgagagaaaagaaacagcagtagcggaggcaagacgaaatggtggccgccgtcgcgtcgccttcgtcggcggcaccctccgccggccgtccccatccgacatacaaggagatgatcatgcaggcgctgacggagctgcggnacccgagcgggtcgagccgcagcgccatcgccagctacatcgccgaccacttctccggnctccactcgcgccacgatgccctcctctccgtccatctccgcagnctcaagtcccatggccaacttcgcctcgtctctggcaactacttcgtctccaccgccgctcagggggaggggggcgaaggttccaacatcccgcccaaccccaaccctgctccggggnagaagcgntgggnccgggggcggccttcgcaagtacgcagattcagccccttccctttgaaacccgggggttttcaggggccaaagggggggggggggggaccccccacgcaaacgccagagcgccaagggaaccgggtggttttcctcccccctccccttcgncgctacaggggaagcaagtggtccgccgcctcctctggggcacaaaaagaaggggggggggaccccctctcgaagggacccccttgtcc

SEQ ID NO: 31579 - protein, 168 aa, Zea mays
  misc_feature: Ceres CLONE 1407952-F
  misc_feature (1)..(63): Pfam Name: Linker_histone Pfam Description: linker histone H1 and H5 family
  misc_feature (11)..(11): Xaa is any aa, unknown, or other
  misc_feature (45)..(45): Xaa is any aa, unknown, or other
  misc_feature (85)..(85): Xaa is any aa, unknown, or other
  misc_feature (89)..(89): Xaa is any aa, unknown, or other
MIMQALTELRXPSGSSRSAIASYIADHFSGLHSRHDALLSVHLRXLKSHGQLRLVSGNYFVSTAAQGEGGEGSNIPPNPNPAPGXKRWXRGRPSQVRRFSPFPLKPGGFQGPKGGGGGPPTQTPERQGNRVVFLPPPLRRYRGSKWSAASSGAQKEGGGDPLSKGPPC

SEQ ID NO: 31580 - DNA, 783 bp, Zea mays
  misc_feature: Ceres CLONE 1407953-F
  misc_feature: Encodes the peptide sequence at SEQ ID NO. 31581
  misc_feature (428)..(428): n is a, c, t, g, unknown, or other
  misc_feature (500)..(500): n is a, c, t, g, unknown, or other
  misc_feature (501)..(501): n is a, c, t, g, unknown, or other
  misc_feature (538)..(538): n is a, c, t, g, unknown, or other
  misc_feature (633)..(633): n is a, c, t, g, unknown, or other
  misc_feature (650)..(650): n is a, c, t, g, unknown, or other
  misc_feature (767)..(767): n is a, c, t, g, unknown, or other
  misc_feature (768)..(768): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
aaagctggagctccccgcggtggcggccgctctagaactagtggatcccccgggctgcaggaattcgcacgagaccattacctagaacatcctaatcgaaaaactcgtctcatctcttccatacgaccataccctacctccaaattcccaattctcaacctctcctccgagttcgagtgaccatgtcggggcgcggaaagggcgggaaggggctgggcaagggcggcgcgaagcgtcaccgcaaggtcctccgcgacaacatccagggcattacgaagccggcgatccggaggctggcgagaaggggtggcgtgaagcgcatctcggggctcatctacgaggagacccgcggcgtgctcaagatcttcctcgagaacgtcattcgcgacgctgtcacctacacggagcacgcccgccgcaagaccgtncaccgccatggacgtcgtctacgcgctcaagcggcagggccgcaccctctacggatttggcggctgaggggnntcaggggtgtcccccagctggctgctggccgttgcanaagtctttggggtcgcggtcacgaaaatggagtggaggcgagagtattcttgcccatggtgcttaaagtttcgtaggcttatcactctagactcnttagtgcctggggtccnagtagtagcaatacgactttgactgggcatttttccttgttctgacctctaaaaaatgggggggggggaggggggattcaccttgatctcaaaaaaaaaaaaaaaagctatcgtacnnggggnnncnnngggg

SEQ ID NO: 31581 - protein, 143 aa, Zea mays
  misc_feature: Ceres CLONE 1407953-F
  misc_feature (25)..(90): Pfam Name: Histone Pfam Description: Core histone H2A/H2B/H3/H4
  misc_feature (107)..(107): Xaa is any aa, unknown, or other
  misc_feature (119)..(119): Xaa is any aa, unknown, or other
MSGRGKGGKGLGKGGAKRHRKVLRDNIQGITKPAIRRLARRGGVKRISGLIYEETRGVLKIFLENVIRDAVTYTEHARRKTVHRHGRRLRAQAAGPHPLRIWRLRGXRGVPQLAAGRCXSLWGRGHENGVEARVFLPMVLKVS

SEQ ID NO: 31582 - DNA, 666 bp, Zea mays
  misc_feature: Ceres CLONE 1407954-F
  misc_feature (286)..(286): n is a, c, t, g, unknown, or other
  misc_feature (380)..(380): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (548)..(548): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (565)..(565): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (628)..(628): n is a, c, t, g, unknown, or other
  misc_feature (631)..(631): n is a, c, t, g, unknown, or other
  misc_feature (632)..(632): n is a, c, t, g, unknown, or other
  misc_feature (642)..(642): n is a, c, t, g, unknown, or other
  misc_feature (652)..(652): n is a, c, t, g, unknown, or other
  misc_feature (659)..(659): n is a, c, t, g, unknown, or other
tccccgcggtggcggccgctctagaactagtggatcccccgggctgcaggaattcgcacgagaccattacctagaacatcctaatcgaaaaatccgactaaaaagggccagggccagggccttcgcttgcttactactcctgcttaccacactctaccttgtctcttcacgtgcacacgacgcctcccccaatggctgcggtggggaggaaggaagtgatcgtcgtcggcgcggggcagcgggggctagcggatgcgggtgtgcctggccctgccacgggtggggnggctggtcctggaccccacgactgcctggattgccattgcccctatgggaccctaaaccgcctccacacccccctccacgcggaaggatggcgnggttgnnnnnnggggccccccggcccgggcccccttggtgcttaaaccctttcccttttcggcgggcccctggaagggtggcccccccagaaatttctccctaccccctccttcccccgttaccccccctcgggttaggnnnnnnccccnnnnnnnnngcgnnnnngncnnncccccattggggngggnnnnnnccccnnncnnnnnnnnncnnnnnnnnnnnnnnnnnnnnnntannnnnnnncccnccnnccccccctcncccccctacnctccgcnccccccc

SEQ ID NO: 31583 - DNA, 745 bp, Zea mays
  misc_feature: Ceres CLONE 1407959-F
  misc_feature: Encodes the peptide sequence at SEQ ID NO. 31584
  misc_feature (609)..(609): n is a, c, t, g, unknown, or other
caaagctggagctccccgcggtggcggccgctctagaactagtggatcccccgggctgcaggaattcgcacgagaccattacctagaacatcctaatcgaaaaatcgaacccccgccaccaccagtccagcagcaccaggccagacaggcacacctcgaagaacaagagctggtcctcctggtaataagcgagagagagagagaggccaatggcagccaagtggtggctcgtcgcctccctgctgctctgcctcgccgtcgcatcggcggcggcaagagcaacgccccgcgactgcgacactactgccgccttcgcggcgggcgacggcagtgccggcgccgtggacgaggacgacgagcaggacaagaccgccgacgtgttcggtgagcgaaccgtcggcgtgggcctcttcggcgacgtccacggcccgctgggcgctgctgacgctgtgttcgagccgctcggtggcgacgccgccgatgcgtttcccatgggagtcttcgatggcgtcgtagcccatcggtgagggagttccaacccatgctttccgaacagctcaatgtccttctctgcattgaaatgttctaaccctaacatcctcatccccnatgaaaatgtactcctatcttgggaacaacgggcgtgatgcaaaaaccggtgttggggaccaaccattttggtttggttccctggaactccacaggaatggcttttttttaaacccctcaaagttcttcccccttc

SEQ ID NO: 31584 - protein, 105 aa, Zea mays
  misc_feature: Ceres CLONE 1407959-F
MAAKWWLVASLLLCLAVASAAARATPRDCDTTAAFAAGDGSAGAVDEDDEQDKTADVFGERTVGVGLFGDVHGPLGAADAVFEPLGGDAADAFPMGVFDGVVAHR

SEQ ID NO: 31585 - DNA, 670 bp, Zea mays
  misc_feature: Ceres CLONE 1407961-F
  misc_feature: Encodes the peptide sequence at SEQ ID NO. 31586
  misc_feature (220)..(220): n is a, c, t, g, unknown, or other
  misc_feature (233)..(233): n is a, c, t, g, unknown, or other
  misc_feature (234)..(234): n is a, c, t, g, unknown, or other
  misc_feature (294)..(294): n is a, c, t, g, unknown, or other
  misc_feature (309)..(309): n is a, c, t, g, unknown, or other
  misc_feature (312)..(312): n is a, c, t, g, unknown, or other
aaaagctgggagctccaccgcggtggcggccgctctagaactagtggatcccccgggctgcaggaattcgcacgagaccattacctagaacatcctaatcgaaaaagagctccaatggccgccgctctcccgcactcccgcctccacctcccgctccacacgcccagtcccacctcccgccgccgcccctgcccccgttcccgccgccgccttccctccnttcgtcgcccggnntcctcccgccgccctccagaacaccaccgccgcgacccacccggtcctcccgcccccggntccgcccccctccgncgngctcctcgccgcgaggggcctccctcgcgccgcgcgagagcacgcttcccagctcggtccctccccacaagcacgctctgctctaacgagcggagacgcgtctgctcggcctcagtgggcggcgcccccccaagggtcctgccgctcggggggaaagggggcctgactaataacccagggggaagggcccttgggacccctttttaaacccaaaaaaggggaacccctgtttcccatgggtcaaaccgggaagaggaaaaaaaaacccccttggggttttaagggtttaaaaatcttgattcccccaaaaaatttttgggggttggggttttgaaaaaaaaaaaaaaaaattttttta

SEQ ID NO: 31586 - protein, 134 aa, Zea mays
  misc_feature: Ceres CLONE 1407961-F
  misc_feature (36)..(36): Xaa is any aa, unknown, or other
  misc_feature (40)..(40): Xaa is any aa, unknown, or other
MAAALPHSRLHLPLHTPSPTSRRRPCPRSRRRLPSXRRPXSSRRPPEHHRRDPPGPPAPGSAPLRRAPRREGPPSRRARARFPARSLPTSTLCSNERRRVCSASVGGAPPRVLPLGGKGGLTNNPGGRALGTPF

SEQ ID NO: 31587 - DNA, 714 bp, Zea mays
  misc_feature: Ceres CLONE 1407962-F
  misc_feature: Encodes the peptide sequence at SEQ ID NO. 31588
tccccgcggtggcggccgctctagaactagtggatcccccgggctgcaggaattcgcacgagaccattacctagaacatcctaatcgaaaaacaccatcatcacactcgaaacccaacagcttccttcctggcgatccaattaacggcttctcttctgagctcagcacgaacaatggccaccatcctcaccgtcgcaagcttcttcgcacttgtgtgcatctctcaacaagcgcgggctgcgaactacacgttcatgaaggacgcggtgcacgcgccgcggacgggcttctacgactacatcatagtcggcggcggcacggcgggctgcccgctggcggccaccctgtcggcccgcgcgcgggtgctgctgctggagcgcgggggctctccgtacgaggacgcgcgcgtcctgaacatgccactttctcggacgtgctggcggacacggtcggcgtcgtccgctcgcaaaacggttcttggtcggaaaaaaacggcgttgatcaactccccccccgcggggggttggggccgccagtaagctgcaatccaacgcccggcttcttcacgcgcggcccggggcggggctacgtccaggggcccccccggctggaaaccccccgagagggggggggggaggctcctgacccttggtaccaaggaaagaaacgtgtttatccgtcgcccaccctgctcctagacccgggggatctcgg

SEQ ID NO: 31588 - protein, 121 aa, Zea mays
  misc_feature: Ceres CLONE 1407962-F
  misc_feature: SWISSPROT Homolog: EC 4.1.2.10 Mandelonitrile lyase
MATILTVASFFALVCISQQARAANYTFMKDAVHAPRTGFYDYIIVGGGTAGCPLAATLSARARVLLLERGGSPYEDARVLNMPLSRTCWRTRSASSARKTVLGRKKTALINSPPAGGWGRQ

SEQ ID NO: 31589 - DNA, 701 bp, Zea mays
  misc_feature: Ceres CLONE 1407967-F
  misc_feature: Translation starting site: 215
tacccgcggtggcggccgctctagaactagtggatcccccgggctgcaggaattcgcacgagaccattacctagaacatcctaatcgaaaaattccagtcttttcagaacgagattgcatcgaggaaactacagaaaagggaccaaatcgaatccgtggtgcactgcccctccccctccctcacaagccgccgccgccgtgaggactccggcgaatggcgtcccgcgtcgcctcgggcctcctccgccgccgcgccgtcgccactctagggctactaaggagtcatacacatgtcagaaactacagcagtcaactttcagctttgattccagctacttctcaatgctcaaatctgacaagaagacgctattacttacctaatccatctctgtaccaagtttggagtaggtcatttgcctcagacagcggagacaagttcgaggctgttgtgcccttcatgggtgaatctgtaactgatggaactcttgctaacttcttaaaaaacctggagacagagtcgaggccgatgaaccatagcgcagattgaaactgaataagtcactataaatgtcgcaagtcttgaagtgggtgtaattgaaaagctcattgctagggaaggcgaaccattactccaggaactaaagtggaatcaaatccaagtctggtcaacttgttgaaaaaatgttgctccatctgaggaa

SEQ ID NO: 31590 - DNA, 605 bp, Zea mays
  misc_feature: Ceres CLONE 1407971-F
  misc_feature: Encodes the peptide sequence at SEQ ID NO. 31591
  misc_feature (305)..(305): n is a, c, t, g, unknown, or other
  misc_feature (342)..(342): n is a, c, t, g, unknown, or other
  misc_feature (348)..(348): n is a, c, t, g, unknown, or other
  misc_feature (370)..(370): n is a, c, t, g, unknown, or other
tctgaactagtggatcccccgggctgcaggaattcgcacgagaccattacctagaacatcctaatcgaaaaatgaccgactagcccatggtctctctccgctccgacgcgcccgacccaccaccacatccctcatggctgccctcgccgacatcgactcctcggcacttccgccgtccgagtcatccaaaggcaagggcaagatggacaaggaggaggaggacgaggcgaagggcgcggagaagatgtgcggcatctgctatctcgacggccggcgggccatccgcggcgagctcgactgctgcngcccatttcttttttgcttgctgatcatggcttgggncgggcnagtccgctgcccttctggaggnccgtttcaaacatcgccgccgcccgttccggcgtttcccaagaggaatcgcttcatcaacagggaaacaggaaaccatctccggggaaaggggaacacaagggggggggaattttacgggaaccatatggcccggttgtggggctccccggaagaaaaaagtggttatctcctggggttttggagcacctgggggaccccattggggggggggggggggcccccccgccacaagg

SEQ ID NO: 31591 - protein, 157 aa, Zea mays
  misc_feature: Ceres CLONE 1407971-F
  misc_feature (58)..(58): Xaa is any aa, unknown, or other
  misc_feature (70)..(70): Xaa is any aa, unknown, or other
  misc_feature (72)..(72): Xaa is any aa, unknown, or other
MAALADIDSSALPPSESSKGKGKMDKEEEDEAKGAEKMCGICYLDGRRAIRGELDCCXPFLFCLLIMAWXGXVRCPSGGPFQTSPPPVPAFPKRNRFINRETGNHLRGKGNTRGGEFYGNHMARLWGSPEEKSGYLLGFWSTWGTPLGGGGGPPRHK

SEQ ID NO: 31592 - DNA, 757 bp, Zea mays
  misc_feature: Ceres CLONE 1407972-F
  misc_feature: Encodes the peptide sequence at SEQ ID NO. 31593
  misc_feature (541)..(541): n is a, c, t, g, unknown, or other
  misc_feature (572)..(572): n is a, c, t, g, unknown, or other
  misc_feature (631)..(631): n is a, c, t, g, unknown, or other
  misc_feature (632)..(632): n is a, c, t, g, unknown, or other
  misc_feature (680)..(680): n is a, c, t, g, unknown, or other
  misc_feature (719)..(719): n is a, c, t, g, unknown, or other
  misc_feature (723)..(723): n is a, c, t, g, unknown, or other
caaagctggagctccccgcggtggcggccgctctagaactagtggatcccccgggctgcaggaattcgcacgagaccattacctagaacatcctaatcgaaaattcgaaacctccgccccgtcgcataaacccctcctcgcctcctccgcccgagcctgcctcctcatcgacttatacgcctccttctcttaactcgacgcactagcctcagccaattgtcgcatttcgtcgctatggggtccacagcggccgtctccgtctccgcctcggcgatcgcgtcccgcggctgcgccagatccgaggctgcgcggcggccaggtggaatccgggtctgcggactccggagcgaggccctcacgtgtcactcgcttcggatctcgcaggcgcccgcgaggctgacggtggcgaggccgccgccgccggcggcggcgaccaatggcgcggcggcggggacctgcgggttcgactacgatctcgtcatcatcggcgcgggcgtcgggggtcacggcgccgcgctgcacgccgttgaagagggcttanaacagaatattggaggaagaaggttgtgggnttggaacttgtgtaaaaaggaggctgtgtcccatcgaaagcgcttctggctgtcagcgnntcgaatgcgggagcttcatgatgacattcatatgaaaggctttggggntctacagggtttcctcttcttggaatgaacagacaaagntggnttgctgatcatggcaaacaatcctggcctcggaa

SEQ ID NO: 31593 - protein, 157 aa, Zea mays
  misc_feature: Ceres CLONE 1407972-F
  misc_feature (103)..(103): Xaa is any aa, unknown, or other
  misc_feature (113)..(113): Xaa is any aa, unknown, or other
  misc_feature (133)..(133): Xaa is any aa, unknown, or other
  misc_feature (149)..(149): Xaa is any aa, unknown, or other
MGSTAAVSVSASAIASRGCARSEAARRPGGIRVCGLRSEALTCHSLRISQAPARLTVARPPPPAAATNGAAAGTCGFDYDLVIIGAGVGGHGAALHAVEEGLXQNIGGRRLWXWNLCKKEAVSHRKRFWLSAXRMRELHDDIHMKGFGXLQGFLFLE

SEQ ID NO: 31594 - DNA, 696 bp, Zea mays
  misc_feature: Ceres CLONE 1407984-F
  misc_feature: Pfam Name: Glyco_transf_5 Pfam Description: Starch synthase catalytic domain
  misc_feature: SWISSPROT Homolog: EC 2.4.1.21 Starch synthase
  misc_feature (271)..(271): n is a, c, t, g, unknown, or other
  misc_feature (317)..(317): n is a, c, t, g, unknown, or other
  misc_feature (348)..(348): n is a, c, t, g, unknown, or other
  misc_feature (349)..(349): n is a, c, t, g, unknown, or other
  misc_feature (397)..(397): n is a, c, t, g, unknown, or other
  misc_feature (521)..(521): n is a, c, t, g, unknown, or other
  misc_feature (535)..(535): n is a, c, t, g, unknown, or other
  misc_feature (539)..(539): n is a, c, t, g, unknown, or other
ggagctccccgcggtggcggccgctctagaactagtggatcccccgggctgcaggaattcgcacgagaccattacctagaacatcctaatcaaaaaaataatccagtattccaggcgttcttccctctccctcctttgctatttttctgctgctcctccacctcttctgttatgtttggtgaagggctgaaggtaagaagctgggaacgtgcagcaaggctgcaaaaacatgtccattaatccagtcagggttcccttggatgcatatatngatggactttgtcttctctgagtcagaaggtggaatatatgacaantaggaatgggatggactatcatattcctggnntctggattctgttgcaagggaacctccaatgcatattgaacacattgncagtggaatggtccttaatcgcgaaagtcggaggccttgggggtgatgttgttacaagccttttcacgagctgttccaagattaagccatttaaagtttgaggttattctgcgaaaaatatgantgtttaaaccttancaanggtgaaggatttacgctaccaacaaattttttacttgggggtgcacaaagataaaaagtatgggtttggaaaaggttgaaaatctccctgtttaattcttggaacccaaaatgggaatggtttggggttgggagggtcctaccgaaagaaggataaa

SEQ ID NO: 31595 - DNA, 717 bp, Zea mays
  misc_feature: Ceres CLONE 1407985-F
  misc_feature (361)..(361): n is a, c, t, g, unknown, or other
  misc_feature (442)..(442): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
aaagctggagctccccgcggtggcggccgctctagaactagtggatcccccgggctgcaggaattcgcacgagaccattacctagaacatcctaatcgaaaagtcaagctttcctcatgaactcgaacaaggaacgcagaaggcgtcctcgactactgcctatggtcgccgtccgcatctagcctgggatggttgtctcctgatccacgacctaccagggcgtagagtcatagccgccgctgttgcgtcaggaaataactgcaagccgaagactgagagcgagcgcaaagtacccaggttatcgctttctatttcgctttctttttcagcgagggagagcattaaggatgccggttgctangcacgagccgcaggagccccgggtgatcaccatgtcgacatgcactgcatctatcgtcagacaactacctgaagagcccgntgatcagtcacagcgacgtcctgcccatcatacggttggaaagagctgatagatgccacaatacaagggtcgggattcgagggaaaagccctggcctgaagccagcccaaagttcgcaggtgttacctttggacggcccccccgctccgggaaaggtgaccctagctttacaaaagttgggggtttgttctccaaattcccccgggggggaggctccgcggnnnnnnnnnnnnnnnnnnnnnnnnnnnnnnnnnnnnnnnnnnnnnnnnnnnnnn

SEQ ID NO: 31596 - DNA, 732 bp, Zea mays
  misc_feature: Ceres CLONE 1407986-F
  misc_feature (187)..(187): n is a, c, t, g, unknown, or other
  misc_feature (229)..(229): n is a, c, t, g, unknown, or other
  misc_feature (338)..(338): n is a, c, t, g, unknown, or other
  misc_feature (339)..(339): n is a, c, t, g, unknown, or other
  misc_feature (397)..(397): n is a, c, t, g, unknown, or other
  misc_feature (436)..(436): n is a, c, t, g, unknown, or other
  misc_feature (448)..(448): n is a, c, t, g, unknown, or other
  misc_feature (488)..(488): n is a, c, t, g, unknown, or other
  misc_feature (493)..(493): n is a, c, t, g, unknown, or other
  misc_feature (528)..(528): n is a, c, t, g, unknown, or other
  misc_feature (529)..(529): n is a, c, t, g, unknown, or other
  misc_feature (577)..(577): n is a, c, t, g, unknown, or other
aaagctggagctccccgcggtggcggccgctctagaactagtggatcccccgggctgcaggaattcgcacgagaccattacctagaacatcctaatcgaaaaatgctgggaccgcgggtgtgggatagggacggatgacaaagcaagagcagaaaaaagaactttcaccatcctccctatcaatacnagattcatctacacaaattataatatactccgtgcgaagganagatcaaattagagattcattcgatcaattctgattgtttccttccattccaaaccaccttcaattctgatttctgcgggtgtgggatatcgtccccccttggcattcnnaatctcctctgcaattttctcatggcagctgacgtttccatcccactcgatccgcgtncaccgcccgctaattcccctctagtctagtcccctctcntctggcgcgacncatctttttcctcgtgtcactcccctgctgctgctgctgncgggnaagatcaaatcccgtcaaaaggctcaaagggatcnnaggttctgtcaagatggcatggcccaagaggaaagaacccatttcccntttggtttctttctgatgatttgcctaaggggtcaacctgggagttttccaatggtggactcatggcgaaaacataacctttgcctttggaaagatttcaaagcacttttaccccccagggggaaggtctagggggaaaagggcgtttttttatt

SEQ ID NO: 31597 - DNA, 725 bp, Zea mays
  misc_feature: Ceres CLONE 1407987-F
  misc_feature: Encodes the peptide sequence at SEQ ID NO. 31598
  misc_feature (468)..(468): n is a, c, t, g, unknown, or other
  misc_feature (573)..(573): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
tggagctccccgcggtggcggccgctctagaactagtggatcccccgggctgcaggaattcgcacgagaccattacctagaacatcctaatcgaaaagactcccgtgctctctctctctctctctctcggatccgaattgccagcgcaccagtcgagctcgcgggaactcgccggcaccggcgatggcctccgccctactggccggacagggcggggcgcgccaccacggctggggggagacgcgcgccccactcgcgcccatacctcccaaccctaaccccagccagccccacccgcgcgccgacgggtccaagtccaagccgcgggcggcagcctcctcgccggcggccggatacgtgacgttccgcccggcgtccctgggcccgcgcgaggaccgcgcgctccgggaccgcctcgcggaggagctcacccaggtgcgggccctcctctcccgaatggaacctggnacagcagggccgccgcccgggggctccgggcgaggggcaaacggggcgccaaatcccccagctgccagggaagggggggggtaaacgacgggaggggggcggccnttcccctcccgcgcagccggggnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnn

SEQ ID NO: 31598 - protein, 122 aa, Zea mays
  misc_feature: Ceres CLONE 1407987-F
MASALLAGQGGARHHGWGETRAPLAPIPPNPNPSQPHPRADGSKSKPRAAASSPAAGYVTFRPASLGPREDRALRDRLAEELTQVRALLSRMEPGTAGPPPGGSGRGANGAPNPPAAREGGG

SEQ ID NO: 31599 - DNA, 658 bp, Zea mays
  misc_feature: Ceres CLONE 1407992-F
  misc_feature: Translation starting site: 234
  misc_feature: SWISSPROT Homolog: EC 2.3.1.41 Beta-ketoacyl-acyl-carrier-protein synthase I
  misc_feature (455)..(455): n is a, c, t, g, unknown, or other
  misc_feature (465)..(465): n is a, c, t, g, unknown, or other
  misc_feature (567)..(567): n is a, c, t, g, unknown, or other
  misc_feature (620)..(620): n is a, c, t, g, unknown, or other
aaagctggagctccccgcggtggcggccgctctagaactagtggatcccccgggctgcaggaattcgcacgagaccattacctagaacatcctaatcgaaaatcgcagccagcaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggcggaatctcccgggacgcctctccgtccgcgcctccgcgacggtggtagcggcaccgcggcgggagacggatcccaagaagcgggtggtgatcacgggggatggggctgggtctccgttttcgggaacgatgtagacgcttactacgaccgcctgctagtcngggagagcgncatcgggcccatcgaccgcttcgaacgcttctaagtccccacccgctttgcggtcagaaatcgggcttctcttccgaggaatactcgacggaaagacgacgncgcccctgatgattgcctcgaactgcatcgcagggggcagaagctctcgaggncctcgtatcgccacggctcagcccttggaaaaatgaaa

SEQ ID NO: 31600 - DNA, 681 bp, Zea mays
  misc_feature: Ceres CLONE 1407993-F
  misc_feature: Encodes the peptide sequence at SEQ ID NO. 31601
  misc_feature (496)..(496): n is a, c, t, g, unknown, or other
tccccgcggtggcggccgctctagaactagtggatcccccgggctgcaggaattcgcacgagaccattacctagaacatcctaatcgaaaagtcgcctcatcaattcaagatccaatctttgctgctgccactcggcgatccgatcgttctcgagcaaggtcggtggccatggcacgctgccgccatcacctcctcctcctttccgtcttacttgccttggctgctgctgctgcgcggcaggcgcagagtcatggaaaagcctccgccgtcttcatcgatgcctcgtcgcaccgctaccttcgggaccagcaagccgaccaccaggacgcttcaatgtcgttaaatgaagtttctgcgggttgtttctgtctttgcttggtttcgcaccgtcaacatccctaccagctatccctttcttcgaggtttgaacaaagttcttcttcctaatccattgaatagaccgccgtgctgttttcctcggcagaaatgatgggnttcaatggtcctagcttcgtatctgaaggcaggaacattttcaagaccaggaattgaaggggcaaacatcgctgatacagggctgacagataaggatgacttaatgggcattcattcagatgaatctctagatctctctcgatcagaatatcttgataatggactttccgcttgggaactgggtc

SEQ ID NO: 31601 - protein, 92 aa, Zea mays
  misc_feature: Ceres CLONE 1407993-F
MARCRHHLLLLSVLLALAAAAARQAQSHGKASAVFIDASSHRYLRDQQADHQDASMSLNEVSAGCFCLCLVSHRQHPYQLSLSSRFEQSSSS

SEQ ID NO: 31602 - DNA, 753 bp, Zea mays
  misc_feature: Ceres CLONE 1407996-F
  misc_feature: Translation starting site: 295
  misc_feature (625)..(625): n is a, c, t, g, unknown, or other
  misc_feature (626)..(626): n is a, c, t, g, unknown, or other
  misc_feature (647)..(647): n is a, c, t, g, unknown, or other
  misc_feature (651)..(651): n is a, c, t, g, unknown, or other
  misc_feature (702)..(702): n is a, c, t, g, unknown, or other
aaagctggagctccccgcggtggcggccgctctagaactagtggatcccccgggctgcaggaattcgcacgagaccattacctagaacatcctaatcgaaaagtccgccccccgccaccaccgcactcccatccagatgggagtgcgcaagaggagctttcggcattccggtctcgctcgaccaaccggatccccgtgagagtccccacccacaccccgagggcggcgtcgggtcgtcggggacagctgatttcacaagacgagccggcgagccggccggcatttcgtcgtcggatggcgccggcctcctcctcgtccgccggcgtcgcgtgcctcgtcctgctcctgctcctgctcctcgccggcgcctccgcggcgcacggctcgttccaggctaggcgtgctctgtcagatgaccatgggagcggtatagtggcgcgatgggcggaggttgctcgccgacgctgcgactccagcgaacaactctcttgtgctggctgcggcgaggactcaccggagcgaccccttcgccaaccttacccgcgtacagcggcggctggaacattagcgacgagcactactggggcttcgtgagggaacaccgcggtgccctcttcctcatggnnccgggctggtggttcgtccgntttncggcggcgtcatgctccgcatctcctgctgctgctgctgcttctggcgggncaagaagacgctaacctcggcggggtgctacctcagctccctgtgcttctc

SEQ ID NO: 31603 - DNA, 749 bp, Zea mays
  misc_feature: Ceres CLONE 1407998-F
  misc_feature: Encodes the peptide sequence at SEQ ID NO. 31604
  misc_feature (623)..(623): n is a, c, t, g, unknown, or other
aaagctggagctccccgcggtggcggccgctctagaactagtggatcccccgggctgcaggaattcgcacgagaccattacctagaacatcctaatcgaaaagctgcgccaaatctcgcttccaacttctccggcccggtgtgctccgcaggctccacctccgcgtcctctcaagtctcaaacgctcaaggtctcaccggagaccgcgccgcgccccgcgggcttctggtagctcgggatggcctccgggggctcggccgcacgtgacgcgtacgatgaggaggacgccgtccgccgccccctcgagctcgatagccgtgacgccgccgcctcgtcctccgaccactggcccggtgggaatgccatgcctaggtatcaagtgggcttgacaaaggatgattcaagtagtagacactctgagtggcggcagcctagcacagatgatgtgcgcaagagcaagctcgggccagatacttcacggcgtttggccgtggatctgtcccctgataatatggcaggtggcattgtctatttggtgcaagggggttctgggtcttgcacggcttgctgtgagcttttacttaaagatatctccctctagatcccgctgaaaccgcaggggnatctgggtttctcgccctggccggggttcatcaagcccccctttggcttttatcagggattcctttccactctttgaaaatcgaaggagggtcctactttttttcggcagggttaactgaaacact

SEQ ID NO: 31604 - protein, 120 aa, Zea mays
  misc_feature: Ceres CLONE 1407998-F
MASGGSAARDAYDEEDAVRRPLELDSRDAAASSSDHWPGGNAMPRYQVGLTKDDSSSRHSEWRQPSTDDVRKSKLGPDTSRRLAVDLSPDNMAGGIVYLVQGGSGSCTACCELLLKDISL

SEQ ID NO: 31605 - DNA, 724 bp, Zea mays
  misc_feature: Ceres CLONE 1408002-F
  misc_feature: SWISSPROT Homolog: EC 1.3.5.1 Succinate dehydrogenase (ubiquinone)
  misc_feature (383)..(383): n is a, c, t, g, unknown, or other
  misc_feature (724)..(724): n is a, c, t, g, unknown, or other
aaagctggagctccccgcggtggcggccgctctagaactagtggatcccccgggctgcaggaattcgcacgagaccattacctagaacatcctaatcgaaaaatccaatacccccacgaacccactctctctccccacgatggcaaaaatggtgatggcgtactcccggctcccggctctcctctgcctcgccgccgtcgccggcgccgtcgcggcggaggccgccgccgctgcaggagaagggggtctccgtctgccccgctatcccacgttcccgtggcctacggcggggcggatcatacctacgactcaccgccggcgtagggagaaggagacggtctccgtcgcggaagtcgactactcgaccaccgattcaacagcgngagcatcaccaagctcttgcccacgtgctcgcacaccgtcgagcctcagggagcgataaatgctgcacttggaaacatgactgaagatgactgaacgtgtcatatgtatgacactgttatggcaagcgattgtctggatgaccaggattctatcggtatatgtgaagaggagcaccaaaagctgttatagaggctagataactatgccctaccattttcgagaactgaagagggaaagatatacccacgtggcttttggagggcaataccttaaatttttggcaaaggggacaagccctaccggtgtgcctgcgctgctgaaagaaaagacttgctatgcn

SEQ ID NO: 31606 - DNA, 700 bp, Zea mays
  misc_feature: Ceres CLONE 1408005-F
  misc_feature (308)..(308): n is a, c, t, g, unknown, or other
cgcggtggcggccgctctagaactagtggatcccccgggctgcaggaattcgcacgagaccattacctagaacatcctaatcgaaaaacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagccgggtcgagggtacggcggaaccgctacaagggtgcggtnttgaaccgggaagaaggcccggcggtggcgcgaggacaatatgggcgggaaatccgccaggggccggccctggaagaaaacctccctcaagaggggcgcccggagagggctccccaggcccagggtcccctgggccctccccccccggggggggagaaaaaaagggttggaaagcctcctcaatattgggataaaggggggtgtcatatggggggaaggaagaaaaacctgtagaggcgaggggccccacaaccagtgtccccacaatgtgggtctcccaaaaggagacgggcccccccctctcgataaagggttgagggcaagggggtggggagccggcgaaggttggggcgctgcctccccccccgggagggggaactccctctcgctcc

SEQ ID NO: 31607 - DNA, 655 bp, Zea mays
  misc_feature: Ceres CLONE 1408007-F
  misc_feature: Encodes the peptide sequence at SEQ ID NO. 31608
  misc_feature (611)..(611): n is a, c, t, g, unknown, or other
  misc_feature (613)..(613): n is a, c, t, g, unknown, or other
tccccgcggtggcggccgctctagaactagtggatcccccgggctgcaggaattcgcacgagaccattacctagaacatcctaatcgaaaacattgaatttggccgagtaacagaaccgtgtctgtttttaattcctgacggttagagatggcccacccctccgccgccgccgtatcctccacggcgctcgctgcaaaccctagctctggcgccagcgaggaaggaggcgcccgctctccgccgtcgccgtctcagagggggcgggccaaggtggtgatcgttatgggcgccacgggcgccggcaagtcgcggctggtcgtcgacctcgcggcccacttcgcgcgtgtcgaggagatctgcgacggctggatgttgctataccgtggcgtccaccgactgacagcaaaggtacctgcctcgaggaaaaggggccacccacggccaccgaggggattttcccccgcgaaaacgcccttggcgaggtttcagcctccgggaatggcaaaaatatggaaaaattggactggcctggctgccggggtttccagcggggcccactggggagggggggctcccgctgcaccccccccccaacgcaggggccggaagncngtgtggggtctctcccacaaacacacgccctgcgggggaccg

SEQ ID NO: 31608 - protein, 169 aa, Zea mays
  misc_feature: Ceres CLONE 1408007-F
  misc_feature: SWISSPROT Homolog: EC 2.5.1.8 tRNA isopentenyltransferase
  misc_feature (155)..(155): Xaa is any aa, unknown, or other
MAHPSAAAVSSTALAANPSSGASEEGGARSPPSPSQRGRAKVVIVMGATGAGKSRLVVDLAAHFARVEEICDGWMLLYRGVHRLTAKVPASRKRGHPRPPRGFSPAKTPLARFQPPGMAKIWKNWTGLAAGVSSGAHWGGGAPAAPPPQRRGRKXVWGLSHKHTPCGGP

SEQ ID NO: 31609 - DNA, 633 bp, Zea mays
  misc_feature: Ceres CLONE 1408008-F
  misc_feature (212)..(212): n is a, c, t, g, unknown, or other
  misc_feature (303)..(303): n is a, c, t, g, unknown, or other
  misc_feature (351)..(351): n is a, c, t, g, unknown, or other
  misc_feature (570)..(570): n is a, c, t, g, unknown, or other
  misc_feature (610)..(610): n is a, c, t, g, unknown, or other
tccccgcggtggcggccgctctagaactagtggatcccccgggctgcaggaattcgcacgagaccattacctagaacatcctaatcgaaaaaagcaaattgcatttcaagtcttttgggtttatacagcacagataaaggcggcagcggcagcagcagagcagcctaccttttcccctctccacctcccgcaagcaaactcacggtcacggnaccgtccccgcacccactgccctctagcttcttcctccccgctttcatggcaggaaagggctgagcgatgatgcccataggccatcccagnttggatcatggcatcctggaactctatacatactgccccagcccgggnaactcgggatctctacttctctaccggccgctggggctggggtaagtcctctctctggctctggtttcgggttttgcctcactcagcctgctgcaagtttttgtttttggggtaaaggggggtctttttgagtccctttaaagggcccccccccattttccttcggttttggcacggaaacgaaaaagctcctggctttaccctttcgggactatcccncccgaaggggaaatatgttttggggggggggaaagggggnaaaagtgtttggcgcccccccgg

SEQ ID NO: 31610 - DNA, 767 bp, Zea mays
  misc_feature: Ceres CLONE 1408012-F
  misc_feature (33)..(33): n is a, c, t, g, unknown, or other
  misc_feature (444)..(444): n is a, c, t, g, unknown, or other
aatatacccaaaaccgctccacgctacaaaagnaaataaggctgcggcgggtcaaacctgctactccccgcggtggcggccgctctagaactagtggatcccccgggctgcaggaattcgcacgagaccattacctagaacatcctaatcgaaaaatgaacagcaaagcaagggccgaatagtataggcctgttccctcactccccagattccccttttcatagctctatatacctctccttctcgtcgtctctctatcccgcatctgctgttctttatttctatacatacatatatactatcaccggttatttgcttctctattctgtccgagtactttacggtgttccgcacatagatctcgtggccggcggttttgcgctttcgcttgcgtttcttggccctgctggtgtttgaccggaccgaacgggggcagatcgatgnctttgggtttgaagcggagctcctatcattccaatgaagggccgttccgaaaagggttggttccgctgctccgttcatggttcccactatcctatctcatcatggtgtatatatggaatccatgggggggggaggggacacaccccgcgccggtaagataaacgccaagccgggccccgccgctggaaccaggcagcggtgggtagaccgaaactccgctgggtggcatacgcatcacgactccgctaatcgcgggtaaaaatgggacggcacgggacggagggcaacggagagggcggcagatcgcgcggtgaccggaaagg

SEQ ID NO: 31611 - DNA, 689 bp, Zea mays
  misc_feature: Ceres CLONE 1408013-F
  misc_feature: Encodes the peptide sequence at SEQ ID NO. 31612
  misc_feature (398)..(398): n is a, c, t, g, unknown, or other
acccgcggtggcggccgctctagaactagtggatcccccgggctgcaggaattcgcacgagaccattacctagaacatcctaatcgaaaaacaactcacaattcacatcgaggtctcagcttcaggaaagggaaggaagcatgttcgggcaccaccaccaccacggccacggcgggcaccaccaggccccgccgccgcacgagcagacgctgttcaggatcttctgccgcgccgacgaggcgtactgcctcaccgtgcgccacgacgccgtcgtcctcgcgcccaccaacccccgcgacgagtaccagcactggtacaaggacatgaggcacagcacgaaggtgaagggacgcggagggccaggccggcggtcgcgctcatcaacagggcccaccggnctcgccatcaagcattcggctcggcagtcccatcccgggggaagctggtgccctatccacgcggagtacctgtgagccagtcccgtggctgtgggaccgaaaaacccccacggggggcaaggggcttcccgctggattccgggatggtccaacaacatccaacttcaacttcgacggctttccacgggcgacagggaccccgggggggggttgcacgaacgcacccaccgggggtggtctgggggaaggggggggaaaggggccccaacccaaaacttggggagggttttc

SEQ ID NO: 31612 - protein, 110 aa, Zea mays
  misc_feature: Ceres CLONE 1408013-F
MFGHHHHHGHGGHHQAPPPHEQTLFRIFCRADEAYCLTVRHDAVVLAPTNPRDEYQHWYKDMRHSTKVKGRGGPGRRSRSSTGPTGLAIKHSARQSHPGGSWCPIHAEYL

SEQ ID NO: 31613 - DNA, 669 bp, Zea mays
  misc_feature: Ceres CLONE 1408016-F
  misc_feature: Encodes the peptide sequence at SEQ ID NO. 31614
tccccgcggtggcggccgctctagaactagtggatcccccgggctgcaggaattcgcacgagaccattacctagaacatcctaatcaaaaaaaagcgaacctcgccgccgcctcttccgtctctctcatctccgtcctcctgcaatctcacccctccctctaaacccgcaggccgcagtagcgccgctacggtttgctcaggattcgaaccccaccttctgattgctccgaatccgagaagtttgcggcatggcggggtacccggaggacaaccagcacgcgttgaacgggtacgacgatgaggaggtcgacgaggaggggcaccccgggcggcggggaggtcgggatggggcgtctgggtacggcgatgctggcggagaggatgtgaggggggcgggcggcgactcatcggggaagatttttgtcggaggcgttgcttgggagacaactgaagaatcattctccaagcattttgagaagtatggggcaataactgattctgtaattatgaaggacaagcatactaagatgcctcgtggatttggattcgttacattttctgatccatctgttatagacaaggttttggaggatgaacacgttatagatggcagaacggtggaagtcaagaggacagttccgagggaagagatgaataccaaagatggc

SEQ ID NO: 31614 - protein, 140 aa, Zea mays
  misc_feature: Ceres CLONE 1408016-F
  misc_feature (57)..(126): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAGYPEDNQHALNGYDDEEVDEEGHPGRRGGRDGASGYGDAGGEDVRGAGGDSSGKIFVGGVAWETTEESFSKHFEKYGAITDSVIMKDKHTKMPRGFGFVTFSDPSVIDKVLEDEHVIDGRTVEVKRTVPREEMNTKDG

SEQ ID NO: 31615 - DNA, 659 bp, Zea mays
  misc_feature: Ceres CLONE 1408020-F
  misc_feature: Encodes the peptide sequence at SEQ ID NO. 31616
aagctggagctccccgcggtggcggccgctctagaactagtggatcccccgggctgcaggaattcgcacgagaccattacctagaacatcctaatcaaaaaccgaaccaaacaacacacgtcaaagcggaaaacctcagaaaaccacaataaatcatcctcgtccaccactgcccccgctctgctgcaactccactcggcccggccgccctttccacccaccttgatcctctgatccgttggtgcttgaccgatccatggacacccatatcggatccgtgaacggggcggcgtcgaaccagacggttggctgcccggcgtcggcgccggggtgcccgatggcgtccacgccggcgcagcccgcggcgaccctgtcggcgggggaggcgtcgctggggcgccacctcgcgcgtcgcctcgtgcaggtcggcgtcaacgatgtattcgcgggtccgggggacttcaacctcacgctgctcgaccacctgatcgccgagcccggcctgcgcctcgtcggctgctggcacgagctcaacgccgggtacgccgccgacgggtacgcgcgcgcgcgcggcgtcagagcctgcgccgtcaacttcacagtcggggggctcagcgtgctcaacgccatcgcggacgccaacaggaaaaacctgcccg

SEQ ID NO: 31616 - protein, 134 aa, Zea mays
  misc_feature: Ceres CLONE 1408020-F
  misc_feature (44)..(134): Pfam Name: TPP_enzyme_N Pfam Description: Thiamine pyrophosphate enzyme, N-terminal TPP binding domain
  misc_feature: SWISSPROT Homolog: EC 4.1.1.1 Pyruvate decarboxylase
MDTHIGSVNGAASNQTVGCPASAPGCPMASTPAQPAATLSAGEASLGRHLARRLVQVGVNDVFAGPGDFNLTLLDHLIAEPGLRLVGCWHELNAGYAADGYARARGVRACAVNFTVGGLSVLNAIADANRKNLP

SEQ ID NO: 31617 - DNA, 660 bp, Zea mays
  misc_feature: Ceres CLONE 1408027-F
  misc_feature: Translation starting site: 156
  misc_feature (425)..(425): n is a, c, t, g, unknown, or other
  misc_feature (537)..(537): n is a, c, t, g, unknown, or other
  misc_feature (660)..(660): n is a, c, t, g, unknown, or other
cgcggtggcggccgctctagaactagtggatcccccgggctgcaggaattcgcacgagaccattacctagaacatcctaatcgaaaaaatccactccactccatcatcccgtgcctcacgagtcacgagtcactccaggtccaggctgagcagcaatggcgccgcgaacgctcggcttcaacgcggccccgctcctccagattctgcggtccctgtgcctcctggccctcgccgcggcggcggcggtgtccgggcggcgccacggggcctccccggcgcgcggcagcgggcagagcatgtacctggcgccggcctgccgggcgcacacggcgtcggtggcggacttcggcggcgtgggcgacggcaccacttccaacaccgcggcgttcccggtccgcggtggaccacctgtcgcagtactcggncgagggcggcggcggtggcatgctgtacgtgccccgggcaagtggctgacgggccccttcaactgaccagccacttcaccctctacctcaccaagacgccgtcatcctcggntcccaggacgtaggcgagggcccaatcgtggatccctgccttccttacggaagagggagggacaagtccggagggaggttcgttagcctcatcgggggatcgaactggaccggagtattctcn

SEQ ID NO: 31618 - DNA, 646 bp, Zea mays
  misc_feature: Ceres CLONE 1408032-F
  misc_feature: Encodes the peptide sequence at SEQ ID NO. 31619
  misc_feature (509)..(509): n is a, c, t, g, unknown, or other
  misc_feature (560)..(560): n is a, c, t, g, unknown, or other
cgcggtggcggccgctctagaactagtggatcccccgggctgcaggaattcgcacgagaccattacctagaacatcctaatcgaaaaccctgttcctcctgtcatctcctcctcctcagaaacccaccaaccccgtccagccgccggctgtctcggccgtcgccgccgccgccgccgccctatcccggtccttcaggtgaaccaggttggccatggccttcaacaagatcaaggtcgccaaccccatcgtcgagatggacggcgatgagatgaccagggtgttctggaaatctatcaaggacaatgtaattggaacgtggctgactctatctccgtcgcccttagatgttgcttcctgtgctcttgttccttgagaggaccatcttttcccccggtttgctgggatgttaaattgttgattgaatttcgtgcagcttatattccctttcgtagacctcgacatcaaatattttgacctcgggcttccacaccgtgatgctaccgacgancaagtcacagtggagggctgcggaggcacactcaagtaaagaattggacgntactatcacttctttaagaaagctggggatgggaagcaagcccagaaaaagagtgttggtgggtttcagtgttatttattatcaac

SEQ ID NO: 31619 - protein, 53 aa, Zea mays
  misc_feature: Ceres CLONE 1408032-F
  misc_feature: SWISSPROT Homolog: EC 1.1.1.42 Isocitrate dehydrogenase (NADP(+))
MAFNKIKVANPIVEMDGDEMTRVFWKSIKDNVIGTWLTLSPSPLDVASCALVP

SEQ ID NO: 31620 - DNA, 691 bp, Zea mays
  misc_feature: Ceres CLONE 1408037-F
  misc_feature: Translation starting site: 178
  misc_feature (403)..(403): n is a, c, t, g, unknown, or other
  misc_feature (404)..(404): n is a, c, t, g, unknown, or other
tccccgcggtggcggccgctctagaactagtggatcccccgggctgcaggaattcgcacgagaccattacctagaacatcctaatcaaaaacatttcctctctctctttctctaactccgggtccctctctcctctctctattctctccatccttgcttctgggaagctcatcagccatggacgatgccactgcagaggaagaagcttccatgttcgagaccagccatgtcctcggcgccctgctggcctcctcgccgttgctggcgcgcgcctgggaccgctgcacagccgcctccgccgcagcgccgtggttcgttcacggcgaagaacgcggcaaggtgtacgtggggttctctggggtgcaggctgcgcttaccgcggcaggcgccggcggtggccggnnggcgcgccaacatcttcccgccgtgagatctccgcggggacccgggggagaggaatggtcccgcccttggtctcccgccaaagccccacccggccgtctaccggggaacccctttgccccggaaggcccttgggcttgtaatggtttcctgaaaattctggtggggggctggattttcccaagcggtttgggaaacaaatcaggggcaaagggggtccctggtcctcacagcccctccctcttgtgggggggcgcgtaggcgtccccaccagcggtcatcctctcct

SEQ ID NO: 31621 - DNA, 672 bp, Zea mays
  misc_feature: Ceres CLONE 1408038-F
  misc_feature: Encodes the peptide sequence at SEQ ID NO. 31622
  misc_feature (553)..(553): n is a, c, t, g, unknown, or other
  misc_feature (622)..(622): n is a, c, t, g, unknown, or other
ggagctccccgcggtggcggccgctctagaactagtggatcccccgggctgcaggaattcgcacgagaccattacctagaacatcctaatcgaaaaacacacgcgggcgcgctagctagtgagagtcggagatgtcgtcgccgcggccacacttcctcgtgctcaccttccctttccagggccacatcgccccggctctccgcctcgccaggcagctgctcgcggcggcgcccgacgcgctcgtgaccttctccaccaccgaggtcgcgcacaggcgcatgttcccggcaaagcccaacgacggcgccaaggactccgacgaagacggccgcctcgagttcctcccgttctccgacggcacggaggccgggtacgtccggagcgccgacctgggctcgttcaacgcctacatgacgtctttccacgccgcgggggcgcgcagcgccgcggagatcgggacggtcctcgcggggggcgggcccgccccgtgttcccgcgtcgtgtacacgctgctcctccccgtgggcggccgacgtcgcgcgggaaccgcggnatcccgtccgcgctctactggatccagccgggtctccgtgttcgccatctaccaccactacttcccggncacggcccggcgtcgtcgccgaccacttcacgacccgtcggtttcggcgg

SEQ ID NO: 31622 - protein, 180 aa, Zea mays
  misc_feature: Ceres CLONE 1408038-F
  misc_feature (141)..(141): Xaa is any aa, unknown, or other
  misc_feature (164)..(164): Xaa is any aa, unknown, or other
MSSPRPHFLVLTFPFQGHIAPALRLARQLLAAAPDALVTFSTTEVAHRRMFPAKPNDGAKDSDEDGRLEFLPFSDGTEAGYVRSADLGSFNAYMTSFHAAGARSAAEIGTVLAGGGPAPCSRVVYTLLLPVGGRRRAGTAXSRPRSTGSSRVSVFAIYHHYFPXTARRRRRPLHDPSVSA

SEQ ID NO: 31623 - DNA, 658 bp, Zea mays
  misc_feature: Ceres CLONE 1408041-F
  misc_feature (361)..(361): n is a, c, t, g, unknown, or other
  misc_feature (401)..(401): n is a, c, t, g, unknown, or other
  misc_feature (627)..(627): n is a, c, t, g, unknown, or other
ggcggccgctctagaactagtggatcccccgggctgcaggaattcgcacgagaccattacctagaacatcctaatcgaaaaattcccttccttccttgctcctcccctgcctcgcctctctctctcccctctcctcgcctccagctcctgctcggcccgctcgcgtcgagctgcgcgcgcgcctgcggtggtcgtgaaggacagcccgagggacgcgccgggtgcactgatctgggggccgcgtgtccccggtggtggggcgaggcggcgccggcttccaggaatgggcaacttgtagcgtcggtttcttttgcatatgcacttttctattgttgttgtcatttcaaaggaggccatagtnctcctgggattttgtatgccttgttatctgggaattgggnaccatagatgtcattccgtagcatagtccgtgatggttaggggatggctttggcagcttgtcgaggagaagctttgaggtgaccctcgcaagcatttatggccttactgggcatcacaaagggaagacccagagctcatcacatgttctcgacgactcaccttcctaaattcgtggaaagtcgatgggcgaatctacctcctgaactcatccgtgatatcatacgnaaactggaggttgatgaaagcacctggccag

SEQ ID NO: 31624 - DNA, 645 bp, Zea mays
  misc_feature: Ceres CLONE 1408042-F
  misc_feature: Encodes the peptide sequence at SEQ ID NO. 31625
  misc_feature (330)..(330): n is a, c, t, g, unknown, or other
  misc_feature (588)..(588): n is a, c, t, g, unknown, or other
  misc_feature (589)..(589): n is a, c, t, g, unknown, or other
  misc_feature (599)..(599): n is a, c, t, g, unknown, or other
  misc_feature (603)..(603): n is a, c, t, g, unknown, or other
gctctagaactagtggatcccccgggctgcaggaattcgcacgagaccattacctagaacatcctaatcgaaaaaatccactccactccatcatcccgtgcctcacgagtcacgagtcactccaggtccaggctgagcagcaatggcgccgcgaacgctcggcttcaacgcggccccgctcctccagattctgcggtccctgtgcctcctggccctcgccgcggcggcggcggtgtccgggcggcgccacggggcctccccggcgcgcggcagcgggcagagcatgtacctggcgccggcctgccgggcgcacacggcgtcggtggcggnacttcggcggcgtgggcgacggcaccacttccaacaccggcggcgtccccgggtccgcggtggacaccctgtcgcagtactcgggcgagggccggcggcggtggcatgctgtacgtgcccggggcaaggtggctgacgggccccttcaacctgaccagccacttcaccctctacctccaccaagacgccgtcatcctcggctcccaggaccgtaggcgagtggccaatcgtggatccctgcctttcttacggaagagnnaggacaaggnccgnagggaggttcgctagcctcatcggcggatcgaaccggaccgg

SEQ ID NO: 31625 - protein, 60 aa, Zea mays
  misc_feature: Ceres CLONE 1408042-F
  misc_feature (51)..(51): Xaa is any aa, unknown, or other
  misc_feature (52)..(52): Xaa is any aa, unknown, or other
  misc_feature (55)..(55): Xaa is any aa, unknown, or other
MLYVPGARWLTGPFNLTSHFTLYLHQDAVILGSQDRRRVANRGSLPFLRKXXDKXRREVR

SEQ ID NO: 31626 - DNA, 657 bp, Zea mays
  misc_feature: Ceres CLONE 1408043-F
  misc_feature: Encodes the peptide sequence at SEQ ID NO. 31627
  misc_feature (468)..(468): n is a, c, t, g, unknown, or other
  misc_feature (474)..(474): n is a, c, t, g, unknown, or other
  misc_feature (478)..(478): n is a, c, t, g, unknown, or other
  misc_feature (495)..(495): n is a, c, t, g, unknown, or other
  misc_feature (503)..(503): n is a, c, t, g, unknown, or other
  misc_feature (512)..(512): n is a, c, t, g, unknown, or other
tccccgcggtggcggccgctcttgaactagtggatcccccgggctgcaggaattcgcacgagaccattacctagaacatcctaatcgaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcgtccgtggaggcgncggcgntggntacggtggtggccgtgnaggcgcgnctacggcgntggcgggcgccgtgatggcggcgacgactacgccggtgtcggcggcgtctacggtggcggcgcggtttacgatgctggtgaagccgtttacgatggtggtaccctggcggcggctactggaactccgaacggaattggaggactt

SEQ ID NO: 31627 - protein, 155 aa, Zea mays
  misc_feature: Ceres CLONE 1408043-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (93)..(93): Xaa is any aa, unknown, or other
  misc_feature (95)..(95): Xaa is any aa, unknown, or other
  misc_feature (102)..(102): Xaa is any aa, unknown, or other
  misc_feature (105)..(105): Xaa is any aa, unknown, or other
  misc_feature (108)..(108): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGVRGGXGXGYGGGRXGAXTAXAGAVMAATTTPVSAASTVAARFTMLVKPFTMVVPWRRLLELRTELED

SEQ ID NO: 31628 - DNA, 693 bp, Zea mays
  misc_feature: Ceres CLONE 1408044-F
  misc_feature: Encodes the peptide sequence at SEQ ID NO. 31629
  misc_feature (90)..(90): n is a, c, t, g, unknown, or other
gctctagaactagtggatcccccgggctgcaggaattcgcacgagaccattacctagaacatcctaatcgaaaaaagaagaacatcgccnttgcagcaagtctgtatgatctgtgacagctgtcgatagaattatcacacacattcgttattcgttgaactaaaaccatggcgaggccgtccgaccaaagcggcgtccacgtcctcctgctcccattccccacgcagggccacatcaacccgctgctccagttcggcaagcggctcgccggccgcgctggcgtccggtgcacgctcgcggcgacccgcttcgtcgtcagctcgacgaagccgaccccgagctcggtccacgtcgccgtgatctccgacggctgcgacgagggcggccccgccgaggtgggaggaattgtcccgcgctacttcgagcgcctcgaggtcggccgggtccgagacgcctggacgaggtcctcgggtccggagccccccttggccccgccgcgcgcaaggcgtgtgcgggaacgccgcgcccccgcacccgtgctgcctccttgtctgcccccgcccatctccccccccgcaacgtcgaaaacctaactcaaccacagccgccacgcgcacgtaggatgacgcgcaggcgagagcgtcgtgtgttacgtgtcggtatttaaaatatgattccgacccccacccccct

SEQ ID NO: 31629 - protein, 141 aa, Zea mays
  misc_feature: Ceres CLONE 1408044-F
  misc_feature (11)..(87): SWISSPROT Homolog: EC 2.4.1.121 Indole-3-acetate beta-glucosyltransferase
  misc_feature (5)..(36): SWISSPROT Homolog: EC 2.4.2.40 Zeatin O-beta-D-xylosyltransferase
MARPSDQSGVHVLLLPFPTQGHINPLLQFGKRLAGRAGVRCTLAATRFVVSSTKPTPSSVHVAVISDGCDEGGPAEVGGIVPRYFERLEVGRVRDAWTRSSGPEPPLAPPRARRVRERRAPAPVLPPCLPPPISPPATSKT

SEQ ID NO: 31630 - DNA, 671 bp, Zea mays
  misc_feature: Ceres CLONE 1408047-F
  misc_feature: Translation starting site: 201
  misc_feature (348)..(348): n is a, c, t, g, unknown, or other
  misc_feature (450)..(450): n is a, c, t, g, unknown, or other
  misc_feature (494)..(494): n is a, c, t, g, unknown, or other
  misc_feature (522)..(522): n is a, c, t, g, unknown, or other
  misc_feature (523)..(523): n is a, c, t, g, unknown, or other
  misc_feature (534)..(534): n is a, c, t, g, unknown, or other
tccccgcggtggcggccgctctagaactagtggatcccccgggctgcaggaattcgcacgagaccattacctagaacatcctaatcgaaaaaaaaccgcggggcagctagtctcgccaccgcaggccgcaccggtcatcacaccggagcgcacgcggggagcccccgtagagttccggggcgaccaggccaactaacgccatgaaggaggaaggcggcggcggggacgcggggttcgtgcgggcggaccagatcgacctcaagagcctggacgagcagctggagcgccatctcacccgcgcctggaccatggagaagcgcaaggaggaggcctccgcggggcctgggncgccggcgccaggcagcaccagcagtcccggcgcccgcggaagggaggaactggggagatcgaccccgccaagcttggtcgtcaagggcgtcatcgcccgcnggcacctttggcaccgtccaccgcggcatctacgacgctccggnacgtcgcagtgaacctacttgatttggnngagaggatggncatagatcagaacaagacattgcagcactaagagcagctttttcacaagaggtctctgtttggcataagcttgaccatccaatgtaaccaagtttattggagctataatggggtgcaagggatctgaatattcaaag

SEQ ID NO: 31631 - DNA, 670 bp, Zea mays
  misc_feature: Ceres CLONE 1408051-F
  misc_feature (461)..(461): n is a, c, t, g, unknown, or other
  misc_feature (556)..(556): n is a, c, t, g, unknown, or other
  misc_feature (616)..(616): n is a, c, t, g, unknown, or other
  misc_feature (637)..(637): n is a, c, t, g, unknown, or other
  misc_feature (638)..(638): n is a, c, t, g, unknown, or other
  misc_feature (648)..(648): n is a, c, t, g, unknown, or other
  misc_feature (670)..(670): n is a, c, t, g, unknown, or other
cgcggtggcggccgctctagaactagtggatcccccgggctgcaggaattcgcacgagaccattacctagaacatcctaatcgaaaactgctagtgctcagtcctcgccctctcgctttccgagggagcctttgcctttcccctccgcccgccagccattaatggcggcggcatctccatccactcccccctcgcccccctcccactgctgctacttctagaagcgctggtggcagggcaggcggtatcccggccgctggcgctggcgcgagagttggttgggtggtggtgttcagcccccctccctcttcaggtttagggtggagcgatccgtgcaggccaacgcggggtgcgtgaccccaaagggaaaccgccgccttttttctcttctgccgccccgcttttccaatccctcctcaacctcatccgccccgcccgcaccatcaccaaaaaggtccccngccttcttcttcctcttctcctctgccctggctttgtcgtttgctcgtgctcccccaccccctttctgatttcagccagggttccttcccgcggncgcggcgcgtcgccatgggcaaactgctgggggcgccaagatcagctccgacagcccctnccgcggcgctccctccccgtnnaaggaccggngtcccaagttgcgaagcaggan

SEQ ID NO: 31632 - DNA, 650 bp, Zea mays
  misc_feature: Ceres CLONE 1408052-F
  misc_feature: Encodes the peptide sequence at SEQ ID NO. 31633
  misc_feature (332)..(332): n is a, c, t, g, unknown, or other
  misc_feature (333)..(333): n is a, c, t, g, unknown, or other
  misc_feature (472)..(472): n is a, c, t, g, unknown, or other
  misc_feature (511)..(511): n is a, c, t, g, unknown, or other
gctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccgggccgccnnatcccggtggtggacctctcggtgacgcggcgcgaggacctagtcgagcaggtgaggcacgcggccggggacggtgggcttcttctggctgggaaaccacggagtgccggaggagctgatgggcgcatggctccgcggngtgcgccagttcaggggggccccggggggagggaaaccnggcgctctactcgagggacctcgcttgcaacctgcggcttcgcctccaatttcgacctctttcagggtgttgcggacgactggcggcgaccgctctttctgcgaggtggctccgaacccgccggccgcgggagggagtg

SEQ ID NO: 31633 - protein, 110 aa, Zea mays
  misc_feature: Ceres CLONE 1408052-F
  misc_feature: SWISSPROT Homolog: EC 1.14.11.20 Desacetoxyvindoline 4-hydroxylase
  misc_feature (72)..(72): Xaa is any aa, unknown, or other
MAPTTATKDDSGYGDERRRELQAFDDTKLGVKGLVDSGVKSIPSIFHHPPEALSDIISPAPLPPSPPSGPPXPGGGPLGDAARGPSRAGEARGRGRWASSGWETTECRRS

SEQ ID NO: 31634 - DNA, 616 bp, Zea mays
  misc_feature: Ceres CLONE 1408055-F
  misc_feature: SWISSPROT Homolog: EC 1.11.1.6 Catalase
tggagctccccgcggtggcggccgctctagaactagtggatcccccgggctgcaggaattcgcacgagaccattacctagaacatcctaatcgaaaaatgtaaaccacactccactccagcactgaacacttgattgattcagtgggtagctagctagctgaatcacaatggatcctaccaaggtccgtccgtccagtagccacgacacgacggtgacgaccaccaacgctggcgctcctgggttgaacgaacaccaagccgctgactgtggggcctccccgtcccatcctcgtggaggactacccctgaaccaaaaagggggcaatttccggcgaagcatcccgaaaagccggtggcccaccgcggggccccccccaaggtttttttaaaggcccacaaaaggagtcctttaaaaggggcaaatttttgtggggcccccgtggggaaaccccgaaaattggcttttccaccaggaacaccaaaggggttccccccaaaaaaaccccacccccccggggttcccccaaaaattatcaccccccccggagaaattgaacccccttggaaaaaaaaattcccccgtttttttttcccgggagggtttaatttcccccc

SEQ ID NO: 31635 - DNA, 632 bp, Zea mays
  misc_feature: Ceres CLONE 1408057-F
  misc_feature: Encodes the peptide sequence at SEQ ID NO. 31636
cgctctgaactagtggatcccccgggctgcaggaattcgcacgagaccattacctagaacatcctaatcgaaaaatcgtccataggccaaccatgcgcccacggctagcttaattcgccgcaccatcagttcgctcgcaaactctcctatcaagcactgcacaggcacagcacacagcacagccatggctgctcccagactcaccgctgccagctgccacgctctgcgcggagtgctccacgacaagctccgcgccgttgagctgcagctgcgggcgtgccgccgctccctcgccggcgcgtccggctcttcgtcgacgacggcagccgccgtggccgcgctcgtcttcgccgccgcggcgttcccgctagccgcggccttctttctgccactcttggcctccacctccctctgctgcacggaagcgtgcctgttcgccgccgtgaagcgcagcgcgaccaaggaggctgtaaaggccgtggtcgtggacggccgaagggaaaggccgaggccgggctgcttaagggggatcgggcgaggcccaccaccagcgcggacgggcgacaggctccgccagcggtccagggggggaggcttccacccccaggtcccgcgaaggggaaggcgtgtag

SEQ ID NO: 31636 - protein, 149 aa, Zea mays
  misc_feature: Ceres CLONE 1408057-F
MAAPRLTAASCHALRGVLHDKLRAVELQLRACRRSLAGASGSSSTTAAAVAALVFAAAAFPLAAAFFLPLLASTSLCCTEACLFAAVKRSATKEAVKAVVVDGRRERPRPGCLRGIGRGPPPARTGDRLRQRSRGGGFHPQVPRRGRRV

SEQ ID NO: 31637 - DNA, 669 bp, Zea mays
  misc_feature: Ceres CLONE 1408058-F
  misc_feature: Encodes the peptide sequence at SEQ ID NO. 31638
  misc_feature (425)..(425): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (601)..(601): n is a, c, t, g, unknown, or other
  misc_feature (669)..(669): n is a, c, t, g, unknown, or other
tcaccgcggtggcggccgctctagaactagtggatcccccgggctgcaggaattcgcacgagaccattacctagaacatcctaatcgaaaaaaaaataggaaacgagcaaaggtctggcgagctacctaccaataaactaccatccccacaaacaggctagcacgtagctatatgccagaactgacctagtagaggatcgatcgcagatggtgtttcctgccatcctccccaaggtggccgcacgatggctcttcacgttctaccgcgccgccagaaagctcaggcgccacgccttccagctctactaccgcaacaccgccgccaagccgtcgtccgccgtctcgcagcagcaggccggggccgccgccactgtcactgccgccgccgccttcaagaccggcgccgccatccctgacgccggggncggaaaccgttgtgtgcgacatgcacggcgccctgctgcgctccaccgcgctcttcccacttctgcgggnnnnnnnnnaaagggggggggaaaaaaacccccccccggccacgggtgggtgtgttcggcgcctccccccccttcggggggggccccccgggaaaagcccccggggncccccggtctccggggaggaaggggcgttcgccccccccttcggggggggctacgggccccagggggn

SEQ ID NO: 31638 - protein, 74 aa, Zea mays
  misc_feature: Ceres CLONE 1408058-F
  misc_feature (17)..(17): Xaa is any aa, unknown, or other
  misc_feature (18)..(18): Xaa is any aa, unknown, or other
  misc_feature (19)..(19): Xaa is any aa, unknown, or other
  misc_feature (20)..(20): Xaa is any aa, unknown, or other
MHGALLRSTALFPLLRXXXXRGGEKNPPPATGGCVRRLPPLRGGPPGKSPRGPPVSGEEGAFAPPFGGGYGPQG

SEQ ID NO: 31639 - DNA, 664 bp, Zea mays
  misc_feature: Ceres CLONE 1408059-F
  misc_feature: Encodes the peptide sequence at SEQ ID NO. 31640
  misc_feature (256)..(256): n is a, c, t, g, unknown, or other
  misc_feature (279)..(279): n is a, c, t, g, unknown, or other
  misc_feature (280)..(280): n is a, c, t, g, unknown, or other
  misc_feature (299)..(299): n is a, c, t, g, unknown, or other
  misc_feature (300)..(300): n is a, c, t, g, unknown, or other
  misc_feature (311)..(311): n is a, c, t, g, unknown, or other
  misc_feature (324)..(324): n is a, c, t, g, unknown, or other
  misc_feature (325)..(325): n is a, c, t, g, unknown, or other
  misc_feature (337)..(337): n is a, c, t, g, unknown, or other
tccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcgncggcgctggctgccatgtggtgnncgtcgtgctcaagaacggnnggtgtcgacgncctcccgccgggnncctcgggttggncggtggtggggaacctggtcccagtgatcctgcagcgacggcccttcatgtacgtggtgcgcgacctccgggaggagtacgggccatctcaccatggggatggggcagcgcaccctcatcggggccacctcggcgggactcatccacgaggcgttggtggaacaaggcccccatgttcgggagccggcccgaggaacggccccacccggcttcctctttaggggggggaagggggccccgtaaattcgggggcctaagggccccttggggggggggtctggggcccaaatttctgtgcccgaggagggggccccccccccggggaag

SEQ ID NO: 31640 - protein, 112 aa, Zea mays
  misc_feature: Ceres CLONE 1408059-F
  misc_feature (13)..(13): Xaa is any aa, unknown, or other
  misc_feature (20)..(20): Xaa is any aa, unknown, or other
  misc_feature (21)..(21): Xaa is any aa, unknown, or other
  misc_feature (27)..(27): Xaa is any aa, unknown, or other
  misc_feature (31)..(31): Xaa is any aa, unknown, or other
  misc_feature (36)..(36): Xaa is any aa, unknown, or other
  misc_feature (40)..(40): Xaa is any aa, unknown, or other
MDVNDVLLVVLAXALAAMWXXSCSRTXGVDXLPPGXSGWXVVGNLVPVILQRRPFMYVVRDLREEYGPSHHGDGAAHPHRGHLGGTHPRGVGGTRPPCSGAGPRNGPTRLPL

SEQ ID NO: 31641 - DNA, 668 bp, Zea mays
  misc_feature: Ceres CLONE 1408063-F
  misc_feature: Encodes the peptide sequence at SEQ ID NO. 31642
ggcggccgctctagaactagtggatcccccgggctgcaggaattcgcacgagaccattacctagaacatcctaatcgaaaatgcgtcgccgccttctgttacccttaggctctgaacccctccggtccggtgcggcggcggattaggctccgatggggaagtctccggcgaagtggatcaagtccgtgctcttcgggaaaagtcgtcgtcgaggtccggctccccaaggccaggtatttatcgaagggtacgactaacaaagcagcagctgctgctgctgctgccgggaaggagcccgcgttctctgagagctctccggtcatctcgaagcctgtgcttgttagccgccacaacaatgagaccgggcgggaggccgctaagggtgagaattccagggggcaggaagtggcaggaaactgatgccagcaaagatttgaaaaacagggccccggtttgggcatagaatgcctaattagggcgggaaggtttgagaaaaaaccaacgggcccggaagggaaaagttggcctcccggggtttttcgggcgccgcgaaaattccggccccgggaggggttaaaaaaaacaagggcctgtgtttcgggaactttttgggaaggggggaaattttttcttcccccccggccactggggtggtgtgggaaaactcg

SEQ ID NO: 31642 - protein, 34 aa, Zea mays
  misc_feature: Ceres CLONE 1408063-F
MGKSPAKWIKSVLFGKSRRRGPAPQGQVFIEGYD

SEQ ID NO: 31643 - DNA, 736 bp, Zea mays
  misc_feature: Ceres CLONE 1408066-F
  misc_feature: Encodes the peptide sequence at SEQ ID NO. 31644
  misc_feature (21)..(21): n is a, c, t, g, unknown, or other
  misc_feature (31)..(31): n is a, c, t, g, unknown, or other
  misc_feature (32)..(32): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (48)..(48): n is a, c, t, g, unknown, or other
  misc_feature (736)..(736): n is a, c, t, g, unknown, or other
tggtccccccccccccccccncttatctatnntggaggcgccnnnccnaaaaactggagctccccgcggtggcggccgctcttcaatagtggatcccccgggctgcaggaattcgcacgagaccattacctagaacatcctaatcgaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgcccccttcgcgcccccgatcgcccgattccttcagggccaaagatattccagtgtttaccaacagagtttctcgtacgtaccgggcaaaatcagtgacagttccagatcacggagttgatgtgtgtcctttggaatacaatgagtatgtcccctgccatgatggagcctatataagcagcttgaagagcctggatacatctaggcatgaggatcttgaaagcatttgtcctccatgggagaagcggttgtttttgtttggcgccccctccaaatgactacaggataaccaataagatgggcagacagccgagactacgtatggcggaagtaatgcccaccattaccatctttgctgaggtcaaaggaagaacagaaactgggtgcan

SEQ ID NO: 31644 - protein, 138 aa, Zea mays
  misc_feature: Ceres CLONE 1408066-F
MRRWWSPALAAVEPRSVQLLLLGVALVAASFYAGTLFGSSASPALVLPPSRPRSPDSFRAKDIPVFTNRVSRTYRAKSVTVPDHGVDVCPLEYNEYVPCHDGAYISSLKSLDTSRHEDLESICPPWEKRLFLFGAPSK

SEQ ID NO: 31645 - DNA, 637 bp, Zea mays
  misc_feature: Ceres CLONE 1408067-F
  misc_feature: Translation starting site: 207
  misc_feature (465)..(465): n is a, c, t, g, unknown, or other
gctctagaactagtggatcccccgggctgcaggaattcgcacgagaccattacctagaacatcctaatcgaaaactctcctctcgctcgcgtccgcacaaatcccgtgctcccccgtctgaaaaccctccccacctccggcggcggcggcggcgctggcgaccgggtgtcttctccggcgagtctcccccctagtaacaagaaaatatggatgtacctgttgatgaccctgtggagaacctcactggaagtcctagtacccttggcaatgaggaagaagccactacttatgctaatgtgcaagatcagtccaaggaagaaccagaaaagctttacgaggaacccaaagacccaatgcaagacgagttgggtaaccaagggcatgtgagcatgaacaatgaagatgtgggaggccagaacaaagtggaccaagctaccccccacagagcacggcgaggaagctggngtgaagcagcatgatgctacagttcctgatgacaagaattggcctgggtggcctgggagagagtgtgttccgtatactggttctaccaacaaaggtgggtgccggcattgggcgcaaaaggggattcatcaagaaaatggggggagggatcaaggagcccgcatcaaggttt

SEQ ID NO: 31646 - DNA, 705 bp, Zea mays
  misc_feature: Ceres CLONE 1408071-F
  misc_feature: Encodes the peptide sequence at SEQ ID NO. 31647
gctctagaactagtggatcccccgggctgcaggaattcgcacgagaccattacctagaacatcctaatcgaaaagaacgagtattttgagtcaactcacaagggtagttcaaagtccagaattccagactcgcgttcgcacgccgcctttcgcgctgccttagcgccttagcctgctagggctcgtcgattcatcgccggctcgacttctgatctcgcgggcagagcagcgcgccggcgcgatggcttcggatccggatgtgtccggcggcgagcaggcggagccgcccgacgatgtgaccggaccccgacggtcgacgaggtcgaccccaccggccgctacttcagggtacaagggagggtcgtggggatccaggggccttcaagacagtcctacaaggggtttcggacgtggtcgaaaggccatcgaggctggcatggggctaaagtgggagaataaacggccgggaaccatggggatcccccccaagtaggctccagcgggctccaagacggaagatccagcctggctgggggtccgctcccatcacaagcaacattctcaaggtctacaccctccatggagtcgaccaacaagaagggggggggggcaatataaacccctggaggtctttcccggtccggcaaccttggggagaggacccgtcacgcgcgcccaggagagtttgtcctggacggctaaggg

SEQ ID NO: 31647 - protein, 83 aa, Zea mays
  misc_feature: Ceres CLONE 1408071-F
MASDPDVSGGEQAEPPDDVTGPRRSTRSTPPAATSGYKGGSWGSRGLQDSPTRGFGRGRKAIEAGMGLKWENKRPGTMGIPPK

SEQ ID NO: 31648 - DNA, 748 bp, Zea mays
  misc_feature: Ceres CLONE 1408073-F
  misc_feature (20)..(20): n is a, c, t, g, unknown, or other
  misc_feature (21)..(21): n is a, c, t, g, unknown, or other
tttttccccccccccccctnntttattttttttttagtcacccaacacaaaatctcctgccctccccgcggtggcggccgctctttactagtggatcccccgggctgcaggaattcgcacgagaccattacctagaacatcctaatcgaaaagtccctgtccctccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcggccccgagccgtcgcgcggtcgcctccacatctcgtcgttcttcaaggtctttggcctccgccgttcttggacaggggcacaccactgtccaccggtgcccactacgcgaaatacgagtccctcgtgcggctccgtagggtggaagagatccatcaggcggtgagtgagaggggcgcgtccacacaaccggaaggggaggggagcaatggcgtccgtggcaggtccactctgcacgtggctccgtcgccgcgtgcttatctggggcaagctacgcctcaacaacacacagaaaaaagatttccagcacaggcggcaacccccgcctttggaagcgtgcggttctggttcccgtccacgcggccgccggcctccctcttgcggcggcaccccacccgctcctgagccccccccccccgtgctaagacgcaccacaaggcgc

SEQ ID NO: 31649 - DNA, 638 bp, Zea mays
  misc_feature: Ceres CLONE 1408074-F
  misc_feature (539)..(539): n is a, c, t, g, unknown, or other
tccccgcggtggcggccgctctagaactagtggatcccccgggctgcaggaattcgcacgagaccattacctagaacatcctaatcgaaaaagtgtttcgcactttgctattcagcttcgttcttcaccggttcaccctagccgccaccccaacccccagcgacagggaccttcgccgccaggccgcccccaatccctagcgactgcgagcaccgtcgccaggcgccgtgcagcgagcgtcgccgcctggcgaagtcgcgcgactcgtgccctgcagcgagcgccgctgtcccgcacccaccgtcgaacggctgccgatgcccaacgccctgcagcgagttgcgccgtcgtccgcttcctctcgctggtaacctcgtgtttcgatttggacagattgctcgtgacttggtgttgcgccgccgaccgagcctccttcccctaagtccctaaccgtaagtcctaaatcttggtgagttctgttcatgtgcatttgagcttacgcatctatgatacgcgccttagggattgtgatctgtganttaggggttgtgaaattgagatgccattttaggggattgtggaagtgtgaactgtgccttactgaaatcgagatgccatttgagcaagttttcaactat

SEQ ID NO: 31650 - DNA, 769 bp, Zea mays
  misc_feature: Ceres CLONE 1408075-F
  misc_feature: Encodes the peptide sequence at SEQ ID NO. 31651
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (30)..(30): n is a, c, t, g, unknown, or other
  misc_feature (33)..(33): n is a, c, t, g, unknown, or other
  misc_feature (35)..(35): n is a, c, t, g, unknown, or other
ttttcccnnnnncccccctnnntttttttnttntntcggggcgccacaccaatattggtgctccccgcggtggcggccgctcttcaatagtggatcccccgggctgcaggaattcgcacgagaccattacctagaacatcctaatcgaaaaatccaagctctcttcattggttcatagctagctagttcgcctcccaaaaacacctgccctcgtgcgtggcaggagcacgggcacgatgatcagcacagcgcacagccggcagcagcaccatgccttcgagaagagccctggcaacagccacatgaagagcatcgactggaagctgcagcaggccatgagccaggcggccagcaagtacatgcagaggatctaccctctaggcatgcagaggagcagctccagcctcacattgtcgtcgctctcgctgtcgcagaactccaacgactcctccatcagcagctccaactccagctgggagcccaaggtgccgctgctctacggcggcaccttcagcccatggggggacgtcatggggcctcggaagatgaggcgggaggaccatgaccaggtccatgaccatgacgtccaaggagggggaggaggacttggaatggaagagacgccggggaagcctggcgaagggtgcaggctgggtccaccagggaaggaggggcccgaggggggaacgtgcgaggtccccgagaaagaggggcgggagagcgggaccacagggggtcaacggcgaaaaagacgaaagttgagactccc

SEQ ID NO: 31651 - protein, 177 aa, Zea mays
  misc_feature: Ceres CLONE 1408075-F
MISTAHSRQQHHAFEKSPGNSHMKSIDWKLQQAMSQAASKYMQRIYPLGMQRSSSSLTLSSLSLSQNSNDSSISSSNSSWEPKVPLLYGGTFSPWGDVMGPRKMRREDHDQVHDHDVQGGGGGLGMEETPGKPGEGCRLGPPGKEGPEGGTCEVPEKEGRESGTTGGQRRKRRKLRL

SEQ ID NO: 31652 - DNA, 862 bp, Zea mays
  misc_feature: Ceres CLONE 1408077-F
  misc_feature (16)..(16): n is a, c, t, g, unknown, or other
  misc_feature (19)..(19): n is a, c, t, g, unknown, or other
  misc_feature (21)..(21): n is a, c, t, g, unknown, or other
  misc_feature (807)..(807): n is a, c, t, g, unknown, or other
tgttcccccccccccnccntnccccccttccacgacctaatggaagaaaaaaacaaagctggagctcaccgcggtggcggccgctctttactagtggatcccccgggctgcaggaattcgcacgagaccattacctagaacatcctaatcgaaaatctctatgacacgtgccccttcccccctcttaagctaagggacccttgggcagcccggcatcttctccaatctccaccctctgcccctctcgatttcttcttcccatctcccgatccatcgcaacccaaaccctactccaggcagatctccgtctccgccgacgctgccggcgtgagcacagcatcagatccgctgtgatggcgttcccgccgcatcctatccaccgtgggtgcgccgccgctccgaccgtgtacggtcgaggggggccgccacacgcggggggaagccctcccaaggtgcgtttgcttgcgcccgccccggtgcccgcccgcaccccgaatgggaaccgcggcaggcgggcacgctggggcactgccttaaagtacccccaccctctctcccggcccgtttgatacccagtcctttcgcggtggctccggggggcacggtcggaccccaacacctttaccccccccacacgggaccggaagcggcggggcccggcacgcgaagagaacagaccggcaggggatacaaccaccgaggcggggatcaccccgagacccgcgagcctaggccggatgaagccccgcaaccgacgcatgacaggcacaccaacaccgcacgttacccccccccccctgcgccacntaccacacggtggacagcggcaagcgggaggagagatcagcgcgggagcccgggg

SEQ ID NO: 31653 - DNA, 686 bp, Zea mays
  misc_feature: Ceres CLONE 1408078-F
  misc_feature: Encodes the peptide sequence at SEQ ID NO. 31654
  misc_feature (184)..(184): n is a, c, t, g, unknown, or other
  misc_feature (327)..(327): n is a, c, t, g, unknown, or other
  misc_feature (340)..(340): n is a, c, t, g, unknown, or other
  misc_feature (409)..(409): n is a, c, t, g, unknown, or other
cgctctagaactagtggatcccccgggctgcaggaattcgcacgagaccattacctagaacatcctaatcaaaaattaatttccagggatgcacgcaggcaagtttaatttggaggatcaatggtagctagctagagctactagagacatacatggcggatcctctggtgcgagcgcgacccanaaggaagaaggtcttagcggactacttggtgcgactccgatggattcctgccctcttcgtggcccttccatatctgcgctgatctacctgagcgtcttcctggggaacacgtggtccgccatgaaatccgagaagcgtcgacngaaggacaccagnagaacgtaaagaggctgaaagggtcctgaagcgtctcagggaaaaggatcccgaaaaggacggcctccnctgcaccgaagaaaccatgggtgggcccgggcatggcccaaggtggaataaagggggccaaaacttttagggccaaccttcccggttgaggaaccccccaaaacacccgggaagggggggccccccaggggggatctccccccaaaggggccccaaaaacggggggtcctgccccaaaactccctcccccggggggtccagggagggaaccttcacccggggggggggaaaaaccaacaaatattttgggggggtttttccaaaaccgtctttttgg

SEQ ID NO: 31654 - protein, 37 aa, Zea mays
  misc_feature: Ceres CLONE 1408078-F
  misc_feature (11)..(11): Xaa is any aa, unknown, or other
MADPLVRARPXRKKVLADYLVRLRWIPALFVALPYLR

SEQ ID NO: 31655 - DNA, 855 bp, Zea mays
  misc_feature: Ceres CLONE 1408083-F
  misc_feature (19)..(19): n is a, c, t, g, unknown, or other
  misc_feature (20)..(20): n is a, c, t, g, unknown, or other
tttcccccccccccccccnntttttgtttttggtatgttgccttcgtcccaaaactggtgctccccgcgggggcggccgctctacaatagtggatcccccgaggctgcaggaattcgcacgagaccattacctagaacatcctaatcaaaaattcccgttccccaattcgaaatcgagtcgggtcggtcttgccgtgcgtgcgtggctgcgcgaaccagcccacgctcccactccccgcccgccaccgccgggtccctctagggttttgccgcgatgtcgctccggccgagcgagcgggagcagatgcggaaggtaactacaagcagacggtggacgccgaggaaagccgccgcccccgggagggcccaaatggccgaactcccgcagggctaagggagaggaaagtctcctaaaaaaaggcccggaatggggttccccgccccccgtcgtcgggccctcacaatggcccccctcccccccgaattcccaaaaaaaagctttgaatgggttttggccgcaggattggttcaaagggccccttttatttctaaaaaaacccccaagttgtggcacatttgggggggccccccccacccacatttttatcaagaaatgccccccccccgaaagggagggggcgaccccccccccaatgagacaaccacccccccccctcaacacgttcgtctgtcccctaataacattatgatgcgcgcccgagacggagggaagcccactcgtccaacacccttttagtagaacaatgagggggaccctcacaacgacgtgcagtcaccgagaccccacggacgatccgttcgcggggggccgacttgcggatactccactcccac

SEQ ID NO: 31656 - DNA, 643 bp, Zea mays
  misc_feature: Ceres CLONE 1408084-F
  misc_feature: Encodes the peptide sequence at SEQ ID NO. 31657
  misc_feature (367)..(367): n is a, c, t, g, unknown, or other
  misc_feature (643)..(643): n is a, c, t, g, unknown, or other
gctctagaactagtggatcccccgggctgcaggaattcgcacgagaccattacctagaacatcctaaaaaactcaaacccctaatccctagccacaccacgccctcttccctccttccccgttggcttcggcggcgggcggccatcagcaaccagcatcgtacggaggagaagcgctgtttacacccgtctggcagggatgccgctggggcagcgttcgggggacaagagcgactcccgctactgcgggggtggaggttctcgacttccccgccggggagggcctccctgccgtcctcaatcactccctcgcctccgccttcgactcatcctcgcccctctggttgatcccaactaccggccggcgncccggcgcgttctggcagtgtcagcgtcggacctcgtcctcggcccgtcccagtggagcaaccacgtcctccgggagatcagcgagtggatcgatttggacgccggagacgagcggcttccggtggactccgagctcacgctgaagcaaggagatcggctggggcatctcacgtctcgctgcaagcattgggtattcctgccccccaggagatctttttgcggcattattggcccgagttgggaatcaaaatttggcaggcctgacaattattaan

SEQ ID NO: 31657 - protein, 147 aa, Zea mays
  misc_feature: Ceres CLONE 1408084-F
  misc_feature: SWISSPROT Homolog: EC 2.1.1.125 Histone-arginine N-methyltransferase
  misc_feature (57)..(57): Xaa is any aa, unknown, or other
MPLGQRSGDKSDSRYCGGGGSRLPRRGGPPCRPQSLPRLRLRLILAPLVDPNYRPAXRRVLAVSASDLVLGPSQWSNHVLREISEWIDLDAGDERLPVDSELTLKQGDRLGHLTSRCKHWVFLPPRRSFCGIIGPSWESKFGRPDNY

SEQ ID NO: 31658 - DNA, 611 bp, Zea mays
  misc_feature: Ceres CLONE 1408087-F
  misc_feature: Encodes the peptide sequence at SEQ ID NO. 31659
  misc_feature (284)..(284): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (331)..(331): n is a, c, t, g, unknown, or other
  misc_feature (399)..(399): n is a, c, t, g, unknown, or other
  misc_feature (400)..(400): n is a, c, t, g, unknown, or other
  misc_feature (410)..(410): n is a, c, t, g, unknown, or other
  misc_feature (450)..(450): n is a, c, t, g, unknown, or other
  misc_feature (468)..(468): n is a, c, t, g, unknown, or other
  misc_feature (469)..(469): n is a, c, t, g, unknown, or other
tccccgcggtggcggccgctctagaactagtggatcccccgggctgcaggaattcgcacgagaccattacctagaacatcctaatcgaaaagacatcagacatcaccaactcgtcgacggtagagagagcaagctcttcggcgatttgagaagaatcgaggagcgagcgagcgagcgagcgagagaggaggaggaggagctggggcttgagcctgcgcccgggggccccgggtcacggaatcctaccattaccaaccctagccttcgttgatcgccgtctcagngtcatggcagggccggcgccggatcgggccgccctgactgtgnnngncgggcatggacatgccaatcatgcacgacagcgaccggtacgagctcgtgcgcgatatcggctccgcnnactttcgcgntgccccgctcatgcgcgaccggcgccacagcgaaactcgncgccggccagatacattnngaggggggggaggaaaataattgggaatggcccgggggggaatatttaccctgagccttgggagcccctaactttttaggggttaaggggtttttttaaccccgccccttttggttttgggaagggaaaagcgcctgggggt

SEQ ID NO: 31659 - protein, 50 aa, Zea mays
  misc_feature: Ceres CLONE 1408087-F
  misc_feature: SWISSPROT Homolog: EC 2.7.11.1 Non-specific serine/threonine protein kinase
  misc_feature (22)..(22): Xaa is any aa, unknown, or other
  misc_feature (25)..(25): Xaa is any aa, unknown, or other
  misc_feature (44)..(44): Xaa is any aa, unknown, or other
  misc_feature (45)..(45): Xaa is any aa, unknown, or other
MDMPIMHDSDRYELVRDIGSAXFRXAPLMRDRRHSETRRRPDTXXGGGGK

SEQ ID NO: 31660 - DNA, 671 bp, Zea mays
  misc_feature: Ceres CLONE 1408095-F
  misc_feature: Encodes the peptide sequence at SEQ ID NO. 31661
  misc_feature (380)..(380): n is a, c, t, g, unknown, or other
  misc_feature (443)..(443): n is a, c, t, g, unknown, or other
  misc_feature (448)..(448): n is a, c, t, g, unknown, or other
  misc_feature (449)..(449): n is a, c, t, g, unknown, or other
  misc_feature (534)..(534): n is a, c, t, g, unknown, or other
  misc_feature (543)..(543): n is a, c, t, g, unknown, or other
  misc_feature (652)..(652): n is a, c, t, g, unknown, or other
  misc_feature (653)..(653): n is a, c, t, g, unknown, or other
gctctagaactagtggatcccccgggctgcaggaattcgcacgagaccattacctagaacatcctaatcgaaaaactgatggatcactcctgcagctgcagctgcagtgcgtcgccgctactccatcgtctattaattcctcgtgtagctccagcgctcggcttagacaagcctctccaacatgaagctcctgggttggatgcaccggaagttacgacagaacagtaatgatgtgttcaaagagttcaacaacgcttggaggtgggacgtgcaactgcatcaccgggctgggccgcgtcggacccggccactttcctcgccaccgccaacgaatacttcgccgccgacaacgacttcaccaacaatcatccaatcgtcgnccggccgccgacctctttcaacttttgggtggcagcggcctcctcaccattggcacgctagcnatcgnngcccccgtcgcggtgtctgcagatggctggatgaagttgattaccgacggtcgacgcccgatgctggactccgactttgacgacnacgacgacncccggcggtggatgacgaaggaccaggtcgacagcgccgtcacgcccacgttcacatatgcagcgccgccttccgggagaggacgccacggtcgtcgagaaaggtgcannttgcccggggttgaagcc

SEQ ID NO: 31661 - protein, 148 aa, Zea mays
  misc_feature: Ceres CLONE 1408095-F
  misc_feature (74)..(74): Xaa is any aa, unknown, or other
  misc_feature (103)..(103): Xaa is any aa, unknown, or other
  misc_feature (106)..(106): Xaa is any aa, unknown, or other
  misc_feature (142)..(142): Xaa is any aa, unknown, or other
MMCSKSSTTLGGGTCNCITGLGRVGPGHFPRHRQRILRRRQRLHQQSSNRRPAADLFQLLGGSGLLTIGTLAIXAPVAVSADGWMKLITDGRRPMLDSDFDDXDDXRRWMTKDQVDSAVTPTFTYAAPPSGRGRHGRRERCXLPGVEA

SEQ ID NO: 31662 - DNA, 674 bp, Zea mays
  misc_feature: Ceres CLONE 1408096-F
  misc_feature: Encodes the peptide sequence at SEQ ID NO. 31663
  misc_feature (566)..(566): n is a, c, t, g, unknown, or other
tccccgcggtggcggccgctctagaactagtggatcccccgggctgcaggaattcgcacgagaccattacctagaacatcctaatcgaaaagtttccagctccgatccaacccagcatctgtaccgcgccgcgcgagcacgtccggcgccggtgcggcaggcgaaatccgagagcactcctcccccgctacgccgcaccgcccatggccgcagctagccgcagatagagagaggcgcaggcgagggcgtgcagatccagatccggtgggcgggaaggacttgatcgcccccaccaccatggccggcgcggtgtcggcgctcttcctgctgggcatgaagggccgcgttctcgtctggcgcgactaccgcggcgatgtctccgcgctccaggccgagcgcttcttcaccaagctcctcgacaaggagggcgattcggaagtgcactcgcctgtggtctacgacgacgctggcgtcacttacatgttcatccagcacaacaatgtcttcctcctcaccgccgctcgccagaactgtaacgcggccagcatcctcctcttcctccaccngggtaatagatgtgtttaagcactacttcgaggagctgggaggaggagtcgctcaaaataccttccgtcgtttgttgtatgagttgctcgatgagaagaaatggaatt

SEQ ID NO: 31663 - protein, 95 aa, Zea mays
  misc_feature: Ceres CLONE 1408096-F
  misc_feature (90)..(90): Xaa is any aa, unknown, or other
MAGAVSALFLLGMKGRVLVWRDYRGDVSALQAERFFTKLLDKEGDSEVHSPVVYDDAGVTYMFIQHNNVFLLTAARQNCNAASILLFLHXGNRCV

SEQ ID NO: 31664 - DNA, 663 bp, Zea mays
  misc_feature: Ceres CLONE 1408097-F
  misc_feature: Encodes the peptide sequence at SEQ ID NO. 31665
  misc_feature (452)..(452): n is a, c, t, g, unknown, or other
acccgcggtggcggccgctctagaactagtggatcccccgggctgcaggaattcgcacgagaccattacctagaacatcctaatcgaaaagattccttccgccttgtcagcgcagcgatccagacccacccgagccaacaacccatggccgccgcgacgccgcgtctcctgctcgcggtcgcgggcctcaccctcgccgtcttcgccgccgcggtctcgccgtctctggcggcggggccgccggtgctgcaggacccggcggagctcctgcgccttgccaaggagccggccttcgcggactggatggtcggggtgcggcggcggatccacgagaacccggagctgggatacgaggagttccagaccagcgagctcgtgcgccgggagctcccggccatgtggatcccctacaggcaccccttcgccgtcaccggcgtggtagcacagcgggncacctggcggtccagccattcgttgctctgcggaaggatatgtacgtactgtcattgcaggaaagtgcgtagtgtcaaccaaatggctacgctgatgccaggtggctagttgcagcaactgctattactattcatacggtgtaggtaatgtgtactctcagtaacgaagacttcttccatttaaccaagtggccgaactgaaccccgctgc

SEQ ID NO: 31665 - protein, 138 aa, Zea mays
  misc_feature: Ceres CLONE 1408097-F
  misc_feature: SWISSPROT Homolog: EC 3.5.1.32 Hippurate hydrolase
  misc_feature (103)..(103): Xaa is any aa, unknown, or other
MAAATPRLLLAVAGLTLAVFAAAVSPSLAAGPPVLQDPAELLRLAKEPAFADWMVGVRRRIHENPELGYEEFQTSELVRRELPAMWIPYRHPFAVTGVVAQRXTWRSSHSLLCGRICTYCHCRKVRSVNQMATLMPGG

SEQ ID NO: 31666 - DNA, 672 bp, Zea mays
  misc_feature: Ceres CLONE 1408102-F
  misc_feature (581)..(581): n is a, c, t, g, unknown, or other
tggagctccccgcggtggcggccgctctagaactagtggatcccccgggctgcaggaattcgcacgagaccattacctagaacatcctaatcgaaaaatcttcttgaccatatcgacaccctttgcttcgacctgagcagtgccaatctcgccgcgggcttccactgctttgccctatgcactatacgccgccccccggactggaaaattgcttccccgcggacctccactccaacggtgcccgtatctcctttgtcctggctggatccgtataatctcctttgtcctccccctcccctcgttccgtttttccctcgcggtcctctcaaccgtacgccgccgccttgctcgcaccgtcgacagtgcctcagtccagatcgaccctccctctacccagatcgggttccagttggactaccgcccccgccgccctactacaggtgccgaggacttcaccggcgaagagcgcccgccagacaaatgggactgagtgataaggcgctcggcgtacgcttgaacaggacgtcaggggaagaagtgcagaaattcaggctcaagctgctgccgaaaggccttggcanccccatggatgtgctactgtccggttggccttgaaggaaattcgaatgatggatcccacacgggaagcaacataacgataaatcccctgtc

SEQ ID NO: 31667 - DNA, 648 bp, Zea mays
  misc_feature: Ceres CLONE 1408104-F
  misc_feature: Translation starting site: 158
  misc_feature: SWISSPROT Homolog: EC 4.1.1.19 Arginine decarboxylase
  misc_feature (446)..(446): n is a, c, t, g, unknown, or other
  misc_feature (504)..(504): n is a, c, t, g, unknown, or other
  misc_feature (539)..(539): n is a, c, t, g, unknown, or other
  misc_feature (637)..(637): n is a, c, t, g, unknown, or other
cgcggtggcggccgctctagaactagtggatcccccgggctgcaggaattcgcacgagaccattacctagaacatcctaatcgaaaaacacaccacagcactaaagtctattcatctctggctccccaaattcagctggagagcactttttcccatcatggataagaactacggtgaactctacaacatcctcggatggggtgaggagtacttcgcggtgaacacggaggggcacctcagcgtgaagcctttcggccgctggacggagcccgggcaggagatcgacgtgcactcggtcatcgtggaagctctagcgacccaacccaacgacagcaccagcaaatctcagttccccatgatccttcgcttccccgacgtgctcaagaaccgtatcgagacgctccataacgcattcaacagcgccatggagtccaccgggtacacgntccaggtaccaaggcgtgttcccgatcaaggtgaaccagaacaagcacgtctgcagancattgggttaggttcggccagcaatggaacatggncctcgaggctggctccaagccagaactgctcatcgccatgagctgcctccccgtcaccgaagccgagcccagcccgtactggatctgcaacgctcccnaggacgcggac

SEQ ID NO: 31668 - DNA, 693 bp, Zea mays
  misc_feature: Ceres CLONE 1408106-F
  misc_feature: Encodes the peptide sequence at SEQ ID NO. 31669
  misc_feature (334)..(334): n is a, c, t, g, unknown, or other
  misc_feature (351)..(351): n is a, c, t, g, unknown, or other
  misc_feature (380)..(380): n is a, c, t, g, unknown, or other
tccccgcggtggcggccgctctagtaatagtggatcccccgggctgcaggaattcgcacgagaccattacctagaacatcctaatcaaaaaacggtttgcgtataaataagtagtcagtcgctcatcttgttccttgtgaacatcgcagtgctgtagcctccttcgtcttgagcgagcatggagatgtcagccatggaggaagccctccccaaggcgatggagaggaggaagggaggcctcagaaccattccgttcatcatcttagacgagatattcgagaaggtggccacgttcgggctgtcggccaacatgatcctgtacctcaccgagcgntatctcatgaccaacgnctttgccaccgtcgtcctctacttctggnatggcttcatcaacttctggccatcttaaggggcgtggtcgccgacgccccgctcggccggttccggggaatcaccctcggtttctggataaccctctttgaatggcccttttgggtttaacgggatccttccggggaaaaaaaaccccccggttgcgcccccgggagttcttttttttggggggggccctccaaggtttttttctctcctttcccccggggaagtgtttttttctctcctaaaaaaaaacccgcggcgcccacaatagggctattaaaaaaaaccgtttgaaaaggagaaaaagggcgttta

SEQ ID NO: 31669 - protein, 76 aa, Zea mays
  misc_feature: Ceres CLONE 1408106-F
  misc_feature (58)..(58): Xaa is any aa, unknown, or other
  misc_feature (68)..(68): Xaa is any aa, unknown, or other
MEMSAMEEALPKAMERRKGGLRTIPFIILDEIFEKVATFGLSANMILYLTERYLMTNXFATVVLYFWXGFINFWPS

SEQ ID NO: 31670 - DNA, 754 bp, Zea mays
  misc_feature: Ceres CLONE 1408107-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (24)..(24): n is a, c, t, g, unknown, or other
  misc_feature (25)..(25): n is a, c, t, g, unknown, or other
  misc_feature (754)..(754): n is a, c, t, g, unknown, or other
nnnnccccccccnnnnnnnnaccnncctttcccccaccctctgccattactcaatactggagctccaccgcggtggcggccgctctatgaatagtggatcccccgggctgcaggaattcgcacgagaccattacctagaacatcctaatcgaaaactacatgccaaatctggaggcaagagaaccgggagagggcgtgttgggttgctcgtcgtgatcccggacggcaatacctgcccttgcctacttgccactgcttgcgtacactgatgtccttgttcaatcccctctagaaagtagaaacattgcttaattggcttggctattgctgttagctccacacaaaagagagaacccggcggcgagctaggagctagccatggacggacacggggcggtctcaccgtggagcgtgcttaggcggggcgacggatgtgctgctcctgtggttgccgacgcaggggctgaatgggccctggtgggcgccccggcgccgggaccgtgcgctgagggcgcagggtcccgaggggcaccgggaaccggcctcctccggcgggaccctccccggaggcgccccgccccccctgtgtagttcctggcgaaggtcacgcccccccgggggtatggcccacacagaatctccggtccccgcgggggcgtgggttattcccttcgaccgggggggccgcccagaaagacaggcccaccgttcccccgaccacccacggggcgcccggggcccgccaccccacacn

SEQ ID NO: 31671 - DNA, 667 bp, Zea mays
  misc_feature: Ceres CLONE 1408108-F
agtggatcccccgggctgcaggaattcgcacgagaccattacctagaacatcctaatcgaaaaacagttttcatgtcctacctacagagattcagcttaccggcatcggcgctcggaccccgaccgtcggctggtcggcacgcgcactctcgcaagcaaaactacaagctcgcttttttaaaatctgtccctgcaattctctcctctgttcccactcattaagatcccaccgcctcccgccggccgccgccgacgagcaccgcagcctgaaccagagccgcgggcgagccatcgcgtgcggcctcgcccgggatggcgaccatggagagcctgatcgggctggtgaaccggatccagcgcgcgtgcaccgtcctcgggaccacgggggcgggcggccgatgagggctcccctctgggaggcgctcccctccgtcgctgtcgttgccgggcagagttcccggaaaagccgtcggtgcttgagagaataaaaagggaaggacttcctgccccggtggaatcggtaatcgatacaagaggtacctttagtggttgctgctccaccagaacaaatggctgaggcagaacaaatgataggagtgtcgcaaccgacccgtgtggaaaacgagaacaccacattttgaatgattggaacgtgaacgataaacgc

SEQ ID NO: 31672 - DNA, 678 bp, Zea mays
  misc_feature: Ceres CLONE 1408109-F
  misc_feature (452)..(452): n is a, c, t, g, unknown, or other
  misc_feature (556)..(556): n is a, c, t, g, unknown, or other
  misc_feature (652)..(652): n is a, c, t, g, unknown, or other
  misc_feature (659)..(659): n is a, c, t, g, unknown, or other
ggcggccgctctagaactagtggatcccccgggctgcaggaattcgcacgtgaccattacctagaacatcctaatcgaaaagccacaacatcacgaaaggaccggatcttggtgagctcgagggtacatgacgcggttcttcctatcgcggcaggtgaccaggacctctatcccctccttgatggaggtcggggactgggatggaggccagggactcgacggcggtgggcctggaggtggcggcaaaggcctcggcgtcgacggccgcggcggtgcgcatttctcggctcgttcattcttgtgccctccttcgattacttcatttcgtcgcgtcccaaatcggtcgatggaaaatggaatctcgatggcttttgttaaatctggattgctatgcatgtctagcgatgcacttgggatttttggtacagtgagattggtagccgcacatgggnaatctcgatggcttttgtaaaatctggattgctatgcatgtctagcgatacacttgggatttctggcaccgtgggagattggtagttgcagatgggatacaggnggcccttagtgaagtggcagcagaagactggaataatggggggtgtacacatcttcttcatctggacgttgaagcaatggtctcagttcccttggnggggggncggttaatgcttctttgga

SEQ ID NO: 31673 - DNA, 785 bp, Zea mays
  misc_feature: Ceres CLONE 1408110-F
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (785)..(785): n is a, c, t, g, unknown, or other
tgcccccccccnccnnnnncccgccccccagggtgggtaaggaaaatttttcataactgcagctccccgcggtggcggccgctctagaatagtggatcccccgggctgcaggaattcgcacgagaccattacctagaacatcctaatcgaaaagtctcgcctctcccttggttcctcgcggcgacgactgggagagcgcctcctcccctccctcactccctccgtgagctcctcgccggcggtgcgcgccgccgcccgtcgccacgtcttctccgctgacgtgggctcaccagatccaatgaaggctgccaacttgacgcaaggtgttcaagaaatttagaccatgcactcttcatcggaggttcaaggcaatatctgtgctaatcttgaggaccttcagtagattgctgagagttctccttgatacgggggaataaagatccaaataagtttttgacattgatctgtagccagtactgcaatgggtatgaagcttgcgggtcctcgggatcccctgggatgttgaccctgaagggttacgagagtacatggtccagttttgaaccccctagacgattgtgtcgtccatgagggagcgggctttctgggacgatctcggcggggttctggctatggtacaatttcgcccccagactgaacgatgccagaaaaatggttcctttgattggcgagacatggtttctttgggggaaggccggaaacatttaagggagggggcaagggtcagctttaacttccccaaagggggagagaataatgggccn

SEQ ID NO: 31674 - DNA, 655 bp, Zea mays
  misc_feature: Ceres CLONE 1408111-F
  misc_feature: Encodes the peptide sequence at SEQ ID NO. 31675
  misc_feature (294)..(294): n is a, c, t, g, unknown, or other
cgcggtggcggccgctctagaactagtggatcccccgggctgcaggaattcgcacgagaccattacctagaacatcctaatcgaaaagcgacgaatcagacagccggactcaagtcgacgcccggcgaattgcccgatactatggagggagacgatcggagggccccgctgctggcggacgacgtcggccgtcccccgtctctgcggcgccgtgactcggagcggtcgctgcgcaacagcttcctgacgcgaatgcccgacatgggcgcgccggtctcgacccggagcacttcncgacgtcgacgtctccaggacaagggttggtccggaggtgggaaaccgtctaccataactgctccccccctgaaaaacttcaggaggggaaggggccttcctgcccgaaatccttcggaggggggggcccacccccaggggggggaaaaagggtagggttcccccgggggctcctttttggccttttggggggtattttttggggaaaagccccccaacctgtggtttgtggtttttttttaaccgcccccccctaaaaaaatttgggggaagtttttttttgttcccccaccctcccgggggttttttgggcccccaaaaaaaaaaaaatttttcttgccccgcccccccgcgtgggccc

SEQ ID NO: 31675 - protein, 102 aa, Zea mays
  misc_feature: Ceres CLONE 1408111-F
MEGDDRRAPLLADDVGRPPSLRRRDSERSLRNSFLTRMPDMGAPVSTRSTSRRRRLQDKGWSGGGKPSTITAPPLKNFRRGRGLPARNPSEGGAHPQGGEKG

SEQ ID NO: 31676 - DNA, 655 bp, Zea mays
  misc_feature: Ceres CLONE 1408112-F
  misc_feature: Encodes the peptide sequence at SEQ ID NO. 31677
gctcttaactagtggatcccccgggctgcaggaattcgcacgagaccattacctagaacatcctaatcgaaaaaaccacgatgctctgctcgaccaccgccgatatctatggtcggattaggttcgctgccctcttcgcctcagctgtttcccgaggtctccctgcggcgacggtcaccgtagtggactccggcctcccccacggcgaccgacaaaagggtgagagagtgcaagaacctacggtacaccggcctcacgaacagctccatcaacaatctctttgatctcatcacggaccaaggtacgggagacctacgcttcaccgcctttgccctctcctccagctagaaaaattgttcctgattccatcaataaccaaggtatgaacagttaaaagctattgcaatatacaactgcaaatttcattgttttgggccactttggcttatggaagaaatttcgaaaggggtccggcttatttaattgaccctaagtgaaaatgattggggttggggcccataagggggctcaaaagactatccattttcttggcggaatattaaccttagggcccaatttttattttgcccaattgggggcctttggggaatggttaaacaccacattacggggggccccggacaacactttattt

SEQ ID NO: 31677 - protein, 67 aa, Zea mays; identical to SEQ ID NO: 27643
  misc_feature: Ceres CLONE 1408112-F

SEQ ID NO: 31678 - DNA, 803 bp, Zea mays
  misc_feature: Ceres CLONE 1408113-F
  misc_feature (706)..(706): n is a, c, t, g, unknown, or other
  misc_feature (776)..(776): n is a, c, t, g, unknown, or other
  misc_feature (778)..(778): n is a, c, t, g, unknown, or other
  misc_feature (803)..(803): n is a, c, t, g, unknown, or other
caagctggagctcaccgcggtggcggccgctctataactagtggatcccccgggctgcaggaattcgcacgagaccattacctagaacatcctaatcgaaaaatcgcaagatgtttgtttccattccatcggtggcacgagacaggagacgccaaggccatagctagagcctagagcagcagcagaggcttgacctgaagctccacccgccatggcattcacgcccgctacggcctgctgcaaggcttccctggcgctggcaccgcgggcgtcgccccgcgggccggggtcctgcgcgcaggcgacgctcctctgcacgtcctccaactccgtgttcccgcggtctccgggtagccctcatctgacgacccccccccaaagccggtgggcactcggaggcgacaaccggccacagacctccgccaatggctcccacgggcatcctgtctgcccaactttcaccctcccccgttgcataaaccgctcttcccaccgtcgtcctcaacccatataactccctacagcccccgcctagcctctccccccccaccccgcgcctcaccaaccacgaccaaaatcaccaccacccacattctcccctcttctccggggtcactcatcctcgcgaatatctcactacagtcgcgccctcctcccggctggccctcccacgcctgttaatcagcccacgcctcccgccctcttntcgcggcgccaccccccccttatgcactccgtcgcgcctcttaagaccctgctgcgacacaccacagtgnancccccctctccctcacacgcgcccn

SEQ ID NO: 31679 - DNA, 731 bp, Zea mays
  misc_feature: Ceres CLONE 1408114-F
tccccgcggtggcggccgctctatgaactagtggatcccccgggctgcaggaattcgcacgagaccattacctagaacatcctaatcaaaaaacccaaaatcctacgcagagacatgagtggcggcggcggcggcggcggggaggaccggatcagcatcctcccggacggcgttatcggcgagatcgtcacccgccttcccaccgccgatgccgtccgcgttcaggtcctctctcgccgttggcggcacatatggatctcctgtccgttgaacctcgatctcggttccccaaactactacaccgactacaagcgcgtcgtgtccggaatcctcgcgccccaccctggcccctgccgccgcctcaaaggtgactgggcgaacgaagacggtgagtcgtacaaccactggtttccggtctcccgcctgtgccggccctccagaagtccgagaccgagcccacaaactcttctctgcgggctagaaacaaacaccgggcctccggtccttcatttctctctcccgcccttacccgccactattttcctgttcgctcccgccgtctgccttgctccaccctacgcgctactcacgctcccccccccaggtcaggatccaggtcagcattcttcgcattgccccactctttggctgctttcgatgtcgcctgcgtcgccttgccacttcgtatgctcttctgccttctccctggatttgcgcccgctcacctcccg

SEQ ID NO: 31680 - DNA, 663 bp, Zea mays
  misc_feature: Ceres CLONE 1408115-F
  misc_feature: Encodes the peptide sequence at SEQ ID NO. 31681
  misc_feature (521)..(521): n is a, c, t, g, unknown, or other
tccccgcggtggcggccgctctagaactagtggatcccccgggctgcaggaattcgcacgagaccattacctagaacatcctaatcgaaaaggtgatagttctgattcccaggcaaggaaccctcttatcccttctcgtctcctgtcccgggaccggggaggccgggatcgagaaggggaacgagcgcgtcccgtgctcgccactcctcgccgatggcgtcctccactctgccagcctcccccttccgtatgtctcttcccggactacgagccccggaccctgctaaggttaagcacgtatccgttcgaacccccgctcgccgtcttcccgttgcagcctccgcggcaccatcaggcgccgcggcggcggcggcgagggagcgcaggcgtttcctggagcgctacgggctcaacccaaacgacttcgaggaagatgcagaggataatccgagggtctactccaattattctgaacttattcgtaatgcttgtcgctgcgaattggtgtgattttgagtggnatgctttctcttttcattttttgcaggaggagagaaaggacaggcgaaggcggaggcagtcggggagaggggagcaaactgcggaagcggcagtggctccggggaaggggaggagcctcgggagatcacaaatggtccaggg

SEQ ID NO: 31681 - protein, 98 aa, Zea mays; identical to SEQ ID NO: 25203
  misc_feature: Ceres CLONE 1408115-F

SEQ ID NO: 31682 - DNA, 694 bp, Zea mays
  misc_feature: Ceres CLONE 1408116-F
  misc_feature: Encodes the peptide sequence at SEQ ID NO. 31683
  misc_feature (599)..(599): n is a, c, t, g, unknown, or other
aaaagtggagctccccgcggtggcggccgctctataactagtggatcccccgggctgcaggaattcgcacgagaccattacctagaacatcctaatcgaaaaactgcgatgtggtcctctcctcctatcacctgacctccacacacacacacagacagacaggcacgcgcaagcaaaaattcattcatatatgcacgctcgttcgttgtcgatctcccccatcactgcacggcgcggcgcaacaagagcgagggattggagctcagctagtcgtctaatcagctagtaggtacgtgtagctaggctgcgctgcaccagctgccgtgcatgcagtgcatggcgcaggagggctctgaggcctccgtcgccagctccccgccgccccagccgccgccgtcggcctcctcctggtggcgcgacatgcagcacccggctgcctacggcgcgtggcctccgtcccccgcggcgaggtggccgccccgggtatcgatggcgccggcagcgacgcagcagcagcagcagcacggcggcgggggcgacgacgtccctccgacggtctctcggcctcaacgcccaccgtagcgtccttcaccaaccanctcccgggtccgggctcagccgggacttccgcgggtggaaaattgaaagccccacccctatcacaaaaaaaaccctcaccacataccccttcctt

SEQ ID NO: 31683 - protein, 84 aa, Zea mays
  misc_feature: Ceres CLONE 1408116-F
MQCMAQEGSEASVASSPPPQPPPSASSWWRDMQHPAAYGAWPPSPAARWPPRVSMAPAATQQQQQHGGGGDDVPPTVSRPQRPP

SEQ ID NO: 31684 - DNA, 661 bp, Zea mays
  misc_feature: Ceres CLONE 1408117-F
  misc_feature: Encodes the peptide sequence at SEQ ID NO. 31685
  misc_feature (555)..(555): n is a, c, t, g, unknown, or other
  misc_feature (598)..(598): n is a, c, t, g, unknown, or other
  misc_feature (621)..(621): n is a, c, t, g, unknown, or other
  misc_feature (661)..(661): n is a, c, t, g, unknown, or other
tccccgcggtggcggccgctctagaactagtggatcccccgggctgcaggaattcgcacgagaccattacctagaacatcctaatcgaaaacccactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggcaacagccggccccgccgccgcaggcgctccgctctacctctccctctccgcccggtggccgcgcactctgctcggattgctggtgagatgcccaaagcctttgtgatcttaggatgatgttgtgcaacacaccctgactaatttgcacagtattcacaaaagcttactaattttggcaggccaagggctgagggaacaaattctcagaaagtgtactttatgatattttgagagaaggtccaagggnccttttggtgatgcaacatatcaaacactcactagactcgggnagcaatggacgccctgcccaatnacattttgcattctgcatctcgggatatgttggtcaacan

SEQ ID NO: 31685 - protein, 99 aa, Zea mays
  misc_feature: Ceres CLONE 1408117-F
MATSPPQNPSSGEPSDASSLAAAALEAPVRVWRSLVARFPPLPDSSSFLAGVSDLQLRYFGNSRPRRRRRSALPLPLRPVAAHSARIAGEMPKAFVILG

SEQ ID NO: 31686 - DNA, 756 bp, Zea mays
  misc_feature: Ceres CLONE 1408120-F
  misc_feature: Encodes the peptide sequence at SEQ ID NO. 31687
  misc_feature (224)..(224): n is a, c, t, g, unknown, or other
  misc_feature (256)..(256): n is a, c, t, g, unknown, or other
  misc_feature (283)..(283): n is a, c, t, g, unknown, or other
  misc_feature (291)..(291): n is a, c, t, g, unknown, or other
  misc_feature (337)..(337): n is a, c, t, g, unknown, or other
  misc_feature (389)..(389): n is a, c, t, g, unknown, or other
  misc_feature (429)..(429): n is a, c, t, g, unknown, or other
aagctggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcgggcatcatggcgcgggaggagcangcgctgctgtcgacggagatcgtgaaccgcgncgtggagccgtcgggcccggacgccgnctcgccgncctttctcgtgcgcgtgcgccgccgccctgcgtacttcctgcagtncgtgaaccctcagtacgtgcgccctcggtaccactacctcatcagccacggngtgtacctggcaccatccccgtcatcgtggctggtgtgcngccgccgagctgggcaccctcaccgcgacgagctgtggcgcaaggtgggggggggaaggccacctacgaccctcgcaccgtggtcgccctccctcggccgtcctcgccttcaccatctccgtttaaatcaatgcccagcccaagggccggggaccccatccaaatttccagggtaaaagccggccgaacgagctcaagggggccccaaggggggaattcatcgacctgggggccaaagtccggaaaagttcaacgagagaaccccgtggggttcccaatccggggtggtggggcaatcccggtattcggggaaaaaagttaaatggc

SEQ ID NO: 31687 - protein, 132 aa, Zea mays
  misc_feature: Ceres CLONE 1408120-F
  misc_feature (6)..(6): Xaa is any aa, unknown, or other
  misc_feature (17)..(17): Xaa is any aa, unknown, or other
  misc_feature (26)..(26): Xaa is any aa, unknown, or other
  misc_feature (29)..(29): Xaa is any aa, unknown, or other
  misc_feature (44)..(44): Xaa is any aa, unknown, or other
  misc_feature (75)..(75): Xaa is any aa, unknown, or other
MAREEXALLSTEIVNRXVEPSGPDAXSPXFLVRVRRRPAYFLQXVNPQYVRPRYHYLISHGVYLAPSPSSWLVCXRRAGHPHRDELWRKVGGGRPPTTLAPWSPSLGRPRLHHLRLNQCPAQGPGTPSKFPG

SEQ ID NO: 31688 - DNA, 486 bp, Zea mays
  misc_feature: Ceres CLONE 1408122-F
  misc_feature (174)..(174): n is a, c, t, g, unknown, or other
  misc_feature (370)..(370): n is a, c, t, g, unknown, or other
ccccgcggtggcggcgctctagaactagggtcccccgggctgcaggaattcgcacgagaccattacctagaaatcctaatcgaaaaaagtagtcaagtctcaaccacctccccaagccgcgtggagccctcatccagatcggagccagcgcgccgtgtgatgcgttccggcgtngagtagctgtctgccccgacccagagccatggcggaggatggcgaggagaagctgctcgcgacggggcagcgcatcgttcagacgttgggagccgcgacaccctggaggaggaattccccaagggggttctcaaaataaagggggcgcccttccctttgaaaagttttaacccccggggggccccctttttgtttntggggggggggcaaaaaaaaacttataaagaaaaattttaaaaaagtttttttgtgacaaccccccccccccgggggggggggggggcccccccctgtgtggagagcccccggggt

SEQ ID NO: 31689 - DNA, 725 bp, Zea mays
  misc_feature: Ceres CLONE 1408123-F
  misc_feature: Translation starting site: 217
  misc_feature: SWISSPROT Homolog: EC 1.4.1.2 Glutamate dehydrogenase
  misc_feature (493)..(493): n is a, c, t, g, unknown, or other
  misc_feature (519)..(519): n is a, c, t, g, unknown, or other
  misc_feature (645)..(645): n is a, c, t, g, unknown, or other
aaagctggagctccccgcggtggcggccgctctagaactagtggatcccccgggctgcaggaattcgcacgagaccattacctagaacatcctaatcgaaaaatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgatccgtcagtgcagagtgacatgaagctatggncgttcaaggtcatcccagggcctggntgacagcccatgattgtagtgaactacaagggcgaggagaaacagtttgctgctgaggagatctccttcatggtcctcatcaagatgaaggagattgctggagcctaccttggttcaccatcaagnacgcagtggtgaccgtgccggtctacttcacgactcgaaagagggcaccaaggggaccccggtgtcttgcgggcctaagg

SEQ ID NO: 31690 - DNA, 605 bp, Zea mays
  misc_feature: Ceres CLONE 1408124-F
  misc_feature (395)..(395): n is a, c, t, g, unknown, or other
ggagctccccgcggtggcggccgctctagaactagtggatcccccgggctgcaggaattcgcacgagaccattacctagaacatcctaattgaaaacttccaatttttctcccaaataaaaaccagccgcagcgggaggtggcgcgacgcgaacccacccaccctgcgaacccggccgcaaaattctcctctcggattccgccgccgcgaaccgtcccctcgacgaggctgctgcgatagatttttcttaccattcgaatagttgatgagcgagaatacagagcaagaatcttgatggtgcgtgtggtacaacttggttaaggaaagctgactgcttgaagtgaccatgttggaccatcttgctatcattgcgtctgagttaggggacgacgcancggattttgagggtgatggcatcgacaacctcagcgagaaacgatgtcagcgactaggagatcgatgctgacgagctcccccgacaaatgtggaaaggacagggtcaggctaaagaggatcagggaagaggcaggaaaaacctttgccctggagcggcttggaacttggaaaaaacccagcaaccaaaaatatttccaaaccccaccccc

SEQ ID NO: 31691 - DNA, 684 bp, Zea mays
  misc_feature: Ceres CLONE 1408126-F
  misc_feature: Encodes the peptide sequence at SEQ ID NO. 31692
  misc_feature (413)..(413): n is a, c, t, g, unknown, or other
  misc_feature (472)..(472): n is a, c, t, g, unknown, or other
  misc_feature (580)..(580): n is a, c, t, g, unknown, or other
  misc_feature (625)..(625): n is a, c, t, g, unknown, or other
aaagctggagctccccgcggtggcggccgctctagaactagtggatcccccgggctgcaggaattcgcacgagaccattacctagaacatcctaatcgaaatctagaaatccacttcgattcgccctggacgctcctgcctcctgctagtcgacgcgcaatccttggcaatctggcagacaggtgaggcgctgagcctgctactactaactaggagccgcggcgggaaatgagggatgcggaggcggcgtcgcgccggcggtggacgctggtgctggtgaacatggcgtcggtgctggagaaggcagacgaggtgttgctgcccgccgtgtacaaggaggtgggcacggcgctgggcgcttctccgaccgcgctgggctccctcaccctctgccgcgcgctcgtccaggccgnctgctacccgctcgccgcctacgcctccgggcgccacgatcggggcccgtgtccgtccnccgtgggagcctttcctctggggccgccgcaccttcccttcgtcggccggtctcgggagctttcctcccagatggccgatcctcgcgggggctcaaacggcatcgggnctcgcgctggcccctcccggcgatcagctcggctcgtcgccgacntacaccgatgaccacaccccgtggcgcgggccccttcgggtgggctggcagatgacccg

SEQ ID NO: 31692 - protein, 135 aa, Zea mays
  misc_feature: Ceres CLONE 1408126-F
  misc_feature (62)..(62): Xaa is any aa, unknown, or other
  misc_feature (82)..(82): Xaa is any aa, unknown, or other
  misc_feature (118)..(118): Xaa is any aa, unknown, or other
  misc_feature (133)..(133): Xaa is any aa, unknown, or other
MRDAEAASRRRWTLVLVNMASVLEKADEVLLPAVYKEVGTALGASPTALGSLTLCRALVQAXCYPLAAYASGRHDRGPCPSXVGAFPLGPPHLPFVGRSRELSSQMADPRGGSNGIGXRAGPSRRSARLVADXHR

SEQ ID NO: 31693 - DNA, 670 bp, Zea mays
  misc_feature: Ceres CLONE 1408127-F
  misc_feature (172)..(172): n is a, c, t, g, unknown, or other
ggagctccccgcggtggcggccgctctagaactagtggatcccccgggctgcaggaattcgcacgagaccattacctagaacatcctaatcaaaaaaccctcatggaagcgtggccacctctcgcccacggggcggccactccggactgtgtcttgtcgtgttgagcaatgncaacggtgcagctcaaggacgagtaccacgattcagcgtggaagcgatgtaccgcatcgtggcgagctgcggcaactctagcgccgtggcagtcgacgtggtggaccccaaaagcggaaatctccggggggctccgatctctccaattgcggggggagcccttggttaccgtgggccccaagtggtcgaagaaggcccccaaaaaaccccgggcgggggcgcctcgggcttccctccccggttccccctgagaaccggtgaaactgtccccggaaatcccttaaaaaaacttccaaattttgcaaggaaaaaggggaatccccaaaactttttaaaagttgcaaaaaaagaatttttgggcttggggttaaactgttgtaaaaattgggaaaacagggggaaaaagccccttttggggaaaacccccccccccccccccgggggggggggaaaaggaaaaaaaaatttttacaaaaacttaaaaggcccggggggtgg

SEQ ID NO: 31694 - DNA, 725 bp, Zea mays
  misc_feature: Ceres CLONE 1408129-F
  misc_feature (528)..(528): n is a, c, t, g, unknown, or other
  misc_feature (643)..(643): n is a, c, t, g, unknown, or other
  misc_feature (659)..(659): n is a, c, t, g, unknown, or other
  misc_feature (660)..(660): n is a, c, t, g, unknown, or other
tggagctccccgcggtggcggccgctctagaactagtggatcccccgggctgcaggaattcgcacgagaccattacctagaacatcctaatcgaaaaacaccccacatcacaacagctccctctgcatctccgcctcgtcgccgtcgtctgcctgcacaaccttcttcttcatctctctctcttcttccgctgccaccctcccagcaccgagggaaggtaagcccacccaggaatctccgtcccgctcccggccgccgtcccttctcataatcgcatcggatctgtattgggttttcagtaaggagcagaaaacgccttagggaatgcagaaagatgtgcttgcacgtcgaagagctactttgtgagggacttggcaggaaagcacgccatactcttcattctctgccacctcttgatgacttcgaagctcaagagtacacgtatctccacctcgtgcttcggcacaatggggggttcgacgtggcggctcaaccgtcttcttaatcaccatctcggtggaaaaaggntgaagtcttcacaccctctcgacctctttgctgtctccaaattttttttttactgtcagggataagcaagtggacctctgtgtgcataccaccaccaccatacgtagcatacacnggcacagatgcagagnnttaaaggaaacgtctcttgacaagtatgaaaaatggggaaattgcttggccaggcactttttgca

SEQ ID NO: 31695 - DNA, 776 bp, Zea mays
  misc_feature: Ceres CLONE 1408131-F
  misc_feature: Encodes the peptide sequence at SEQ ID NO. 31696
  misc_feature (48)..(48): n is a, c, t, g, unknown, or other
  misc_feature (320)..(320): n is a, c, t, g, unknown, or other
  misc_feature (333)..(333): n is a, c, t, g, unknown, or other
  misc_feature (407)..(407): n is a, c, t, g, unknown, or other
  misc_feature (410)..(410): n is a, c, t, g, unknown, or other
  misc_feature (422)..(422): n is a, c, t, g, unknown, or other
  misc_feature (423)..(423): n is a, c, t, g, unknown, or other
  misc_feature (429)..(429): n is a, c, t, g, unknown, or other
  misc_feature (459)..(459): n is a, c, t, g, unknown, or other
  misc_feature (462)..(462): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (583)..(583): n is a, c, t, g, unknown, or other
ctggagctccccgcggtggcggccgctctagaactagtggatcccccngggctgcaggaattcgcacgagaccattacctagaacatcctaatcgaaaaatcaaacccccggacatttctggtcgcaccctcctccggccctcccagccgctaagccctctggaaccttcgagagctcgatcggatcggagcccctgccatggccgacgaggcgaaggcgaagggtaatgcggcgttctcagccggccgcttcgaggaggcggcgcggcacttcacggacgccatcgcgctcgccccgggcaaccacgtcctctactccnaccggtcgggggngctcgcctcactccaccgctactccgacgctctcgccgacgcgcagaagaccgtcgagctcaagcctgactggnccnagggctactccnngctcgncgcgcgactccgggcccttcggggacgccnccngggccgtcgccgaaaaacaagaagggccttgcgctcgacccccagcacgagggcctcaaggggggggctcgaggaccccaaaaaggcgccgcgccgnnnnggggggtggggggtttttggnccccaaaccttggggaaaagggttcagggcccccaaaatgggggaaaaaaaagggttcaaaccccacaagagggggttaattaaaggggcccatttttttgtagaggtgggcgggaggggggaggacaccccgggggttccgtgggggtccccccccccccccggggggggggggggccccccccgggttagg

SEQ ID NO: 31696 - protein, 155 aa, Zea mays
  misc_feature: Ceres CLONE 1408131-F
  misc_feature (2)..(35): Pfam Name: TPR_2 Pfam Description: Tetratricopeptide repeat
  misc_feature: SWISSPROT Homolog: EC 3.1.3.16 Phosphoprotein phosphatase
  misc_feature (41)..(41): Xaa is any aa, unknown, or other
  misc_feature (45)..(45): Xaa is any aa, unknown, or other
  misc_feature (70)..(70): Xaa is any aa, unknown, or other
  misc_feature (71)..(71): Xaa is any aa, unknown, or other
  misc_feature (75)..(75): Xaa is any aa, unknown, or other
  misc_feature (77)..(77): Xaa is any aa, unknown, or other
  misc_feature (87)..(87): Xaa is any aa, unknown, or other
  misc_feature (88)..(88): Xaa is any aa, unknown, or other
  misc_feature (121)..(121): Xaa is any aa, unknown, or other
MADEAKAKGNAAFSAGRFEEAARHFTDAIALAPGNHVLYSXRSGXLASLHRYSDALADAQKTVELKPDWXXGYSXLXARLRALRGRXXGRRRKTRRALRSTPSTRASRGGLEDPKKAPRRXGGWGVFGPQTLGKRVQGPQNGGKKRVQTPQEGVN

SEQ ID NO: 31697 - DNA, 721 bp, Zea mays
  misc_feature: Ceres CLONE 1408134-F
  misc_feature: Encodes the peptide sequence at SEQ ID NO. 31698
  misc_feature (667)..(667): n is a, c, t, g, unknown, or other
caaagctggagctccccgcggtggcggccgctctagaactagtggatcccccgggctgcaggaattcgcacgagaccattacctagaacatcctaatcgaaaaatgaccgactagcccatggtctctctccgctccgacgcgcccgacccaccaccacatccctcatggctgccctcgccgacatcgactcctcggcacttccgccgtccgagtcatccaaaggcaagggcaagatggacaaggaggaggaggacgaggcgaagggcgcggagaagatgtgcggcatctgctatctcgacggccggcgggccatccgcggcgagctcgactgctgcgcccatttcttttgctttgtctgcatcatggcttggggccgcgtcgagtcccgctgtcccttctgcagggcccgcttcacaccatccgccgcccgcccgtcgccggccggttccccgacgagcgaatcgtctcgatccaagagcgcaaccaggtacaccatcctcagggcaacgggagcagcatagtgggcggagatccttacgtgaacacatatgcacccgttgcagcagctccagcgatgactagctgctgctactctgcgagctctgcgactcagctgcacacacttactgtgtcgggctggggaccacgtgcccagaggggactggntctgcaagactggcggacgatcagagatgatcatttgagatgggcagctgagaa

SEQ ID NO: 31698 - protein, 118 aa, Zea mays
  misc_feature: Ceres CLONE 1408134-F
MAALADIDSSALPPSESSKGKGKMDKEEEDEAKGAEKMCGICYLDGRRAIRGELDCCAHFFCFVCIMAWGRVESRCPFCRARFTPSAARPSPAGSPTSESSRSKSATRYTILRATGAA

SEQ ID NO: 31699 - DNA, 729 bp, Zea mays
  misc_feature: Ceres CLONE 1408138-F
  misc_feature: Encodes the peptide sequence at SEQ ID NO. 31700
caaagctggagctccccgcggtggcggccgctctagaactagtggatcccccgggctgcaggaattcgcacgagaccattacctagaacatcctaatcgaaaacatagagatagagatagacagctagcttcatcagtaggatgggcagcgacgaggaagcggcgctgctggtgccggcggtggaggagggttgccccgggtgcgtgatggagcggcggaaggcgagcagcaacggcaggatcccctacagggagctgttcttcgtcgccgccacctccctcgcctcagctttaccgatcacgtgcctcttccccttcttgtatttcatggtaagggacttccgcgtcgctgaaacagaggaagacatcggattctatgctggttttcttgctgcgtcgtacatggtgggcagaggcttctcttccatcttctggggcgtcatcgcagaccgcgttggacggaagcctgtcatcacgttttcgatactggtcgtggtcgtattcagcgcgctgtttggtctgagcacgacgtactgggatggcgatcgccacgaggctcgtgctgggggctctcaacggctgctcgccccgataggcggacctgtggcttgaaagtttgccaaacccagcaccaggggctgggactcccgttgggaacccggattgggctctggggcccccattggtgggccccgctcttggggggcaccctttccagcccggtgaaaa

SEQ ID NO: 31700 - protein, 156 aa, Zea mays
  misc_feature: Ceres CLONE 1408138-F
MGSDEEAALLVPAVEEGCPGCVMERRKASSNGRIPYRELFFVAATSLASALPITCLFPFLYFMVRDFRVAETEEDIGFYAGFLAASYMVGRGFSSIFWGVIADRVGRKPVITFSILVVVVFSALFGLSTTYWDGDRHEARAGGSQRLLAPIGGPVA

SEQ ID NO: 31701 - DNA, 728 bp, Zea mays
  misc_feature: Ceres CLONE 1408139-F
  misc_feature: Encodes the peptide sequence at SEQ ID NO. 31702
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (30)..(30): n is a, c, t, g, unknown, or other
  misc_feature (728)..(728): n is a, c, t, g, unknown, or other
nnnnnnnnnnnnnnnnnnnaacaaagacanacgccccccgccgccgcaccacaccaaaaaactggagctccccgcggtggcggccgctctagaactagtggatcccccgggctgcagcaattcgcacgagaccattacctagaacatcctaatcgaaaagatttcgcaagctcctggttacggcggcatctatcgttccgccgcatcgtctctctcgcgacgctgccccagaccgccgagataatggctggccaccgaaacagtcatggaaagcgccagtctgattttactgaaaatggaggcggaaagagaagaaatcctggcgatgatacatatgcacctggccctgatgacactgtgtatcgctacctctgtctctagaaaaattgggagtatcattggcaggcgcggagaaattgcaaagcagttgaggaatgagacccaagctaagatcaggattggcgagagcgcccctggatgggatgagcgagttattaccatatttagcaccagcaggaaaactaataccatcgatggcgcctgaagatgaaggtttgcccctgcttcaggatgcccctctttagagttcaatgacaggtttgcccagtgatcgagggtccttcgggaaacgaagacccgccaaagaaaattctcccactccaaggttaactggttccgcattggcatggggggcccatccagaaacccagaaattgggaaaggccatn

SEQ ID NO: 31702 - protein, 92 aa, Zea mays
  misc_feature: Ceres CLONE 1408139-F
  misc_feature (30)..(89): Pfam Name: KH_1 Pfam Description: KH domain
MESASLILLKMEAEREEILAMIHMHLALMTLCIATSVSRKIGSIIGRRGEIAKQLRNETQAKIRIGESAPGWDERVITIFSTSRKTNTIDGA

SEQ ID NO: 31703 - DNA, 664 bp, Zea mays
  misc_feature: Ceres CLONE 1408140-F
aaagctggagctccccgcggtggcggccgctctagaactagtggatcccccgggctgcaggaattctttctatatcttacctagaacatcctaatctataaattttgttcatgagacggcgaaattatcggatctaccttcttcctctctcaacgaggcaccctctacatgcaacaactggagcgcaaagattattgacagagggacatcgcacttacatgttctcgctacctagcgctcgtactcagcccgactccgtcctcctttccctctctagatctctctctgcgattctcgtaacattggttcctgctccctcactaaaggtggtagataactgtcttccctgatctatctagatgatgccgaccacgacgtcaacgaccaccgtcgtaacagcagccgccaccaccaacaagccgagaaagacgtcctccgccctctgcacagggtggccggagcctggacgagaagatctcctgcggggcgatgctaccccacccgtccgaaagcccaaacagcaggcactgcaaaagcgtccaccatcggctcctccgaagagcccacttggtctgccccccggaacctggaggccctcgacaccgtaaactcggcataatcctcagcggggccccccacaaccaattggaaacgcggtgaaaag

SEQ ID NO: 31704 - DNA, 694 bp, Zea mays
  misc_feature: Ceres CLONE 1408141-F
  misc_feature: Encodes the peptide sequence at SEQ ID NO. 31705
  misc_feature (433)..(433): n is a, c, t, g, unknown, or other
  misc_feature (434)..(434): n is a, c, t, g, unknown, or other
  misc_feature (494)..(494): n is a, c, t, g, unknown, or other
  misc_feature (670)..(670): n is a, c, t, g, unknown, or other
cgcggtggcggccgctctagaactagtggatcccccgggctgcaggaattcgcacgagaccattacctagaacatcctaatcgaaaaattcgtccatcccacctaccatggccaccgcctccggcactgacgccggtgcccagccgcgcgacgaccccagcctcctccccttcgcgtccttctcgctcggcctctccatccgcgcgccggccacccccacactcgcctccgtcccctccaccctccacctccccactcaaatctctacactcgccgtctgcctccacccctccgccgcgcagccctcctcccgccgcaccacccgcctcaattccgccacctcctccgtcatcgccccgctgccctcctcaacgcccggcctctcccgctccttccccttcgggcgcgcccgccgcagcagggcgccgccganncgctcgtctggttccgcgccgacctccgcctccagaaccatgagccgttcacgccgcagnggggggggcgtcgtcctccctccctccccgttttcgtctttcgatcccgcgggacttcggcaagtccccccctcggggttccgcaccggaacggggcccgtacccgcgccaacttctggggtttcgattcgggcgcccgaccttgcgccggagctccgggtgggcccggggtgggngaaacctgggggggggccccgtgg

SEQ ID NO: 31705 - protein, 195 aa, Zea mays
  misc_feature: Ceres CLONE 1408141-F
  misc_feature (109)..(109): Xaa is any aa, unknown, or other
  misc_feature (129)..(129): Xaa is any aa, unknown, or other
  misc_feature (188)..(188): Xaa is any aa, unknown, or other
MATASGTDAGAQPRDDPSLLPFASFSLGLSIRAPATPTLASVPSTLHLPTQISTLAVCLHPSAAQPSSRRTTRLNSATSSVIAPLPSSTPGLSRSFPFGRARRSRAPPXRSSGSAPTSASRTMSRSRRXGGGVVLPPSPFSSFDPAGLRQVPPSGFRTGTGPVPAPTSGVSIRAPDLAPELRVGPGWXKPGGGPR

SEQ ID NO: 31706 - DNA, 735 bp, Zea mays
  misc_feature: Ceres CLONE 1408142-F
  misc_feature: Encodes the peptide sequence at SEQ ID NO. 31707
  misc_feature (355)..(355): n is a, c, t, g, unknown, or other
  misc_feature (380)..(380): n is a, c, t, g, unknown, or other
  misc_feature (526)..(526): n is a, c, t, g, unknown, or other
aagctggagctccccgcggtggcggccgctctagaactagtggatcccccgggctgcaggaattcgcacgagaccattacctagaacatcctaatcgaaaacttccgtccttggcaaccaggcccaggcatcgtttcaccgttattcctcctgccccatctcctcccgatccatccgagcccaaaccctagtccagccagatctccgccgccgccgtcgagagcacggcatcatatccgccgcgatggcgttccgccgcatcttatccacaggggtgcgccgccgctcgaccatcgccgcgtcagcggccgtgaacgaacgcgaggtctctacgtccgatgccgcggcgtccggngtgctatcccacgacgcgacgccgntgtgcgctaccgtgatagcgtagtatcgcatcgcccaagacgttaccatgcggctgcaggggattgagcaccagaccgccgctttcctcgggtatgataggccccgtagcgttccacgacgaacacacgggcagtcctggttgggncggagacccgggtcaccacgcttgccaacggcctgcgggtggccaagaaatctcccctcgccggggaactgatacggggggtggggggcatcaatgcgggcagcatgcaccaaaaacaggatgcggcccgcgacgcgcattttgccagcccctgcgggcaaggggccagggaaacccaccccccccacctggaaccagggaattgcctc

SEQ ID NO: 31707 - protein, 52 aa, Zea mays
  misc_feature: Ceres CLONE 1408142-F
  misc_feature (46)..(46): Xaa is any aa, unknown, or other
MAFRRILSTGVRRRSTIAASAAVNEREVSTSDAAASGVLSHDATPXCATVIA

SEQ ID NO: 31708 - DNA, 662 bp, Zea mays
  misc_feature: Ceres CLONE 1408143-F
  misc_feature: Encodes the peptide sequence at SEQ ID NO. 31709
  misc_feature (199)..(199): n is a, c, t, g, unknown, or other
  misc_feature (391)..(391): n is a, c, t, g, unknown, or other
  misc_feature (394)..(394): n is a, c, t, g, unknown, or other
  misc_feature (662)..(662): n is a, c, t, g, unknown, or other
aagctggagctccccgcggtggcggccgctctagaactagtggatcccccgggctgcaggaattcgcacgagaccattacctagaacatcctaatcgaaaaatctctctcgctttctctagccatgacgctggtgaggatgccttgccgcctctgctgcttcctgctcgtcgtcgccgcctccgccgtctccggggggnggcgggtggtcaccaccctcccgggctacgagggccgcctccccttccacctcgaaacagggtatgtggaggtggacgaggacgccggcgcggagctcttctactacttcgtccgggccgagtccggcgccgacgacagcgacaccccgttcgtcctccggatccccgcccccaacggtgggctgcttcagnggnctcgcctaccaaataggtcccatcatgtttgtcgtggagccctaccacgcagcttgccgcgcctgccctacaaccaaaatcggggaaaaagggggcgcatattctttttggggattccccaggtggggcccggttttccttctccccaagaggccaaggttaccacgctgggagcggtatccaaccccatgggctttggggaaagtcccccccaagggggtcaatgaccatcccgggaaacatgggaatccttttttacttcgagggn

SEQ ID NO: 31709 - protein, 165 aa, Zea mays
  misc_feature: Ceres CLONE 1408143-F
  misc_feature: SWISSPROT Homolog: EC 2.3.1.92 Sinapoylglucose--malate O-sinapoyltransferase
  misc_feature (26)..(26): Xaa is any aa, unknown, or other
  misc_feature (90)..(90): Xaa is any aa, unknown, or other
  misc_feature (91)..(91): Xaa is any aa, unknown, or other
MTLVRMPCRLCCFLLVVAASAVSGGXRVVTTLPGYEGRLPFHLETGYVEVDEDAGAELFYYFVRAESGADDSDTPFVLRIPAPNGGLLQXXRLPNRSHHVCRGALPRSLPRLPYNQNRGKRGRIFFLGIPQVGPGFPSPQEAKVTTLGAVSNPMGFGESPPQGGQ

SEQ ID NO: 31710 - DNA, 626 bp, Zea mays
  misc_feature: Ceres CLONE 1408144-F
  misc_feature (342)..(342): n is a, c, t, g, unknown, or other
  misc_feature (354)..(354): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
aaagctggagctccccgcggtggcggccgctcaagaactagtggatcccccgggctgcaggaattcgcacgagaccattacctagaacatcctaatcgaaaaattccaaaagctctcgagacttcctcagcaatcaatcagctttccagcgatcggcagctcctcgatcgtttcgaagctccaatccgcccggccgcctccgcctgttgccactagctaggtgatccatcgaatggactgcggtggctcgctgcagctcccgactgggttccgcttccaccccaccgatgaggagctgcgtgatgtactaatctcctcccgcaaagtggggtggtctggcgntcgcggcgcggnatcgccgaggggatctctacagttcgaccatggcagctcccgaaaaaggggtcggtggaaagaagattggtatttcttttggccggggaccgaaagaaccgtattgggttccaggccaaaaccgggggggccccgaaaaaggtatcgggaggggcccccccggccctaaataacccgggtaagggaccccccggcccccccggggcccnnnaagggttttttttcccccacaaaattaaacccccccccatcggggnnnnnnnnnnnnnnnn

SEQ ID NO: 31711 - DNA, 676 bp, Zea mays
  misc_feature: Ceres CLONE 1408146-F
  misc_feature: Encodes the peptide sequence at SEQ ID NO. 31712
  misc_feature (263)..(263): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (305)..(305): n is a, c, t, g, unknown, or other
  misc_feature (315)..(315): n is a, c, t, g, unknown, or other
  misc_feature (382)..(382): n is a, c, t, g, unknown, or other
  misc_feature (424)..(424): n is a, c, t, g, unknown, or other
aaagctggagctccccgcggtggcggccgctctagaactagtggatcccccgggctgcaggaattcgcacgagaccattacctagaacatcctaatcgaaaaagtgccaccgcgctcgcggcggccatgaacattaagcagccgctgcacggcgcatcgacgctgttcgcgctgctctctctctcgctgctcctcctccgcctgctcctccgcctccgcctggccgccttccgcgacgcggcgctgtcgctccacctggtggngcgcnnntcgctccgcccccgtctccctctgctcccaggagnctgccacgancggcgcgccggcgccggcgccacacgctgcgcgtctggtgcccgccaccccatcctcgaaggcgcgntgctcctctccacggtttcggggggacgccaggtgacgtggngggaacctcccgggctgtccgccattccagtggtacggccgaactcgtgtcttcgggggaatcccggcccggtccccctgggtccgggggttcaggccccgtggccccccaggcatggcccccctcggggcccccttaaaaggggggggagaaaaaacgggtttccccccaccacgatggcccccccaaggaaagaaaccccggggaaaatttttattttaacaccggggggggggccccccccggggaaga

SEQ ID NO: 31712 - protein, 183 aa, Zea mays
  misc_feature: Ceres CLONE 1408146-F
  misc_feature (46)..(46): Xaa is any aa, unknown, or other
  misc_feature (48)..(48): Xaa is any aa, unknown, or other
  misc_feature (60)..(60): Xaa is any aa, unknown, or other
  misc_feature (63)..(63): Xaa is any aa, unknown, or other
  misc_feature (86)..(86): Xaa is any aa, unknown, or other
  misc_feature (100)..(100): Xaa is any aa, unknown, or other
MNIKQPLHGASTLFALLSLSLLLLRLLLRLRLAAFRDAALSLHLVXRXSLRPRLPLLPGXCHXRRAGAGATRCASGARHPILEGAXLLSTVSGGRQVTWXEPPGLSAIPVVRPNSCLRGNPGPVPLGPGVQAPWPPRHGPPRGPLKRGGRKNGFPPTTMAPPRKETPGKIFILTPGGGPPPGK

SEQ ID NO: 31713 - DNA, 726 bp, Zea mays
  misc_feature: Ceres CLONE 1408148-F
  misc_feature: Translation starting site: 188
  misc_feature: SWISSPROT Homolog: EC 1.1.1.85 3-isopropylmalate dehydrogenase
  misc_feature (294)..(294): n is a, c, t, g, unknown, or other
  misc_feature (312)..(312): n is a, c, t, g, unknown, or other
  misc_feature (702)..(702): n is a, c, t, g, unknown, or other
  misc_feature (703)..(703): n is a, c, t, g, unknown, or other
tggcggccgctctagaactagtggatcccccgggctgcaggaattcgcacgagaccattacctagaacatcctaatcgaaaaaccacccttctctcctccgcatccccccggccggttcctccctgccgccgcggtcgctgtgcgaagccttgcgaatcaccgttgtccgggctgtggggggctggcatggcgctccggaggctgctgcaggggagtgtcctgccgcgggtaaccggcagggcttcggcaccggccgtggcgccgtttttcacggagtccggagagaccatccngtgccaccctccttttcnggcgacggcatcgggccagagatcgccgagtcttgtcagcaggtattcaatggttgcagggtaccattggaatggaaagaccctatgttgggaacgaaagtggttccaaaaaaaaaaaattttttgacttggaaaaacctggggaaccagggggaaaaaaacaagttgggtttgaaaaggcccatgggtccccccttggggagggggcccccccctctttaaactacaaaaaagaagaaaaaaagtggtcctcatatccaaggggggggccttaaaaaccccccccccggttaaaaaaaaaaaaaaagggggtgttctcccctctcggcactccgcaaaaaaaaaagagaagaaaaataatcggtctccaccccacagggggggaggagnncgtaaaaaaaaagctattttacc

SEQ ID NO: 31714 - DNA, 780 bp, Zea mays
  misc_feature: Ceres CLONE 1408150-F
  misc_feature: Encodes the peptide sequence at SEQ ID NO. 31715
  misc_feature (362)..(362): n is a, c, t, g, unknown, or other
  misc_feature (371)..(371): n is a, c, t, g, unknown, or other
  misc_feature (372)..(372): n is a, c, t, g, unknown, or other
  misc_feature (426)..(426): n is a, c, t, g, unknown, or other
  misc_feature (441)..(441): n is a, c, t, g, unknown, or other
aaagctggagctccccgcggtggcggccggctctagaactagtggatcccccgggctgcaggaattcgcacgagaccattacctagaacatcctaatcgaaaaacggtccaccgacgactcttcttcctcacctcctcccgctccagctccagctcgtctctctcctcgcctcgcgtagggtttcgcttcccgtctcgccgccgtcagcatgggggacaactacgatgacgaaggcgagccgatcgtgaacctcgacgaacgggaaccctcccctgagcatcagccgtacgaagacctcgatgacgacctcgacggcggcggcgattggaccccgcgacgctctccgaccccccgtcacggngacgacggnnggggcagggtcctcctccaagccccgaaagcgcctttctcagaaagggcggcgntggaggcatgcccgncgatgaagggcctgaatgacttttgggttgaaggacgaaggaccggaaccctttcggttgagggaagaaaaaagaagggtctcctcttccttgagggaccctccgaggggcggggcgggaacgggaaaaaaaagttaaaaaattgggtgggggacccaccgggggggggagggaccttgggatggggggggaaaagggggaaaaaggagaaagaaccccaggggggagggaacaccaaggtgtgggggaagagagaaaccccgggttttgaaaaacattttggggggggggggcaaaaagaacccacaaaaagggttaacaaccccgtttgtgtttttt

SEQ ID NO: 31715 - protein, 190 aa, Zea mays
  misc_feature: Ceres CLONE 1408150-F
  misc_feature (55)..(55): Xaa is any aa, unknown, or other
  misc_feature (73)..(73): Xaa is any aa, unknown, or other
  misc_feature (78)..(78): Xaa is any aa, unknown, or other
MGDNYDDEGEPIVNLDEREPSPEHQPYEDLDDDLDGGGDWTPRRSPTPRHGDDGXGRVLLQAPKAPFSERAAXEACPXMKGLNDFWVEGRRTGTLSVEGRKKKGLLFLEGPSEGRGGNGKKKLKNWVGDPPGGGGTLGWGGKRGKKEKEPQGGGNTKVWGKRETPGFEKHFGGGGQKEPTKRVNNPVCVF

SEQ ID NO: 31716 - DNA, 681 bp, Zea mays
  misc_feature: Ceres CLONE 1408151-F
  misc_feature: Encodes the peptide sequence at SEQ ID NO. 31717
  misc_feature (312)..(312): n is a, c, t, g, unknown, or other
  misc_feature (316)..(316): n is a, c, t, g, unknown, or other
  misc_feature (681)..(681): n is a, c, t, g, unknown, or other
gctctagaactagtggatcccccgggctgcaggaattcgcacgagaccattacctagaacatcctaatcgaaaacccactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggcaacagccggccccgccgccgnaggngctccgctctacctctccctctacgcccggtggccgcgcactctgctcggattgctggtgaaatgcccaaagcctttgtgatcttaaatgatggtgggaaccccccctgactaatttgccaggattcccaaaaggttactattttggagggccaggggggaggaaaaatttcccaaaaagggattttatgtattttggaaagaggcccagggccctttgtttggggcaaatttaaacccccccaaaacccgggaaaagtggcccccccccaaaaaaatttttctttcgccccgagaaggggggggaaaaaaaccctcccccccaaaaaaaaaaaaaccggggggccgtttttcttttagagaaan

SEQ ID NO: 31717 - protein, 105 aa, Zea mays
  misc_feature: Ceres CLONE 1408151-F
  misc_feature (70)..(70): Xaa is any aa, unknown, or other
MATSPPQNPSSGEPSDASSLAAAALEAPVRVWRSLVARFPPLPDSSSFLAGVSDLQLRYFGNSRPRRRRXSALPLPLRPVAAHSARIAGEMPKAFVILNDGGNPP

SEQ ID NO: 31718 - DNA, 666 bp, Zea mays
  misc_feature: Ceres CLONE 1408153-F
  misc_feature (576)..(576): n is a, c, t, g, unknown, or other
tccccgcggtggcggccgctctagaactagtggatcccccgggctgcaggaattcgcacgagaccattacctagaacatcctaatcgaaaagccgcaacccctctctcattttcttcctcgtctacacctccttctctcctcctcgatacattcgagcacgcccggacgcggtcagaagggagaaagcagcaagcggcgccgggttccccctcccttcgtcgcccccgatcgacgccgatcggggccgactgctcgtgggggacgccgaccgaagcccgggcggcgctgcttcaatatacggaagcagtttctagttttcttcagttcgccgctgcagtttctagtttccagcggttcccaccagttgtctaaaaaacttattgttgttgtacgtggaggttgcttttgtcgtatttgccaggttggctttttgttgtatttgccaggtgacaacactttgggtgttgtaatcattgcctatttttgggtcatgacttggtttttatggaaaatcatggctgccaaggttcactaaatccttgatgcaacataatagatcccccatgctgtcttcntcagagattgccagtttggttctagttctagcaaccctgtcatggatcggcaggatttactcccaacactcaaacggggatgacagattt

SEQ ID NO: 31719 - DNA, 742 bp, Zea mays
  misc_feature: Ceres CLONE 1408155-F
  misc_feature: Encodes the peptide sequence at SEQ ID NO. 31720
  misc_feature (16)..(16): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (28)..(28): n is a, c, t, g, unknown, or other
  misc_feature (29)..(29): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
aaaggaaaaagggggnaannnggggggnncgaaaaatnnnnnnttctcannnnnnaaaagctggagctccaccgcggtggcggccgctctagaactagtggatcccccgggctgcaggaattcgcacgagaccattacctagaacatcctaatctaaaactcttcgtcgtcctatcttataatcgcatttcgaaatccccaaacggaggcctcgccactcttccgaacctgaacaatcaccaccgttattaagaagatgatgcgctgcgctgcaacgggcggcgggtgcgtcgcttcgtggagcggagattggagattgccggcggacaacccctgcagcgtgcggatgccgacgggcaacgatgggaggtgcgccggcctgagggcgcgggcggcggatctcgccggcctcgagatggacaacctgcccgccggcggcggggggctcttccgcgcgagcccgcgctacagacgcttgcaagccaccggcgggggttgacccatgagagatgccactggggcaggggacaaagggaaatcctcaggaacaagtggggccaaaaagaagggggggaacaagattgggaaaaaatgccgggatcgaaaaacccatctggaaaggggggcaaaaggccggagaatggaacactgtcgggggaagggccccctggggggcacccctgaaaaaaagccggcccataggcagggggaacgccccggggcgaacacacgccaatgtggg

SEQ ID NO: 31720 - protein, 80 aa, Zea mays
  misc_feature: Ceres CLONE 1408155-F
MMRCAATGGGCVASWSGDWRLPADNPCSVRMPTGNDGRCAGLRARAADLAGLEMDNLPAGGGGLFRASPRYRRLQATGGG

SEQ ID NO: 31721 - DNA, 681 bp, Zea mays
  misc_feature: Ceres CLONE 1408156-F
  misc_feature: Encodes the peptide sequence at SEQ ID NO. 31722
  misc_feature (637)..(637): n is a, c, t, g, unknown, or other
aagctggagctccccgcggtggcggccgctctagaactagtggatcccccgggctgcaggaattcgcacgagaccattacctagaacatcctaaaaaaaaaacggttaaacccatgccgctaatcgacgccgccgcctcggcggtcgcgccgcccccaccccggcgagtggctcaactccgcttcttcagcactcgcagacccggaatcctatccctaactgccaccagctgctccccctcccctccgcccccggtcgctgcggaggtgcctgcggcgccacaggaagcgaagtcgaagccgaggccacggcggtacccgaagcagtaccccggcgagtcggtgggcgttgctgaggagatgcgctttgtcgccatgcgcctgcgtaaccccaagcgcaccaccataaaagacaagtcggggacggaggacgcggacgccggggcgggcgtgtcggagggcgaggctgaggaggacgacggcggggggcgtgaaggaggaacacgagggaggaggatgaagggcgagctcgaggaaggggaaatggatgcccagcaatggaagggttccgtgcgaatacctgggggacaaggagtttccgccttcggaaaccatccgagcgggtcgggggccgaatncccccgaatgccgccctgggaagtcacaagttcctccttcccca

SEQ ID NO: 31722 - protein, 189 aa, Zea mays
  misc_feature: Ceres CLONE 1408156-F
  misc_feature (175)..(175): Xaa is any aa, unknown, or other
MPLIDAAASAVAPPPPRRVAQLRFFSTRRPGILSLTATSCSPSPPPPVAAEVPAAPQEAKSKPRPRRYPKQYPGESVGVAEEMRFVAMRLRNPKRTTIKDKSGTEDADAGAGVSEGEAEEDDGGGREGGTRGRRMKGELEEGEMDAQQWKGSVRIPGGQGVSAFGNHPSGSGAEXPRMPPWEVTSSSFP

SEQ ID NO: 31723 - DNA, 774 bp, Zea mays
  misc_feature: Ceres CLONE 1408158-F
  misc_feature: Encodes the peptide sequence at SEQ ID NO. 31724
  misc_feature (15)..(15): n is a, c, t, g, unknown, or other
  misc_feature (774)..(774): n is a, c, t, g, unknown, or other
ttacccccccccccncccccctccactattatttattgtgtcgttttttaatactgcggctccccgcgggggcggccgctctagaactagtggatcccccgggctgcagtaattcgcacgagaccattacctagaacatcctaatcaaaactccactgctctgctgctcctcgcgccgccgcagcgacgtaatggcttccgccgcggtgctccggaacgccggctcccggcgcctcttctcctaccctactctccgcgccgctgcgatatatgtaccttctgcgctacccgatgcgcccgcggcggcggcagcgccggcccagccgccaccgacggccgggaccctctgggcgaggtctatggccaccttcacgcgcacgaagccccatgtgaacgtcggcaccattgggcacgtcgatcacggcaaaaccactctcactgctgccattaccaaggtcctggccgagggcagggaaggccaaagccgttgcttttcgacgagatcgacagggctcccggaggagaaagccagaggaatcaccattgcgacagctcacgtcgaagtatgagaacggctaaaaggcattatgcttcaccgttgattgtcaaggtcacggcaagattatgtccaagaacatgatccactggagctgctcaaaagggatagggggggaattttcttggccgggcccacattccctgaaagggccccgatgccaccaaactaagggaggaatattccttttttggccccgcacaagagttgggcggaan

SEQ ID NO: 31724 - protein, 125 aa, Zea mays
  misc_feature: Ceres CLONE 1408158-F
MASAAVLRNAGSRRLFSYPTLRAAAIYVPSALPDAPAAAAAPAQPPPTAGTLWARSMATFTRTKPHVNVGTIGHVDHGKTTLTAAITKVLAEGREGQSRCFSTRSTGLPEEKARGITIATAHVEV

SEQ ID NO: 31725 - DNA, 757 bp, Zea mays
  misc_feature: Ceres CLONE 1408160-F
  misc_feature: Encodes the peptide sequence at SEQ ID NO. 31726
  misc_feature (468)..(468): n is a, c, t, g, unknown, or other
  misc_feature (546)..(546): n is a, c, t, g, unknown, or other
  misc_feature (595)..(595): n is a, c, t, g, unknown, or other
  misc_feature (680)..(680): n is a, c, t, g, unknown, or other
ggagctccccgcggtggcggccgctctagaactagtggatcccccgggctgcaggaattcgcacgagaccattacctagaacatcctaatcgaaaaccttcgctgtcctctctggctaaaaagaaccgcagaaagatcgttttttttccctgtccccgttcttgcactcgagttcttcagttcttaggaatagtcagacggaacaactcgagtttgccatggtggtgatctggaaccggggtgtgctgccccctctttgattccctgattggtctcgctccagttcgacgcgggatttggacgggacgggcggaagttgggagagcagagcggccggcatgtttgggtccagggtccaggatgaggtggagatgcagaggaggcctaacaacaggatctttcccgacgagagacaaaatcaatctaagtcattgtatcaaactacacgggctgacagatttggcgcanatagaatagatctgaagaatcctgagaagcttaaggtgttaaatgaaagcaacaaaccctggcaccagcgtattcagnaccctggaagtaatattgtactgagatggaacagggtgaccttgggggnaatgtttgtttgctctttattatagatccttttttctattacgttccattgattagacaagtggagggggattcttcatgtgttngcaagggaccaggactgagcataaagatcactgtcctacgaatcacgttgctgaccttattttacatgttgacatta

SEQ ID NO: 31726 - protein, 93 aa, Zea mays
  misc_feature: Ceres CLONE 1408160-F
  misc_feature (44)..(44): Xaa is any aa, unknown, or other
  misc_feature (70)..(70): Xaa is any aa, unknown, or other
  misc_feature (86)..(86): Xaa is any aa, unknown, or other
MFGSRVQDEVEMQRRPNNRIFPDERQNQSKSLYQTTRADRFGAXRIDLKNPEKLKVLNESNKPWHQRIQXPGSNIVLRWNRVTLGXMFVCSLL

SEQ ID NO: 31727 - DNA, 670 bp, Zea mays
  misc_feature: Ceres CLONE 1408163-F
  misc_feature: Encodes the peptide sequence at SEQ ID NO. 31728
  misc_feature (647)..(647): n is a, c, t, g, unknown, or other
  misc_feature (648)..(648): n is a, c, t, g, unknown, or other
aagctggagctccccgcggtggcggccgctctagaactagtggatcccccgggctgcaggaattcgcacgagaccattacctagaacatcctaatcgaaaaatcatcagtcatcacataccgccaagaccacatcggcacatcgacgtgagctcgtgcgtgagtgccctggtcgacgaccgctcgcgcgccatggactcaacgacgacggcgccgctgctgcagccgtccgccgcctcgagcaaggaggggccggggccggcgccggctcagcacggtgagggcagccgggagctggaggcgatcctggccgacgcgtccaagccgtgggcttggcgggcctgggaaggcgcccgcctggagctgccgctgctgctgcgggtggcgctgccggcggtggccgtctacatgatcaacttcgtcatgtccatgtccacgcagatcttctgcggccagctcggcaacctcgagctcgccgcctcctcgctcggcaacaccggcatccagcccttggcctacggcctcatgctgggcatggggcagcgccggtggagacgctgtggcaggcaggcgtacggcgcgcacaacacgcattgggtttgggggtgtacctgcagcggctccgacggtgctgctcatggccaccgnncgtgccggttgacccgtcgtct

SEQ ID NO: 31728 - protein, 159 aa, Zea mays
  misc_feature: Ceres CLONE 1408163-F
  misc_feature (153)..(153): Xaa is any aa, unknown, or other
MDSTTTAPLLQPSAASSKEGPGPAPAQHGEGSRELEAILADASKPWAWRAWEGARLELPLLLRVALPAVAVYMINFVMSMSTQIFCGQLGNLELAASSLGNTGIQPLAYGLMLGMGQRRWRRCGRQAYGAHNTHWVWGCTCSGSDGAAHGHRXCRLTRR

SEQ ID NO: 31729 - DNA, 646 bp, Zea mays
  misc_feature: Ceres CLONE 1408164-F
  misc_feature: Encodes the peptide sequence at SEQ ID NO. 31730
  misc_feature (262)..(262): n is a, c, t, g, unknown, or other
  misc_feature (444)..(444): n is a, c, t, g, unknown, or other
  misc_feature (584)..(584): n is a, c, t, g, unknown, or other
tccccgcggtggcggccgctctagaactagtggatcccccgggctgcaggaattcgcacgagaccattacctagaacatcctaatcgaaaaaggaaaaggagccgaggaagccctcccctctcgccgcagccgcaccaccagaccgacaaccggccggcttccctcgcccccggcgaggagtgaagacaagccgacaaggcaaaaccatcgcctgtacggtatccaaccgccgtcccgccgcacaaccaaggatagggcggngagagggggatctcgctttcgctccgctgccgcatgcgcaccgcccctcctcatgacaccaactagggcaccaccagcccccttctcgtcgacctccgcgcggtgactctgctgagcatcatacccttatagggcccgacccatggatgtaacttcgaccgctgccgcctccgcctcaggcngggggtaggtggtacacgggcatgtccgcggataacatcaagggcctggtgctcgcgctctcctccagcctcttcatcggcgccagcttcattatcaagaagaagggactcaagaaggccgcatcctccgcgtcgaaacngggggggttggtggctattcttatttatatgaggctccttttggtgggttggcatgataaca

SEQ ID NO: 31730 - protein, 60 aa, Zea mays
  misc_feature: Ceres CLONE 1408164-F
  misc_feature (40)..(40): Xaa is any aa, unknown, or other
MSADNIKGLVLALSSSLFIGASFIIKKKGLKKAASSASKXGGLVAILIYMRLLLVGWHDN

SEQ ID NO: 31731 - DNA, 672 bp, Zea mays
  misc_feature: Ceres CLONE 1408165-F
  misc_feature (316)..(316): n is a, c, t, g, unknown, or other
tccccgcggtggcggccgctctagaactagtggatcccccgggctgcaggaattcgcacgagaccattacctagaacatcctaatcgaaaaagaaatacgcacctgctcctcactcttctttatatttttttctccatttggcaacttttgcttgtcgttcatgtatatgcatgaccctttccacatatgatcagaagataagcacatgcaagacgatctcgcgtggatatgatgcatggatcagaccctacctctatatcatcacccaaacgctcgtagatgatgctataccattccctggttaaattatttttnaggaaaaaaaaaagaaaccggacggggcttccttaaaaattaaaaaataaatgggctgccaatggacaaccttttgcctgggccagggaaaattgtgggaacccccctggaaccgggagggggccccaattctccggccccttaatccggaaatttcccccggggggaacggattttttaaccccctttcccccccccggggggcccccaaaaaaacccggggttttaagtggggggggggtttcccccccccccccccccaattcccgcgggaaaaataaccacccttttggccgggggaaaaagggcccccgcggggggccccctttttttagaaaaaaaaaaaaaagaaaaag

SEQ ID NO: 31732 - DNA, 666 bp, Zea mays
  misc_feature: Ceres CLONE 1408169-F
  misc_feature: Translation starting site: 334
  misc_feature (323)..(323): n is a, c, t, g, unknown, or other
  misc_feature (329)..(329): n is a, c, t, g, unknown, or other
  misc_feature (387)..(387): n is a, c, t, g, unknown, or other
  misc_feature (388)..(388): n is a, c, t, g, unknown, or other
  misc_feature (430)..(430): n is a, c, t, g, unknown, or other
  misc_feature (431)..(431): n is a, c, t, g, unknown, or other
  misc_feature (434)..(434): n is a, c, t, g, unknown, or other
  misc_feature (439)..(439): n is a, c, t, g, unknown, or other
  misc_feature (453)..(453): n is a, c, t, g, unknown, or other
  misc_feature (454)..(454): n is a, c, t, g, unknown, or other
  misc_feature (456)..(456): n is a, c, t, g, unknown, or other
  misc_feature (460)..(460): n is a, c, t, g, unknown, or other
  misc_feature (463)..(463): n is a, c, t, g, unknown, or other
  misc_feature (475)..(475): n is a, c, t, g, unknown, or other
  misc_feature (476)..(476): n is a, c, t, g, unknown, or other
  misc_feature (484)..(484): n is a, c, t, g, unknown, or other
  misc_feature (488)..(488): n is a, c, t, g, unknown, or other
  misc_feature (499)..(499): n is a, c, t, g, unknown, or other
tccccgcgggtggcggccgctctagaactagtggatcccccgggctgcaggaattcgcacgagaccattacctagaacatcctaatcaaaacgaaggaacctgctcggcctcgccgtccccggcgcgtggagcgcgtcgcgtccgccacacgcaccgaccatcccctgccctcatcagcaatccccggcccgcagcgtacaaatacacgctccccgccgctccgacctcactttccccgcctccatcaccaattcacgatctcctttcccgcaccgcgccccggatcgccggctcgcaattccggagttaaattcccctccanccgcancgtcatgggcggctcccacagccgcgaggacgtcgatctcacctcctcccgacgaganngagaatttcgagacgactatgacgcccgatcacccatcgcgnnagncgcancgagcggcgggaanngngaanaanaacttccttcgnnacgcacancttncttcgtttgangcatcggacgccagctcagttcgctggatctcaagaacaaaagaactaccggcggccaggtctaccctcccggtggggggggcctccccttccggggggttgggtggcccgcaagacccgggaaacctatgatttggtgaacaaggtaaggggagacgctccccccc

SEQ ID NO: 31733 - DNA, 681 bp, Zea mays
  misc_feature: Ceres CLONE 1408172-F
  misc_feature: Encodes the peptide sequence at SEQ ID NO. 31734
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
aagctggagctccccgcggtggcggccgctctagaactagtggatcccccgggctgcaggaattcgcacgagaccattacctagaacatcctaatcgaaaaaaggaaacgtcacgtcaccaccacacacctcttcggctcttcctcttctcctccgtatagcggcgggcctccgtcgccccccttccaccccgttttgccgccccgcaggccacagcccaaaatcctcctcgtcgctggtgccctctccgcggcctcctccgccagccatggccgccgctgggcccgggctctactccgacatcgggaagaaggcaagaggtctcctgtacaaggactaccacactgggacgggagttcacgctcaccacttacgccggcaacggagcttttcagggcgcgtgtcaccatggacatgaagcaccgcgtcgtccgcgccatgatcgcgggtagcatgggaggacggtgatggcgcacccgtgcatgtccaggataaggaccgagtcgggcattactgctgcagcaccagggaagatgaagctatctttaaaaaatcccggggccagctgagcacaaaaatgggggtccnnnnnnnnnnnnnnnnnnnnnnnctcgnnnnnnnnnnnnnnnnnnnnnnnnnnnnnnnnnnnnnnnnnnnnnnnnnnnnnnnnnnnnnnnnnnn

SEQ ID NO: 31734 - protein, 49 aa, Zea mays
  misc_feature: Ceres CLONE 1408172-F
MAAAGPGLYSDIGKKARGLLYKDYHTGTGVHAHHLRRQRSFSGRVSPWT

SEQ ID NO: 31735 - DNA, 747 bp, Zea mays
  misc_feature: Ceres CLONE 1408174-F
  misc_feature: Encodes the peptide sequence at SEQ ID NO. 31736
  misc_feature (526)..(526): n is a, c, t, g, unknown, or other
  misc_feature (527)..(527): n is a, c, t, g, unknown, or other
  misc_feature (655)..(655): n is a, c, t, g, unknown, or other
aaagctggagctccccgcggtggcggccgctctagaactagtggatcccccgggctgcaggaattcgcacgagaccattacctagaacatcctaatcgaaaagtcctcttctagtcgcctctacccagttacttgcatcgccccgtcaagcacgccgccggcacgcggccctcggtctccccgccgcgccctctgcctccgcccgaacaaagccgtctcgccgtcgtgttgccttccttaccgtccaccgcgggcagccgtcctagtactcggttggtcctcccctgctgcccttctacggtggaggagcggagatcctgccgttttccggctgatttcttctaattgcggggcaagttccgtcgatagtcaatactgcttgtgctgttgagctaatattaagttcctgctgggagaacttctgcagttcctatggcaaagcctctcaatggcagtggccgtagcatgccaagatcgaatgagggaatgcggctcatattttcggcagttgtaggtgtcatgctgnngttacctgtttgggatctccttccctacagtcaacataaccaagcttcacttcccttcgagtatcatctcttatatcgaagataggaactctggcatcacaacccagacattgttgaaccatggcttngcatctgcaaacatcataaaaaagatagttctgaaatctacactgatgaaatcccccgagatttaatgtcctaccaacccaaagagtgctga

SEQ ID NO: 31736 - protein, 59 aa, Zea mays
  misc_feature: Ceres CLONE 1408174-F
  misc_feature (32)..(32): Xaa is any aa, unknown, or other
MAKPLNGSGRSMPRSNEGMRLIFSAVVGVMLXLPVWDLLPYSQHNQASLPFEYHLLYRR

SEQ ID NO: 31737 - DNA, 644 bp, Zea mays
  misc_feature: Ceres CLONE 1408178-F
  misc_feature: Encodes the peptide sequence at SEQ ID NO. 31738
tccccgcggtggcggccgctctagaactagtggatcccccgggctgcaggaattcgcacgagaccattacctagaacatcctaatcgaaaaccacagcctccccagcatcagtgaagctcgctcaccgtcattcgacgacgccctcccgcacacacgaccatggccgcggcgatgaccggcagtgctcgcgccagcaccggctccttgctcgtgcttctcttcgtcgcgctggccggcgcgaccgccggggcgagtgccaccgttgccttcagcagcggcgacagcaacgcggcggcgctgctgacgacgccagcatcggcgtccccggggcagctgaacggcatcatccagtgccttatgggctgcttcacgcagttgttcggctgttcgttcggatgcatgggcaagcagggcgctgacctgccgctctgcatcatcagctgcgacagaagaagcgtcgtgtgcatggtcagctgcggccttgcgccgtcaccgccatcaccgtcgccgcccacgcccaaaccaccagcacccaagccgcccacgcccaagccgcccggcccgctaaaacccccgccgtaggcggccgctggcggtcaccggacgcacatctggcctgattatgtcgactggtgcctgccag

SEQ ID NO: 31738 - protein, 140 aa, Zea mays
  misc_feature: Ceres CLONE 1408178-F
MAAAMTGSARASTGSLLVLLFVALAGATAGASATVAFSSGDSNAAALLTTPASASPGQLNGIIQCLMGCFTQLFGCSFGCMGKQGADLPLCIISCDRRSVVCMVSCGLAPSPPSPSPPTPKPPAPKPPTPKPPGPLKPPP

SEQ ID NO: 31739 - DNA, 752 bp, Zea mays
  misc_feature: Ceres CLONE 1408179-F
  misc_feature: Encodes the peptide sequence at SEQ ID NO. 31740
  misc_feature (275)..(275): n is a, c, t, g, unknown, or other
  misc_feature (407)..(407): n is a, c, t, g, unknown, or other
  misc_feature (449)..(449): n is a, c, t, g, unknown, or other
  misc_feature (545)..(545): n is a, c, t, g, unknown, or other
  misc_feature (635)..(635): n is a, c, t, g, unknown, or other
  misc_feature (742)..(742): n is a, c, t, g, unknown, or other
aaagctggagctccccgcggtggcggccgctctagaactagtggatcccccgggctgcaggaattcgcacgagaccattacctagaacatcctaatcaaaaaaccctagcgccgcaccctcccgcccaccgccgtcgccgcccaaccgcagtaaggaggaaggagcaggaagatgccggcggggcacgggctgcggtcgcggacccgcgacctgttcgcgcggcccttccgcaagaaggggtacatcccactcaccacgtacctgcgcacctacnagatcggcgactacgtcgacgtcaaggttaacggcgccgtgcacaagggcatgccgcacaagttctaccacggccgcaccgggagcgtctggaacgtcaccaagcgcgccatgcggcgtcgagatcaacaangcaggttaatggccgcatcatcaggaagcggatccatgtccngcgtggagcatgtgcagccctccgttgccaacggaggagttccgcttgaggaaagccaagaatgaccagctcaagcggatgcaagggcccgcgggntgaggtgatcagcaccaagaggcagcctgtgggacccaactggcttcaggggggttgagggtgctacactcgagacagcactctatttcntttatgatggtggcaacgatcctcagggcgttaactagaaggagaatttttgtaccttcaggcagtcaacgagctggcaacttatctggatctttttgaaaaatggnctaggtcttt

SEQ ID NO: 31740 - protein, 113 aa, Zea mays
  misc_feature: Ceres CLONE 1408179-F
  misc_feature (2)..(101): Pfam Name: Ribosomal_L21e Pfam Description: Ribosomal protein L21e
  misc_feature (35)..(35): Xaa is any aa, unknown, or other
  misc_feature (79)..(79): Xaa is any aa, unknown, or other
  misc_feature (93)..(93): Xaa is any aa, unknown, or other
MPAGHGLRSRTRDLFARPFRKKGYIPLTTYLRTYXIGDYVDVKVNGAVHKGMPHKFYHGRTGSVWNVTKRAMRRRDQQXRLMAASSGSGSMSXVEHVQPSVANGGVPLEESQE

SEQ ID NO: 31741 - DNA, 731 bp, Zea mays
  misc_feature: Ceres CLONE 1408181-F
  misc_feature: Encodes the peptide sequence at SEQ ID NO. 31742
  misc_feature (577)..(577): n is a, c, t, g, unknown, or other
  misc_feature (686)..(686): n is a, c, t, g, unknown, or other
  misc_feature (687)..(687): n is a, c, t, g, unknown, or other
aagctggagctccccgcggtggcggccgctctagaactagtggatcccccgggctgcaggaattcgcacgagaccattacctagaacatcctaatcgaaaagccgcttccaaatcccaataataccatcgcgtaaatccagatatcagggcagctggaactgaaggtggcgggagccgagtgatccggcggtgagctgagcggggcgggatggcggcggagcaggggcggtcgctggcggagacgcccacctggtccgtggcaaccgtcaccacgctcatggtcgctgcctgcttcctcgtcgagcgctccctctcgcgcttcgccaagtggctgcgcaagaccaagcggaaggccatgctcgccgcgctcgagaagatccgcgaagagctgatgctgctcggagtcatctcgctgctgctcagccagacggcgcgcttcatatcggagatctgcgtgccgtcctcgctcttcaccagccgcttctacatctgctccgagagcgactaccaggacctgctgcgcaacacggacgccaaccagacggcgtcgacaagaaccatggtcggtggccaacngctgccgtcctggtggcgagggcatggaacctttttgttttcgtacgagggccttgagcagctgcaccggtttctcttcatcctggaatcactcagggggggggaagtnntttaaaaaaaggggggtggttttgccccaaggacaaaataataa

SEQ ID NO: 31742 - protein, 159 aa, Zea mays
  misc_feature: Ceres CLONE 1408181-F
  misc_feature (4)..(160): Pfam Name: Mlo Pfam Description: Mlo family
  misc_feature (123)..(123): Xaa is any aa, unknown, or other
MAAEQGRSLAETPTWSVATVTTLMVAACFLVERSLSRFAKWLRKTKRKAMLAALEKIREELMLLGVISLLLSQTARFISEICVPSSLFTSRFYICSESDYQDLLRNTDANQTASTRTMVGGQXLPSWWRGHGTFLFSYEGLEQLHRFLFILESLRGGEV

SEQ ID NO: 31743 - DNA, 703 bp, Zea mays
  misc_feature: Ceres CLONE 1408183-F
  misc_feature: Pfam Name: HSF_DNA-bind Pfam Description: HSF-type DNA-binding
  misc_feature (330)..(330): n is a, c, t, g, unknown, or other
  misc_feature (333)..(333): n is a, c, t, g, unknown, or other
  misc_feature (334)..(334): n is a, c, t, g, unknown, or other
  misc_feature (339)..(339): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (348)..(348): n is a, c, t, g, unknown, or other
  misc_feature (351)..(351): n is a, c, t, g, unknown, or other
  misc_feature (355)..(355): n is a, c, t, g, unknown, or other
  misc_feature (357)..(357): n is a, c, t, g, unknown, or other
  misc_feature (363)..(363): n is a, c, t, g, unknown, or other
  misc_feature (401)..(401): n is a, c, t, g, unknown, or other
  misc_feature (426)..(426): n is a, c, t, g, unknown, or other
  misc_feature (703)..(703): n is a, c, t, g, unknown, or other
tccccgcggtggcggccgctctagaactagtggatcccccgggctgcaggaattcgcacgagaccattacctagaacatcctaatcgaaaaagcaggagaagagagacgacacagcagctttttgggtttccccttccctttccccgcgcggtgatcgcagggttctccgcgagcgaggcagagcactgcgcgtcctccgtgacttcctggtgatcgctgggggttctggacgttggtgtttcatttggttggttggtgggtggcagcagccgtggcgagatggacctgatgatgccggtgacggtgaaggagaagtgggcgcccggagnagnnagagnannnagacntgnacgngnacgcgnacgctccgcggccgatggaggggctgcacgaggccggnccaccgcccgttctgaccaagacgntcgaactggtggccgacccggcccccgaacaagtcatctcctggggccgggcccaaaacgtttccttggtttggaacccccacctgttccccgcaggggttttaccccaggccctttaaaaaaaaaaatacctccggttatgcgcgccacatcaaaaccttatttataatgaccacccccccgcgtatactacaaaatccaccccgcccaaaccaaaaaaaaaaaaaatcggctttctcattccaaaaaccgcaacaactccctcttcccgttaacn

SEQ ID NO: 31744 - DNA, 611 bp, Zea mays
  misc_feature: Ceres CLONE 1408186-F
  misc_feature: Encodes the peptide sequence at SEQ ID NO. 31745
gctctagaactagtggatcccccgggctgcaggaattcgcacgagaccattacctagaacatccttcgaaaagaacgacaaacacgagcgcgggcgcgcacaagttcgccaacccccaccccccgcgtgctgcgcgtcgttggaaccaaggcttggattagtctcgccgaggaggaggtggtggtcggcgaggggctcgcggggatggggatctcgaggccccttgtggtggcgatggcggtggcgctgctgatcgccgtcgccggtgcgaccgccgaggagcaggagcccctgctggcggcggacgcggtggccggcgcggtggaggcggcgctcagggccgagctggggcaactccgggcgaagatctcggcgctagagtcagacatagaagagcgatctcaagaactgaagaataaggatgatgccatcatgaacctggagaaagccattgaagagaagtcaaaggctattacctctatgctggacgagattgcttccctcaggcaaaagggtctgtagctgccgaggagcaggctaacaaggcaatgccaagggtgttgagcttgaaaagcagggtgacaagatcaaaaaggatattgaagcacaaa

SEQ ID NO: 31745 - protein, 105 aa, Zea mays
  misc_feature: Ceres CLONE 1408186-F
MGISRPLVVAMAVALLIAVAGATAEEQEPLLAADAVAGAVEAALRAELGQLRAKISALESDIEERSQELKNKDDAIMNLEKAIEEKSKAITSMLDEIASLRQKGL

SEQ ID NO: 31746 - DNA, 741 bp, Zea mays
  misc_feature: Ceres CLONE 1408187-F
  misc_feature: Encodes the peptide sequence at SEQ ID NO. 31747
  misc_feature (1)..(1): n is a, c, t, g, unknown, or other
  misc_feature (457)..(457): n is a, c, t, g, unknown, or other
naaagctggagctccccgcggtggcggccgctctagaactagtggatcccccgggctgcaggaattcgcacgagaccattacctagaaatcctaatcgaaaaacaaatgaaacccctgagacagtcagacgtcccgtgctcgtcatcaccacccacatctcagttcaccccggcgtcgtcctcttcccccggcgctactctcccgctccacgttccaaaggaaagatggcgtcccatattgttggataccctcgcatgggccccaagagagagctcaagtttgccttggagtctttctgggatgggaagagcagcgccgatgatttagagaaagttgcctctgacctcaggtctagcatctggaagcaaatgtcagaagctgggatcaagtacatttccagcaacaccttctcgtactatgacccagtcctttgatacacgccatgcttggtgctgntccagagcgctactcttggactggaagcgagattggcttgagcaccttattctcaatggggcaggggaaatgccacgtccctgcttatggaaaggacccagtgttttgaaacaaactaccatttattgtccttgaattggcccaagaacaagtcaaatagttttcccaaaggtgtgttctgaaaaagggggcaaaacgcccgaattgaaatggccccagggtttgggagaaaggggtaatttggccctttaacggggggaggggggggggaaaaatttttcgcg

SEQ ID NO: 31747 - protein, 69 aa, Zea mays
  misc_feature: Ceres CLONE 1408187-F
  misc_feature: SWISSPROT Homolog: EC 2.1.1.14 5-methyltetrahydropteroyltriglutamate--homocysteine S-methyltransferase
MASHIVGYPRMGPKRELKFALESFWDGKSSADDLEKVASDLRSSIWKQMSEAGIKYISSNTFSYYDPVL

SEQ ID NO: 31748 - DNA, 698 bp, Zea mays
  misc_feature: Ceres CLONE 1408188-F
  misc_feature: Encodes the peptide sequence at SEQ ID NO. 31749
  misc_feature (527)..(527): n is a, c, t, g, unknown, or other
  misc_feature (548)..(548): n is a, c, t, g, unknown, or other
  misc_feature (672)..(672): n is a, c, t, g, unknown, or other
aaagctggagctcaccgcggtggcggccgctctagaactagtggatcccccgggctgcaggaattcgcacgagaccattacctagaacatcctaatcgaaaaagttaagtctcgttcactgcctgtgctgctcagtgctctgctcacacatcctcgtcgccaatggcggctcccgtccgggccatcccgctcccgtcgcccgtcctgtacccccgcatgtccttatggggccgcagcagctgcagccggcgacgtgcccccggagttcgcgcagcagtggaggcggcggagggtgcttcgcgggcgacggagcccgtggaggtggtcggcgtaggcagccgaaaggacgccgtcatcgacttctgcctgggctcacgcacgctgtcctccacccccatccgcttctggacagtacatgtgatggataaattctaaagttcagttaatacaaaaaggtcatggaacttgatgcaagtgttcagagacttggaaccctcccttatttcttcatcctgcccacctgcggnttattcttgtttctagtgcangacaggatgctgatcatattactgcaatgagttaccttaaacgttgtcaaatctgctggtaatctgctgcatcaaatatttttgagccctcctgcttcagggacaagaagcaaagaaaggcagntttgattgaatgcaaacttcaactgt

SEQ ID NO: 31749 - protein, 90 aa, Zea mays
  misc_feature: Ceres CLONE 1408188-F
MAAPVRAIPLPSPVLYPRMSLWGRSSCSRRRAPGVRAAVEAAEGASRATEPVEVVGVGSRKDAVIDFCLGSRTLSSTPIRFWTVHVMDKF

SEQ ID NO: 31750 - DNA, 672 bp, Zea mays
  misc_feature: Ceres CLONE 1408192-F
  misc_feature: Encodes the peptide sequence at SEQ ID NO. 31751
  misc_feature (402)..(402): n is a, c, t, g, unknown, or other
  misc_feature (415)..(415): n is a, c, t, g, unknown, or other
  misc_feature (418)..(418): n is a, c, t, g, unknown, or other
  misc_feature (433)..(433): n is a, c, t, g, unknown, or other
aaagctggagctccccgcggtggcggccgctctagaactagtggatcccccgggctgcaggaattcgcacgagaccattacctaagaacatcctaatcgaaaaaggctggatttgagcctgtttagcagcgctatccgcttggcccaattcgtctactgctcctccagctcctccgctgcgccgccggtcgccgcccgacaccgccgaagaagagcagacgccgagtccaggacgtcgccgcggggctcggggaacgcggtgttgccatcgcgaggaaggtcggaagttcgctgttcgcccgccggatcggcaccgtcgccaccgcccatggcaaccgtcgcccccgtcgtctccgacctcgtcgacttcctcaacgcgtcgcccaccgccttttcacgcgntgacgaggcaaancgncggcctgaaaggcgngggggttcttgcaacttgccgaacgggaaggaatggcggttccccaaaaccccgggggcaaaaaatttttttaaaggaaaccccccaaaatggcgtttttccaccggcaaaaaaaaggtggggggaaggggtccccaatttgggggaaaaaaaaaaacccttttgagaaaaaaaaacccttccccaaaaaaaaaaagagaggccccttgggggggggcgcaaaaagaatgggggggggg

SEQ ID NO: 31751 - protein, 114 aa, Zea mays
  misc_feature: Ceres CLONE 1408192-F
  misc_feature (25)..(25): Xaa is any aa, unknown, or other
  misc_feature (29)..(29): Xaa is any aa, unknown, or other
MATVAPVVSDLVDFLNASPTAFSRXDEAXRRPERRGGSCNLPNGKEWRFPKTPGAKNFFKGNPPKWRFSTGKKKVGGRGPQFGGKKKTLLRKKNPSPKKKREAPWGGAQKEWGG

SEQ ID NO: 31752 - DNA, 685 bp, Zea mays
  misc_feature: Ceres CLONE 1408194-F
tccccgcggtggcggccgctctagaactagtggatcccccgggctgcaggaattcgcacgagaccattacctagaacatcctaatcgaaaaacacacaaaccgccgccgccgctaccttcaccactgcggactgcaccagctgcccgccgactactccgtttctcttcctagtacattgccgcgtcgaaggcgaggtcctcagcagcgccggcggactccgctcgcacgccatactcagcctactccgtcttcccctgtctagcagacaccctcttcccctctccactcccaatcttatcgtcgcctccctcgacgtcgctgctgcctccacttcaccatggcgcttcacgccccggtccttcgttctgaagactcgctgaaagcgggagcctgggcgcgaagggtcaccaagccacatccagcgggccaggggtttcccttgactccaaccacctactttggggccccgaaccctggctgaaatggttctggaggtctgtgggaggcatttggggttaccaaggggggggacggcccctttttgggggaaaaaaccctgtgccccccgggttgccatctaagttcgaacttatttaaccacgggcggaaaacatcgcggaaggcacaccctcggcgcagtcgtcacaaaggggaaaaactcctaccatggtgccgcgtgtcttc

SEQ ID NO: 31753 - DNA, 722 bp, Zea mays
  misc_feature: Ceres CLONE 1408195-F
  misc_feature: Encodes the peptide sequence at SEQ ID NO. 31754
  misc_feature (359)..(359): n is a, c, t, g, unknown, or other
  misc_feature (370)..(370): n is a, c, t, g, unknown, or other
  misc_feature (377)..(377): n is a, c, t, g, unknown, or other
  misc_feature (382)..(382): n is a, c, t, g, unknown, or other
  misc_feature (392)..(392): n is a, c, t, g, unknown, or other
  misc_feature (395)..(395): n is a, c, t, g, unknown, or other
  misc_feature (594)..(594): n is a, c, t, g, unknown, or other
  misc_feature (595)..(595): n is a, c, t, g, unknown, or other
  misc_feature (626)..(626): n is a, c, t, g, unknown, or other
  misc_feature (645)..(645): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
aagctggagctccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacggggctcgtgtggctccggcagcgncgcagggtggnacactanctcgncaagggcggncgncacgtgtcctaggcgccgaggtgggccgcggtgggccgaccaaggccggctcaagaagattcacggggcgtcaggcccaggagatggctggctgtgggtcacccttcacgagatcgggcgtcgacgacccgcccactgggtagctccactgcaggggcatcggcggcctgtcccgcagcttcccccgtcgagggcctcnnaggccgaggagccgcgcgcgcgaaaaccccngcgtgcgtcccgggacggngnnnnnnnnnnnnnnnnnnnnnnnnngnnnnnnnnnnnnnnnnnnnnnnnnnnnnnnnnnnnnnnnnnnnnnnnnnn

SEQ ID NO: 31754 - protein, 77 aa, Zea mays
  misc_feature: Ceres CLONE 1408195-F
  misc_feature (66)..(66): Xaa is any aa, unknown, or other
  misc_feature (68)..(68): Xaa is any aa, unknown, or other
  misc_feature (70)..(70): Xaa is any aa, unknown, or other
MTLTIPDEVRAKAEVYVGDAAGQEKTRLLLQETGLPSGLLPLRDIIECGYVEETGLVWLRQRRRVXHXLXKGGRHVS

SEQ ID NO: 31755 - DNA, 686 bp, Zea mays
  misc_feature: Ceres CLONE 1408196-F
  misc_feature (453)..(453): n is a, c, t, g, unknown, or other
aagctggagctccccgcggtggcggccgctctagaactagtggatcccccgggctgcaggaattcgcacgagaccattacctagaacatcctaatcgaaaacattaattaacctctctccttcctcgccccttcccctccacgactccactaccaccaccttcaccttgtctcccacaaccgccgcgcgcaagccctagcccgatctcgccggcgacagacaccagatctcgccgcccgttgcgcgccgatacgcgccccgccggattcaccgctcctcgcgctgcagcacgcccgggcctgggttactgcgtgacatgtagtattgataattggaggttgtcaccatcacccacaagcatatgttgtgatttgtcgatggcgaggagatgaaacaggtgtaggggcggagcagcaaggacatgacagccatggcgcatccgcgccaccgagncgctgctagaagcccatgggatcataggctattgcctttgggttggggtgcacctatggggggcaatggctaccaaccagggcgtaccccgaaggaactttttttggttcaggggcgtaaccccccgacaaggattggcaccacggggtggccccggggggaattggaaaaaaaaattttccccggggggtaaaaggggtttcctttctaagggccgagggtttgtaaaaaaa

SEQ ID NO: 31756 - DNA, 834 bp, Zea mays
  misc_feature: Ceres CLONE 1408197-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (32)..(32): n is a, c, t, g, unknown, or other
  misc_feature (35)..(35): n is a, c, t, g, unknown, or other
  misc_feature (38)..(38): n is a, c, t, g, unknown, or other
  misc_feature (39)..(39): n is a, c, t, g, unknown, or other
  misc_feature (55)..(55): n is a, c, t, g, unknown, or other
nnnnccccccccccccccccccccccccccanaantgnngatatgctgccgactntaaaactggtgctcaccgcggtggcggccgctctagaactagtgcatcccccgggctgcaggaattcgcacgagaccattacctagaacatcctaatcgaaaatctgtctatcttgatctcatctcctatcttcttcctcctagattctttcttccgcgcgccctctctctctctctccttcctgccttctgcctgcgggcggaccatgtccgtggcgcccctcctgccctgcgagctgcttctccagcgaaaaggttgctgcgccttgacgcaccaccgatcccacgccgcccaaacccgagcgttctgtccggcagctaggtagcgagctgcgcggtggctgccaccgaaagaaggaaggggaacaggtcaagcgaacgcccggggcgattgccttgcctttgccctgtgtgctcccgcccggagccaagtttggaccccgccggttcccattggatggaatggacaaagggaacgttattcttccacacgtccccgaaccctggaaagtacattttctaacccaggccaagcagcccagacatgcacccacccgggtaccccttttaggagtgaccggcggcggggtgagaaaaccaataacacccgccccccccgactgggcgccgaggtacgcgtattctcgcggtgaaattccgcctcacctgggcccccaaccacgagaccagaccgccgcccccgccgcgagcccgctcacttaataactcccataatacacgggcgagcgacgccaacacgcaaaagggcgacgaaaaac

SEQ ID NO: 31757 - DNA, 680 bp, Zea mays
  misc_feature: Ceres CLONE 1408201-F
  misc_feature: Encodes the peptide sequence at SEQ ID NO. 31758
  misc_feature (430)..(430): n is a, c, t, g, unknown, or other
tccccgcggtggcggccgctctataactagtggatcccccgggctgcaggaattcgcacgagaccattacctagaacatcctaatcgaaaagtggcttctcattcattgttgattgattgatcctccccgcctcactcctttgtctcctcgcctcgtgctcgctcgctcccctcgccctggggaggagggcagcagaaaccctagcggctcaggccgggcgggggttagatgctccaaggttcgagagggaagggtaggttagtggtgcgccatcgactatgggctgcgtcttcggccgggcggctgcgtcgtcctctgcagcgccgaagaagaagtggggcaaggggaggtcgtccccgcagtccgaagcggagtcgtcctccgcagtcgcggccgccgacggcgacgggaggccgatgcccagcgtcngggagttcaccatctcgctctacgaggtgctggcgcgggcgcacgtccgcaaaatcgtgcccgagatcggcaacttcatgcccaccatcctgtgaacgctctcctccacggggggctccttcccgctccaccaggcctgctccaaggtggtgcccgcccatcgggcggcacggaatcgaccccctccgcgcccgaaggggaagaaggccgtcaatcttcgccctccctctgccaggccaatctgacaagg

SEQ ID NO: 31758 - protein, 81 aa, Zea mays
  misc_feature: Ceres CLONE 1408201-F
  misc_feature (51)..(51): Xaa is any aa, unknown, or other
MGCVFGRAAASSSAAPKKKWGKGRSSPQSEAESSSAVAAADGDGRPMPSVXEFTISLYEVLARAHVRKIVPEIGNFMPTIL

SEQ ID NO: 31759 - DNA, 748 bp, Zea mays
  misc_feature: Ceres CLONE 1408202-F
  misc_feature: Encodes the peptide sequence at SEQ ID NO. 31760
  misc_feature (320)..(320): n is a, c, t, g, unknown, or other
  misc_feature (339)..(339): n is a, c, t, g, unknown, or other
  misc_feature (366)..(366): n is a, c, t, g, unknown, or other
  misc_feature (372)..(372): n is a, c, t, g, unknown, or other
  misc_feature (373)..(373): n is a, c, t, g, unknown, or other
  misc_feature (381)..(381): n is a, c, t, g, unknown, or other
  misc_feature (382)..(382): n is a, c, t, g, unknown, or other
ctggagctccccgcggtggcggccgctctagaactagtggatcccccgggctgcaggaattcgcacgagaccattacctagaacatcctaatcgaaaaagtgtgagagctcgattcgttgccgtccacttgtctcacggcctgtcgccatctccttcctggttttttcatccgaccatccccggctcctccgcgccgtcggcgacgactccatcgagtcactcggccgcagcaaccggcgaccatgtaccgagtcgcctccgggctcggcgccctcaagaggcatggggcaaatgctcaaatgatgaatgctgcaattangtgtggcagcacaagtgtngcacagaagtcttcccggtgcttgtgnacctgnntgactggnngcgcgtcaaatgaatacctccctcagaattccacctcccgggagggactatccctccctccgctgcctgacatggggaagggtggaaaaaaaaggcccaaccttccccaagggggtaaaaaacctttggaaactctgggggaccttttgttcgggggggaattatggggaatgggggtcttgaaaaaaaacccttaaaacaagggtgcccctcaattttgaaaacaaagggcctcccccccctccccaaaaggaggaggggggtggggggcgaaaattgaaaaaaaaggggggccgccccaacttttcctcccccggaggaaattaaatctctcttgggggcccgaaaaattttgggcgggggggg

SEQ ID NO: 31760 - protein, 111 aa, Zea mays
  misc_feature: Ceres CLONE 1408202-F
  misc_feature (26)..(26): Xaa is any aa, unknown, or other
  misc_feature (41)..(41): Xaa is any aa, unknown, or other
  misc_feature (43)..(43): Xaa is any aa, unknown, or other
  misc_feature (44)..(44): Xaa is any aa, unknown, or other
  misc_feature (47)..(47): Xaa is any aa, unknown, or other
MYRVASGLGALKRHGANAQMMNAAIXCGSTSVAQKSSRCLXTXXTGXASNEYLPQNSTSREGLSLPPLPDMGKGGKKRPNLPQGGKKPLETLGDLLFGGELWGMGVLKKNP

SEQ ID NO: 31761 - DNA, 739 bp, Zea mays
  misc_feature: Ceres CLONE 1408203-F
  misc_feature: Encodes the peptide sequence at SEQ ID NO. 31762
aaagctggagctccccgcggtggcggccgctctagaactagtggatcccccgggctgcaggaattcgcacgagaccattacctagaacatcctaatcaaaaacacaaaaacccagcatcagtcaagctcgctcacacgaccatggccgcggcgatgaccggcagtactcgcgccagcggcggctccttcctcgcgcttctctttgtcatgatgcccgctgtcgactacgtcgcgtcagctgcccacactgcagtgagtgctactgttgccactaacacctgagacagaaacgcgaagggccttctgacgatgcgtcgaactagtccagcagcaaatggatgccatcatcattgcctggtggattggtccccgaaggggtgggcggctccaatggaaaaccgctaaccaagtccccacccggggtgtggtaattctccctggcacaaagaactggggagtttttaacacattgtgcaatcccctcccctggtgtgaaaaaaccccgttaaaattgtggggtatccttatgttcccgggggataattgctatgttctcccgcaaaaaaaacccttttaaaaatggggcgcacaaaattgggaaaaaaatggtctctccccctccgccgcaatgagtgggcgttgggagggaaaaataaaaaaaaaaaggggggccacaaaaaccttctctctcccagagaaaacacccccccccgagcgcgctataaaacaattgggaggg

SEQ ID NO: 31762 - protein, 46 aa, Zea mays
  misc_feature: Ceres CLONE 1408203-F
MAAAMTGSTRASGGSFLALLFVMMPAVDYVASAAHTAVSATVATNT

SEQ ID NO: 31763 - DNA, 636 bp, Zea mays
  misc_feature: Ceres CLONE 1408204-F
  misc_feature (211)..(211): n is a, c, t, g, unknown, or other
  misc_feature (283)..(283): n is a, c, t, g, unknown, or other
  misc_feature (311)..(311): n is a, c, t, g, unknown, or other
aagctggagctccccgcggtggcggccgctctagaactagtggatcccccgggctgcaggaattcgcacgagaccattacctagaacatcctaatcgaaaactcgtgttcttgttcgtctccgcctcaggcaactccacacggtcacacctcgctcgctctcgctcccgtatcgcggtttccttttcgaagccttgctaggtttagctggngcctctgtctatcctgtcaatggccccttaggcggctgtacttcagacttcagaagtgacgtgaggcgtggngacgcgcgtacctgattgtttcgaggangcgggggatgggaccggacttctcgccggcgagtggggggcccgagctttgaggtcggctttaaatcgggccacttctctgaacgggtgttgcaaatccagatccgccctggggaagaccccctcgcggcccaagggggcacccgggaagggtgctcattctttgccaaggggggtgccaccccaaaggacaacaggaggagatcccaaacgaacaaagaactaaaaaaaacattgccaaatccggcaaactggaaaattgaaacttaagaaaggggatgcccaacaaggagggaaatgagcctgtagcttatgatagagcaatc

SEQ ID NO: 31764 - DNA, 720 bp, Zea mays
  misc_feature: Ceres CLONE 1408205-F
  misc_feature: Encodes the peptide sequence at SEQ ID NO. 31765
  misc_feature (515)..(515): n is a, c, t, g, unknown, or other
  misc_feature (539)..(539): n is a, c, t, g, unknown, or other
  misc_feature (540)..(540): n is a, c, t, g, unknown, or other
aaagctggagctccccgcggtggcggccgctctagaactagtggatcccccgggctgcaggaattcgcacgagaccattacctagaacatcctaatcgaaaagagaagagggcgggcatcggccagtgggggctcggaggccgagggaggcgaggaaagcggcgggtgccgggccgcccgcgccggtgccgaggccctcaccagtcaccaccccctcccctcttccgtctgtcccgcgcttgccgccaccgccgctgcctgctcgcgacccttcccccttttaacgctcccgcggccccgcgtcgtgctcccttttgtcgccgctgccttcgtgcccgtactcgcgggttctcctcgctcctcaatctccgcgcctgggcgcggcgttcgccgccggatctgggcgcgggacggtgccccggacggccgatgggcgcgggtgacgcttccggttgggcgcccgcgcgctcgcggttctcgtcctcgtgtcagtggctctgcttccacttgtcagntccgacgatgacacaacacctggnnaagggggttgtccaggcgctggggcgtattcctccacggggcgcgtgaaggaacggggacaaactgagccttccaggatttgctcttcttcctcacatttcttaggactggaagccgcacctactttcactgcttccttaaaagctgtatacaattgcgcaggaatggcccgcgtctatt

SEQ ID NO: 31765 - protein, 52 aa, Zea mays
  misc_feature: Ceres CLONE 1408205-F
  misc_feature (29)..(29): Xaa is any aa, unknown, or other
  misc_feature (37)..(37): Xaa is any aa, unknown, or other
MGAGDASGWAPARSRFSSSCQWLCFHLSXPTMTQHLXKGVVQALGRIPPRGA

SEQ ID NO: 31766 - DNA, 674 bp, Zea mays
  misc_feature: Ceres CLONE 1408206-F
  misc_feature: Encodes the peptide sequence at SEQ ID NO. 31767
  misc_feature (535)..(535): n is a, c, t, g, unknown, or other
aaagtggagctccccgcggtggcggccgctctagaactagtggatcccccgggctgcaggaattcgcacgagaccattacctagaacatcctaatcgaaaacctcgcgcgcacgttctgccgcgcgcatacgcccgcatcccgcagccgcggcagcgccgcagccgctccttccatcctccgccctccttccatcctccgcggatcccagctctccctcccgcgcccgcccgcagccgcaccgcatcccgcagccggcgtcggcgcaacggctgatgctcaaggggtgtgagtcgctgctacagcggcagtgccggccgcgcacccccgcggggtacatggagcccacgccgctaccggttggcggtgaagagcaaggggacagataagcccaaaggcagcaaggggaacgtcgacaaggaccccaacaagcctgactcccaacactttttttgttcgctggtgcttgcggcgacggtgctggcgagctctcccgtgctggggctctgggatgtccaagggcaccgggttccggngagacgtggagtcaccacacggcggatgcgccgccgctggctgccttgcagttcctcgatcgattcaagggaaatattggcagtgggaagagactggtgaatcaaaggcagtcaaagctagatgggaggcggaagtgcc

SEQ ID NO: 31767 - protein, 37 aa, Zea mays; identical to SEQ ID NO: 25346
  misc_feature: Ceres CLONE 1408206-F

SEQ ID NO: 31768 - DNA, 696 bp, Zea mays
  misc_feature: Ceres CLONE 1408209-F
  misc_feature (301)..(301): n is a, c, t, g, unknown, or other
  misc_feature (375)..(375): n is a, c, t, g, unknown, or other
  misc_feature (396)..(396): n is a, c, t, g, unknown, or other
aaagctggagctccccgcggtggcggccgctctagaactagtggatcccccgggctgcaggaattcgcacgagaccattacctagaacatcctaatcgaaaaatctcgcagccgtcccgcggtctcgcaagctccaacttccactggaagatgttcctacctgtggcccagcgccgccgacaacaagtccgtcgcctaccgtgacggttccacccgctggtgctccagctcgacgacgacttcgccgacctgcgggcgctggtgggccgcctagcgtcgccggcctccgtgaaggccgtgncacggctgggccgcgtgctcgtgtcgctctccggcctgttgcaccaaccacaggcgcaggacccgctgcgccgnctcggcccgtcccgttcgcgnagcggacgacttcctccgcctcgtcgaagggcacgggagctttcgcgaccttcgggtcgcgctccccccgccccaggttgaggcccccccctcgttgtcaagggggaatatggcccccctctttctcccctccataattaattcattctctcttccttcctcctccccctctcccctccggcgcggggcaatataatcttgttaactacatctcctcctatatctttccctaaaacccaccctctttcatcctctcgcctacctatttttcctcccccactctacgcccgccgctccgct

SEQ ID NO: 31769 - DNA, 672 bp, Zea mays
  misc_feature: Ceres CLONE 1408213-F
  misc_feature: Encodes the peptide sequence at SEQ ID NO. 31770
  misc_feature (360)..(360): n is a, c, t, g, unknown, or other
  misc_feature (453)..(453): n is a, c, t, g, unknown, or other
  misc_feature (463)..(463): n is a, c, t, g, unknown, or other
  misc_feature (493)..(493): n is a, c, t, g, unknown, or other
  misc_feature (540)..(540): n is a, c, t, g, unknown, or other
  misc_feature (541)..(541): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
aaagctggagctccccgcggtggcggccgctctagaactagtggatcccccgggctgcaggaattcgcacgagaccattacctagaacatcctaatcgaaaagtttccagctccgatccaacccagcatctgtaccgcgccgcgcgagcacgtccggcgccggtgcggcaggcgaaatccgagagcactcctcccccgctacgccgcaccgcccatggccgcagctagccgcagatagagagaggcgcaggcgagggcgtgcagatccagatccggtgggcgggaaggacttgatcgcccccaccaccatggggccggcgcggtgtcggcgctcttcctgctgggcatgaaagggccgcngttctcgtctggcgcgactacccgcggcgatgtctccgcgctccaggccgagcgcttcttcaccaagctcctccgacaaggagggcggattcnggaagtgcanctcgcctggtggtctacgacgacgctggcngtcacttacatgttcatccagcacaacaatgtcttcctccctcacgnncgctcgcagaactgtaaacgcggcagcatcctctcttccctcacgggggaaatagatgtgtttaagcactacttcaggagtgaagtaacgcgnnnnnnnnnnnnnnnnnnnnnnnnnnnnnnnnnnnnnnt

SEQ ID NO: 31770 - protein, 96 aa, Zea mays
  misc_feature: Ceres CLONE 1408213-F
  misc_feature (5)..(5): Xaa is any aa, unknown, or other
  misc_feature (36)..(36): Xaa is any aa, unknown, or other
  misc_feature (39)..(39): Xaa is any aa, unknown, or other
  misc_feature (65)..(65): Xaa is any aa, unknown, or other
MKGPXFSSGATTRGDVSALQAERFFTKLLRQGGRIXEVXLAWWSTTTLAVTYMFIQHNNVFLPHXRSQNCKRGSILSSLTGEIDVFKHYFRSEVTR

SEQ ID NO: 31771 - DNA, 719 bp, Zea mays
  misc_feature: Ceres CLONE 1408215-F
  misc_feature: SWISSPROT Homolog: EC 3.2.1.23 Beta-galactosidase
  misc_feature (250)..(250): n is a, c, t, g, unknown, or other
  misc_feature (275)..(275): n is a, c, t, g, unknown, or other
  misc_feature (276)..(276): n is a, c, t, g, unknown, or other
  misc_feature (280)..(280): n is a, c, t, g, unknown, or other
tggagctccccgcggtggcggccgctctagaatagtggatcccccgggctgcaggaattcgcacgagaccattacctagaacatcaatcgaaaatcaaaattactatgtgtatcatggtggcacaattttggtcgcactactggggggccattcattacaactagctacgactatgatgcaccaattgatgaatatggacttcggagaattccgaagtgggcacatctgagggaacttcacaaatctatnagattgtgtgagcacaccctgcttnnatgnaataccacgttcctttctctgggtcctaaacaaaaggttgatatttacagggatcagtctggaggctgggttgcattccgggaaaaattgattcccccatgacaaatttgccccttcccgaaaaaggaaaaatgatcttccggcttgggcagaaaaaaatcttccggaagggggaaagggggggggtccaacctgggaagggggaacccccaactttcaggggggccctggggtcccaaaaatttgacaagccaaaaacccgggggggggggatttttccgaggaaaaaaaagggtttttgggaaaaaaaaattttttcccgaagaggttttggggccaatttataaaaaaaaagggcccccccccccacctgtgggccaaaaaatttttgggggggggggagaaatcccccccaaaagggggcgggggtgttttaaaa

SEQ ID NO: 31772 - DNA, 786 bp, Zea mays
  misc_feature: Ceres CLONE 1408219-F
  misc_feature: Encodes the peptide sequence at SEQ ID NO. 31773
  misc_feature (250)..(250): n is a, c, t, g, unknown, or other
  misc_feature (393)..(393): n is a, c, t, g, unknown, or other
  misc_feature (416)..(416): n is a, c, t, g, unknown, or other
aaagctggagctccccgcggtggcggccgctctagaactagtggatcccccgggctgcaggaattcgcacgagaccattacctagaacatcctaatccaaaaatatcccatcctgatctctcctcccttcttcagtggcagcagcaggccagcagcacgccacccgccccactcctgcctccgatccgctgcttactcgccacccggagatggccaccgccgccgccttctccgtctcctcgccggcggnctccgccgtcgccgcgcgatccaaggtgttggagggagagtaaaccagcgagaactagaactggctgccgcgtcggcatcacgcggaagaaacttggccgtgtcatgatggcccttgcagtggatgtttctcgttttgagganggccaatggctcctcagacccanttcttggggtttctgaggccttttaggcaaaaaaagcgagctgaaacccattctgggggtggggccctatggaaaaaaaaactgcccccctaccggcccagggttcccaaaagggttaaaatcttttggtgggaaaaggaaaaaaaaaaaaaatcttccccttgagggggttaccccctttaaaaaaaaacacaaaaaaaattttgttggggataaaacccccttaaaaaaaagaggggggggggtaaactttacctctccccgggaaaagagaatcgcgccccccgcaaattaaaaaaaaaaattttttgagaaaaaggggggttttcccccccccggggggaaacaaaaaaattttgtgggggggggg

SEQ ID NO: 31773 - protein, 143 aa, Zea mays
  misc_feature: Ceres CLONE 1408219-F
  misc_feature (84)..(84): Xaa is any aa, unknown, or other
  misc_feature (131)..(131): Xaa is any aa, unknown, or other
  misc_feature (139)..(139): Xaa is any aa, unknown, or other
KAGAPRGGGRSRTSGSPGLQEFARDHYLEHPNPKISHPDLSSLLQWQQQASSTPPAPLLPPIRCLLATRRWPPPPPSPSPRRRXPPSPRDPRCWRESKPARTRTGCRVGITRKKLGRVMMALAVDVSRFEXGQWLLRPXSWGF

SEQ ID NO: 31774 - DNA, 673 bp, Zea mays
  misc_feature: Ceres CLONE 1408220-F
  misc_feature: Encodes the peptide sequence at SEQ ID NO. 31775
  misc_feature (425)..(425): n is a, c, t, g, unknown, or other
  misc_feature (428)..(428): n is a, c, t, g, unknown, or other
  misc_feature (443)..(443): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (479)..(479): n is a, c, t, g, unknown, or other
  misc_feature (528)..(528): n is a, c, t, g, unknown, or other
ggagctccccgcggtggcggccgctctagaactagtggatcccccgggctgcaggaattcgcacgagaccattacctagaacatcctaatcgaaaatttttctgctgcccagccgccgtccgtccgcgcttcactatccttcattccctcccctgtcagcgacgactgggtaggctaccgccgccgccctacgctaggtgcccatctcttcgccggcgaagagcgcccaccaagctccggccaagggcgtgatggcggctgtaggcagcttgaagccggggatggagactcttcatgtgcaggactacaaggacgcgcctccggccaaggccgcggtagagagcctccagccggcgatggagagtctgcatgtgcaggattacaaggacgcgcctccggccaaagggcgtggccgccgccgccgncgntagggagcttgcagncgnnngggcggagaattctgcaggtgcaggactacnaggacgctacattgttattatggtgcttacccggcttatgccatggagnctatggtgggttgggggggagtacccatacctgagccatgatggagcacagacaccaactgctggtacctatgctgacatgtactatggctagctcccatatggggtgcaacatggggcatgatggccaaatttatgggtcaaag

SEQ ID NO: 31775 - protein, 59 aa, Zea mays
  misc_feature: Ceres CLONE 1408220-F
MAAVGSLKPGMETLHVQDYKDAPPAKAAVESLQPAMESLHVQDYKDAPPAKGRGRRRRR

SEQ ID NO: 31776 - DNA, 830 bp, Zea mays
  misc_feature: Ceres CLONE 1408221-F
  misc_feature: Encodes the peptide sequence at SEQ ID NO. 31777
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
nnnttttnnnnnnnnnnnnnnnnnnnnntttaggaaacgcaaaagagaccccaaactataactggagatccccgcggaggcgcacgctctacaactagaggatcccccgggctgcaggaattcgcacgagaccattacctagaacatcctaatcgaaaataaattctaatcgaaaactcggcctgaatcgaacagctggatcatcaagtactgttgatgctaatgtggatcctactgtattgccacttgaacctaaaggtggccaactgcctttgttcagcagtggtgattggatgtcagacattgattctggatatgaggcagcagaaattgcagcttctactcaaacctcttcgggtgtcacaccatatctgtgttctgctggaagtgcttttggcagctccatggatgctggctaatcatgaccaatcagatggaccatcaacttctgctggtacatcatcgcagccagaaaggtgtacctcaaagcgagcatcacccggaatttacaccggccttcccagagtctgcagggaaaatccagaagacaaaaaaaccttttttgcctgacctatttcctttcctggggagagttacagcccaacacataacctctcccccccccctttactcggccccaccatttttaaactaccaattgaaaggttgaaacaaggggtcagagaagcaaacagtggtctccataaacagactcggacaaaacacacactccaccccgctacacaaaaaacggaaggatactgccctaccccaataacaaatattccgccaatattcatccccaccacgacaccacctctcccaacccc

SEQ ID NO: 31777 - protein, 41 aa, Zea mays
  misc_feature: Ceres CLONE 1408221-F
MSDIDSGYEAAEIAASTQTSSGVTPYLCSAGSAFGSSMDAG

SEQ ID NO: 31778 - DNA, 719 bp, Zea mays
  misc_feature: Ceres CLONE 1408222-F
  misc_feature (531)..(531): n is a, c, t, g, unknown, or other
  misc_feature (548)..(548): n is a, c, t, g, unknown, or other
  misc_feature (561)..(561): n is a, c, t, g, unknown, or other
  misc_feature (585)..(585): n is a, c, t, g, unknown, or other
  misc_feature (697)..(697): n is a, c, t, g, unknown, or other
  misc_feature (703)..(703): n is a, c, t, g, unknown, or other
tggagctccccgcggtggcggccgctctagaactagtggatcccccgggctgcaggaattcgcacgagaccattacctagaacatcctaatcgaaaactctctcgcgcgtccgcgcccgcgcccgcggcctcgttcaatccgccagcgctcccccgccccccggtggtagcgggctctacggcagcgctcctctccggttcccctgcgctccgcgtcttcatctgtggcggccgacgctccgtcggtgtctcgtcggacggagcgagcggagctagggttccgtttcatgctcaggatcggcgagatctagggtctcgatttcagggtgattgtactggatagctgctgctgatattgcaagacaatgaaagctcatcagcagcaaggtaatgcatctggcacaggagcaaagaccaaatctttttttgataagatacaaagcctggaaagctggtgcacatatcaacaaatcatcaggcaatgtggctgcaaaggcgtaaaaaggtctctccttttgaatcacataccanaagcaagatagcatcanaagactggcagtncttatgggagcgccagcagtggantggcttaagttggtctggctcggccacctaaatcacctctgggaaagatcaaacttcaacttttccccattatatgaaacccattccaagagattatgcagcaagaaaacancatccnttaccttgggattggt

SEQ ID NO: 31779 - DNA, 694 bp, Zea mays
  misc_feature: Ceres CLONE 1408223-F
  misc_feature: Encodes the peptide sequence at SEQ ID NO. 31780
  misc_feature (388)..(388): n is a, c, t, g, unknown, or other
  misc_feature (389)..(389): n is a, c, t, g, unknown, or other
  misc_feature (426)..(426): n is a, c, t, g, unknown, or other
  misc_feature (495)..(495): n is a, c, t, g, unknown, or other
  misc_feature (521)..(521): n is a, c, t, g, unknown, or other
  misc_feature (522)..(522): n is a, c, t, g, unknown, or other
  misc_feature (577)..(577): n is a, c, t, g, unknown, or other
tccccgcggtggcggccgctctagaactagtggatcccccgggctgcaggaattcgcacgagaccattacctagaacatcctaatcgaaaaaaccggccggcttccctcgcccccggcgaggagtgaagacaagccgacaaggcaaaaccatcgcctgtacggtatccaaccgccgtcccgccgcacaaccaaggatagggcgggagagggggatctcgctttcgctccgctgccgcatgcgcaccgcccctcctcatgacaccaactagggcaccaccagcccccttctcgtcgacctccgcgcggtgactctgctgagcatcatacccttatagggcccaacccatggatgtaacttcgaccgctgccgcctccgcctcaggcggnnggtaggtggtacacgggcatgtccgcggataacatcnaagggcctggtgctcgcgctctcctccagcctcttcatcggcgccagcttcatttatcaagaagaaggnactcaagaaggcgcatctcgcgtcannaaaaggggggggttggggggctattctttattatatgagcctcttttgggggggnttggcatgataacaatgattgtgtgggaagaagttgcaaaatttcgcagctttatgcatttgcaccgggcttattttggtcacctcccctctcgggtgctcctaagcataattaatc

SEQ ID NO: 31780 - protein, 37 aa, Zea mays
  misc_feature: Ceres CLONE 1408223-F
MITMIVWEEVAKFRSFMHLHRAYFGHLPSRVLLSIIN

SEQ ID NO: 31781 - DNA, 580 bp, Zea mays
  misc_feature: Ceres CLONE 1408225-F
  misc_feature (166)..(166): n is a, c, t, g, unknown, or other
  misc_feature (182)..(182): n is a, c, t, g, unknown, or other
  misc_feature (201)..(201): n is a, c, t, g, unknown, or other
  misc_feature (202)..(202): n is a, c, t, g, unknown, or other
  misc_feature (212)..(212): n is a, c, t, g, unknown, or other
  misc_feature (254)..(254): n is a, c, t, g, unknown, or other
  misc_feature (255)..(255): n is a, c, t, g, unknown, or other
  misc_feature (259)..(259): n is a, c, t, g, unknown, or other
  misc_feature (296)..(296): n is a, c, t, g, unknown, or other
  misc_feature (423)..(423): n is a, c, t, g, unknown, or other
tgggagctccaccggcggtgggcggccgctctagaactagtggatcccccgggctgcaggaattcgcacgagaccattacctagaacatcctaatcgaaaaaacccccggacatttctggtcgcaccctcctcccggcctcccagcgctaagccctctggaacttncgagagctcgatcggnatcgagcccctgccatggnncgacgagcgngcgaagggtaatgcgcgtctcagccgccgcttcgaggagggnngggnattcacgacgcatcgggttgcccgggaacacgtcttnatatcaaacggtgggggggttgcctaatcccccgtttccaaagtttccccaagggaaaaaaacgtggagctaaagctgatggggcaggggttatccgcctgggcggactctgttttgggggagaggngggggggggtgtttaaaataaaaaaagggccttttgttcccaccccaaaaaaagtttcaaggggggttttagaaaccaaaaaaagcccccccccccccccccggggggggggggtctcccccccaaaaattttttttaaagatttttgccgcccccc

SEQ ID NO: 31782 - DNA, 681 bp, Zea mays
  misc_feature: Ceres CLONE 1408227-F
  misc_feature (399)..(399): n is a, c, t, g, unknown, or other
  misc_feature (453)..(453): n is a, c, t, g, unknown, or other
  misc_feature (454)..(454): n is a, c, t, g, unknown, or other
  misc_feature (478)..(478): n is a, c, t, g, unknown, or other
  misc_feature (488)..(488): n is a, c, t, g, unknown, or other
  misc_feature (572)..(572): n is a, c, t, g, unknown, or other
aagctggagctccccgcggtggcggccgctctagaactagtggatcccccgggctgcaggaattcgcacgagaccattacctagaacatcctaatcgaaaagggggtgttaaaccgcatcgcatcgtcttctagggtttcctcctcccgccgccacttgctgccccacgagcccattcccctcagcccttcaccatctccggcggtcgcagtggcatcagcagctccggctcacgcgcagcaaaggaacgacaatatggcgaccatcgtaaacacgacggaggaggagccgatggctggccgtggtccgcttcaccgctgagctcgcctgggccgaccgggggcccggaagtcgccggaccccgaggtcgcccgcctatggtctcgaggcgcaggaatnatcttcggccggggggccggggggcttcgacatggccctccccttatggctcgnnctccgccgaacctcctcctcaccntccccgtcgnggcgtctcggacaaagaccctgggaggtgcgttctcctccgtcatctgcagcctcgtcaccaagggcgggaatcccgaggaccnaggcggctgcaagatcacccgaactcatctggcgttaagctcacccaccaacacggtggacaagccagcgttggcgcctcaaaaggtctttttcagctttgtacaatct

SEQ ID NO: 31783 - DNA, 735 bp, Zea mays
  misc_feature: Ceres CLONE 1408228-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (24)..(24): n is a, c, t, g, unknown, or other
  misc_feature (25)..(25): n is a, c, t, g, unknown, or other
  misc_feature (28)..(28): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
nnnnnnnnnnnnnnnnnccccggnnaangggaannnannngnnnnacgtctccccatttaaaagtggagctccccgcggtggcggccgctctagaactagtggatcccccgggctgcaggaattcgcacgagaccattacctagaacatcctaatcgaaaactctgcaaagcgtgcgacgggacgggccgggtcgttctcgacctctcggctcgggcttccgtccgcccccgaggaagtaaccctagcctagcgtagctccgaccggccgccgcggagactgctacgatgatgtactgccctgtaggccgaagaccgcgcggaggacttcctcctcgtcgaaaccgggcccggctacgaggcagatctcgtccccggcttccgggacaatgcagggctggggattggggccatccatggagatgctggcagattttaacaaatcaaatttcggggaaaagggggtaaatattaaaccatgttccactggggcccaaactcccagggggttcgccggggaaaaaaaatgggggggggcccaatatctaatgggcccgggtgcccgggggaataaagagttcctatttatgaaaacccggcgggaaggggaaaccccagtccaaaaaaaagggcaaaaaatctttgtggaggagatacccccccccgcaaaaagggggggccccctctcttttaagagggggggccggcccaccaaataaatctttggggggggacc

SEQ ID NO: 31784 - DNA, 747 bp, Zea mays
  misc_feature: Ceres CLONE 1408232-F
  misc_feature: Encodes the peptide sequence at SEQ ID NO. 31785
  misc_feature (262)..(262): n is a, c, t, g, unknown, or other
  misc_feature (607)..(607): n is a, c, t, g, unknown, or other
  misc_feature (734)..(734): n is a, c, t, g, unknown, or other
ctggagctccccgcggtggcggccgctctagaactagtggatcccccgggctgcaggaattcgcacgagaccattacctagaacatcctaatcgaaaaacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacntcgaccgcatgctccacgacatccctggcatgaaggtcctcgtcctcgacccccaaaccgttgggatggtgagcgtggtgtacagccagtcggatctgctgcggaaggaggtcttcctcgtcgagaccatggacaacgcctccagctccagggagtccatggcgcacctcaaggccgtctacttcctccgaccctccgctaacaacgtccagaagctccgcaggcacctcgccatgccgcgcttcgccgagtaccacctattcttctcagttatattgaagggtccgcagattcaaatacttgctgactcggatgaaacaggagttgtgcagaaagttcaggaangtctatgctgattttttgtgcattgaccccatacatttcactctcacatacaaataaccacatgttatgctccccacagtgtcgaccctccctgtatggcaggcttctgggatcgagccgtgacggnattgctctggctt

SEQ ID NO: 31785 - protein, 128 aa, Zea mays
  misc_feature: Ceres CLONE 1408232-F
  misc_feature (11)..(11): Xaa is any aa, unknown, or other
  misc_feature (126)..(126): Xaa is any aa, unknown, or other
MVLITLVRDYXDRMLHDIPGMKVLVLDPQTVGMVSVVYSQSDLLRKEVFLVETMDNASSSRESMAHLKAVYFLRPSANNVQKLRRHLAMPRFAEYHLFFSVILKGPQIQILADSDETGVVQKVQEXLC

SEQ ID NO: 31786 - DNA, 705 bp, Zea mays
  misc_feature: Ceres CLONE 1408236-F
  misc_feature: Encodes the peptide sequence at SEQ ID NO. 31787
  misc_feature (300)..(300): n is a, c, t, g, unknown, or other
  misc_feature (319)..(319): n is a, c, t, g, unknown, or other
  misc_feature (407)..(407): n is a, c, t, g, unknown, or other
  misc_feature (417)..(417): n is a, c, t, g, unknown, or other
gctctagaactagtggatcccccgggctgcaggaattcgcacgagaccattacctagaacatcctaatcgaaaaactgatggatcactcctgcagctgcagctgcagtgcgtcgccgctactccatcgtctattaattcctcgtgtagctccagcgctcggcttagacaagcctctccaacatgaagctcctgggttggatgcaccggaagttacgacagaacagtaatgatgtgttcaaagagttcaacaacgctggagggtgggacgtgcaactgcatcaccgggctggccgcgtcgnacccggccactttcctcgncaccgccaacgaatactttcgcgccgacaacgacttcaccaacatcatccattcgtcggccggccgccgacctcttcaccctttgggngggcaggcgncctcctcaccattggcacgctagcaatcgccccccccccccgggggggctggcaaatgctttaattaaattttaattaaccaccgtcaacagcccgatgctggacttccgaatttgacgagacacgacgacacccggccgggggaatggaccaaaaaacagggtcgaaagggggccgttccccgcccacggtttccataatgccagcggccgcctccccggaaaagggacacccccgggtcctcccaaaaaaagctgtaactttttcccccgggggtttaagggcacc

SEQ ID NO: 31787 - protein, 70 aa, Zea mays
  misc_feature: Ceres CLONE 1408236-F
  misc_feature (25)..(25): Xaa is any aa, unknown, or other
  misc_feature (31)..(31): Xaa is any aa, unknown, or other
  misc_feature (64)..(64): Xaa is any aa, unknown, or other
MMCSKSSTTLEGGTCNCITGLAASXPATFLXTANEYFRADNDFTNIIHSSAGRRPLHPLGGQAXSSPLAR

SEQ ID NO: 31788 - DNA, 686 bp, Zea mays
  misc_feature: Ceres CLONE 1408239-F
  misc_feature: Encodes the peptide sequence at SEQ ID NO. 31789
  misc_feature (364)..(364): n is a, c, t, g, unknown, or other
ccccgcggtggcggccgctctagaactagtggatcccccgggctgcaggaattcgcacgagaccattacctagaacatcctaatcgaaaaaaacacgcaaaacgtgcttctgtccctctcctgttataatttcgtcttcttccctctcccaccggtgtcctcgcctcgcctatccgatctgccacctcgccgtctcgcacgttcctttccccaactccccagcgcctctccgcgccgcgatccagatccaggttgttcagcatgggtctggtgaaggaaggcgtcgacatggaggagggaaccctagagatcggcatggagtacaggactgtatctggtgtggccgggcctctggttatcttgnataaagtaaagggccccaaagtaccaagaaattgtaaacatccgactttggagatggcaccactcgccgtggtcaaggtccttgaagttgatgaaagaaaagctggttgtgcagggtttttgaagggaacttctggaatagacaacaaatacacaaccgtgcagttaacagggggaggtttttgaaaactcctgcctccatccaatatgcttgggcggattttttaatggttctgggaaaacctattggaaaatggcccccccgaatattacctggaagcctacttggataatctctcgggaagttccaattaatcgcaagg

SEQ ID NO: 31789 - protein, 95 aa, Zea mays
  misc_feature: Ceres CLONE 1408239-F
  misc_feature: SWISSPROT Homolog: EC 3.6.3.14 H(+)-transporting two-sector ATPase
  misc_feature (35)..(35): Xaa is any aa, unknown, or other
MGLVKEGVDMEEGTLEIGMEYRTVSGVAGPLVILXKVKGPKVPRNCKHPTLEMAPLAVVKVLEVDERKAGCAGFLKGTSGIDNKYTTVQLTGGGF

SEQ ID NO: 31790 - DNA, 676 bp, Zea mays
  misc_feature: Ceres CLONE 1408240-F
  misc_feature (348)..(348): n is a, c, t, g, unknown, or other
  misc_feature (361)..(361): n is a, c, t, g, unknown, or other
  misc_feature (370)..(370): n is a, c, t, g, unknown, or other
  misc_feature (414)..(414): n is a, c, t, g, unknown, or other
  misc_feature (415)..(415): n is a, c, t, g, unknown, or other
  misc_feature (439)..(439): n is a, c, t, g, unknown, or other
tggagctccccgcggtggcggccgctctagaactagtggatcccccgggctgcaggaattcgcacgagaccattacctagaacatcctaatcgaaaagccaagctttcctcaaaaactcgaaaaaggaacggagaaggcgtcctcgacgactgcccatggccgccgcccggacctagccagggattgttgtctcctgagtcccgacctaccaaggcggaaagggagagggggcgctgtggcgtcaggaaataactggaagccgagggctgagggcgagcgcagagtcgggtggttatcgctttctttttcgttttctttttccggaggggagagtattaaggatgccngttgctaggccgnagccgcagnagcccccgggtgatcgcccatgtcgacatggactgcttctatgnntcagtcgagcagcggagaacccgncgctcaggggacagcgaacgcccgtgtgcagaacaccggctgaaagggcggcggcttgattgccgcagctacaaggctcgggggatttgggggggaaaaggcccctgcccgaaaatgagcccaaaaagtatggcctggaattaatccttggtcaagccccccgggggcggggggaaaagttaccccttaatttttaaaaaaaggggttgggggtttaaattttttcgcaaaccttag

SEQ ID NO: 31791 - DNA, 734 bp, Zea mays
  misc_feature: Ceres CLONE 1408241-F
  misc_feature: Encodes the peptide sequence at SEQ ID NO. 31792
  misc_feature (465)..(465): n is a, c, t, g, unknown, or other
  misc_feature (511)..(511): n is a, c, t, g, unknown, or other
  misc_feature (569)..(569): n is a, c, t, g, unknown, or other
  misc_feature (570)..(570): n is a, c, t, g, unknown, or other
  misc_feature (650)..(650): n is a, c, t, g, unknown, or other
  misc_feature (684)..(684): n is a, c, t, g, unknown, or other
  misc_feature (689)..(689): n is a, c, t, g, unknown, or other
  misc_feature (710)..(710): n is a, c, t, g, unknown, or other
  misc_feature (720)..(720): n is a, c, t, g, unknown, or other
aagctggagctccccgcggtggcggccgctctagaactagtggatcccccgggctgcaggaattcgcacgagaccattacctagaacatcctaatcgaaaaacccggcagtcacacctcgaaagcaacagcaagtcagcaacctacctagctagagctatcactatatcagtatcaggtacctagacctagcagcagccacacccacaccgtacgtcggcatggctaggtggtcgtcgtcagctctggtcgccgtcctcgtggtcctggccgcggcggtggcgtgctccgcggcgcgccccgtccccgcgcagcagcagcaggcggtagaggacgtgaagcggccggacacgctgcacgaggggacggtgctgatccccggggatggggcgctacgagatcggcagccactacatcccggacatcgggcgggctggaccacagcatccccgccgccacccacggncagttcctccccggggccgcgaaaacactggagtgccacccgcggnttttcgaggtccccaaccccttcatggcccggcgcgggcactccctgaaagttaccgnnggtgggggggagggggggtttccgggcgaaatggggatcgccggagcccggccgcccgccctggacgaatatactacagnctactctcgggtctgtaacgaatagctagctagntttancttagccgtgcttgcctgtgnaatgacccanggtgctttcggggg

SEQ ID NO: 31792 - protein, 112 aa, Zea mays
  misc_feature: Ceres CLONE 1408241-F
  misc_feature (82)..(82): Xaa is any aa, unknown, or other
MARWSSSALVAVLVVLAAAVACSAARPVPAQQQQAVEDVKRPDTLHEGTVLIPGDGALRDRQPLHPGHRAGWTTASPPPPTXSSSPGPRKHWSATRGFSRSPTPSWPGAGTP

SEQ ID NO: 31793 - DNA, 806 bp, Zea mays
  misc_feature: Ceres CLONE 1408244-F
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
tttttttcccccnnnnnncntcccccccccaccccccctctccctcccccatccaacctggggatcagcgcggggggggtggctctagaatagtggatcccccggactgcaggaattcttacgagaccattacctagaacatcctaaacgaaaactccttcccctcccctctttccacgacaccaaaagaaaccgaaaagcatctgagcgctccgtccaccctcccctaccccgcgtcctcctcccctacgcctcccagcccagcggcaaaacctatccctatatgggcgccgtcccctctacggccgcgacgcgctttgccttttttcccgcagagtccgccgtagtatgggtttcgagaatgcgggcgccgctctcggccccttgccacacccggagcctccggccccaggaatatccaaaacgcccggcctcgggtcccccggcaactatcaagcccgcccggcctccgcgatctggggctacaccccaagcccgatcgacataagggagtgacagaaaacagaaccgcctgtggttccgtgtgggcggaattcatcaaggtacgcgcctcccgcagaggacgaacaaagagggaacaggcgacgtaattaggatctacaagtatactgtagcacaggagaacgaagagacggctggaggcaaacgggacatacgatttaccaatcaaaacaactttttatcaatcactatacagagtgaaaaatgcggtaagatatattggcacgctcacaccagacaaccccgctaatgtatacacatccgaccgacagttatagaaatcg

SEQ ID NO: 31794 - DNA, 749 bp, Zea mays
  misc_feature: Ceres CLONE 1408246-F
  misc_feature (26)..(26): n is a, c, t, g, unknown, or other
  misc_feature (749)..(749): n is a, c, t, g, unknown, or other
tttttcccccccccggcccgcccccntcattttatatttgaactcctaaattattttccggttccacgccgggaggccccctctataatagtggatcccccggggtgcaggaattcgcaaccattacctagaacatcctaatcgaaaaattgcctgttctccactccagttcccagctccgcagctcgaggacggaacggagggagatagggccaggggaagggacggagagccccgtctccaattcacaacactgccacggccggagccggaggaggaaggcgccagccgtagtccacaggcaacgcaagggaatgccactgttctagtctcgctctcgcagatctgctccgccgcgccctgttcaccgggaattctggagctgagggcgcaggttcgagcagaagctcggagcatggccatggccgagggggagaagcaccatgcccggtgccggtggtaggtagggctctctgatatcgcaggcctttcacgcggcccggcccaaaggcttcccgtccgtaccgtcggctagccgaggacggaaaccgagatcgggtgattgcttgactcggaagctgagccgaggtcgcaatgggcgtcgtggtacaaacctcgggagagctctccaacatcgcgcaacttcacggggcttggacgccgccaaagctcatttcccgccatcggccagggccgcccgccccacggcgcaggctggcacaagttgcaaacgggcacgcggcttcccn

SEQ ID NO: 31795 - DNA, 688 bp, Zea mays
  misc_feature: Ceres CLONE 1408247-F
  misc_feature: Translation starting site: 194
  misc_feature: SWISSPROT Homolog: EC 2.7.11.1 Non-specific serine/threonine protein kinase
  misc_feature (286)..(286): n is a, c, t, g, unknown, or other
  misc_feature (324)..(324): n is a, c, t, g, unknown, or other
tccccgcggtggcggccgctctagaactagtggatcccccgggctgcaggaattcgcacgagaccattacctagaacatcctaatcaaaaaaccaggcaagcaagcgggagccgccaactcgtgcctctcggcagcggcgtctgaactctgaaccgaccgaccgaccgaccgttccgttccgttcaccccaccatggaggcgccgccgggaccggggcccatggagctggacgccccacctcccgccgccgccgccgcggcgattcctcccgccggagcgacaggncacaagggacgggggaagggggagacgcttgtgacggnccatatcatctccaccacccatcggcgggaagaacggcgagcccaagcggaccatcagttacatggcagaaacgtgtcgtgggcacaggcttcatttgggatcgtcttcccaggctaagtgtctggaaaacaggagagaccttcgccattcaagaaggtgctgcaaagatcggcgttacaagaaaccgggagctgcaaacttatgcgtgccatgaagcaccccaacgtcatctgcctgaagcactgcttcttctcgacaaggagcaggggacgaattgtttttaaaccttgtcatggaattcggccctgaaactttataccggatcctgaaacacttacggcatgcgaaccaaaaggtgccttt

SEQ ID NO: 31796 - DNA, 862 bp, Zea mays
  misc_feature: Ceres CLONE 1408249-F
  misc_feature: Translation starting site: 160
  misc_feature: Pfam Name: PAZ Pfam Description: PAZ domain
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
tttttgggcaccannnanatctctccttccacatttatatattcctctccccgtaatagatgtactcaccgcggtggtgtccgctctagaatagtggctcccccgggctgcaggaattcgcacgagaccattacctagaacatcctaatcgaaaaaacaatggagttatcattccctattgatgatcgtggtactgttaagactgtggtgcaatacttcctggagactttatggtttcagtattcagcacacccactttacctttgttttgcaagtgggcaatcagaaaagaccaaattatctgccctatggaggcctgtaaaatagttggggggcaccgctactcaaaacgacttaatgataaaccgatcacttgtcctactgaaggggacttggccaacggtccccaagcaacgtgaaaaggcacatttttggaaaattgggatttcaaaaaggcccaactccccaggatacctttatgccccaggaaattttgggaaataacccattggtatgaaccgtcttttgcgcttccggtataaaaaacctcgtggttttctccccccctccccccaaggtgttggaaaaaaacccttgggaaaggggggccaaaaaaaaaaagtggatgttgatatatctccaaaaaccattccgcccctcgggggacaccttggtcggaaataaaaaaaaatggggcgaaaccgggcgggcaaaagagattaaaaaaaaatcggcgcaagaagaacaaataacccttcccccacagaagagttgtgcaaaaatgtgggttgccccacacacaaacgatttctattccctccaccttctgcgctctttaacacgccgcactaaagaaatcgag

SEQ ID NO: 31797 - DNA, 687 bp, Zea mays
  misc_feature: Ceres CLONE 1408250-F
  misc_feature: Encodes the peptide sequence at SEQ ID NO. 31798
  misc_feature (328)..(328): n is a, c, t, g, unknown, or other
  misc_feature (347)..(347): n is a, c, t, g, unknown, or other
  misc_feature (391)..(391): n is a, c, t, g, unknown, or other
cgcggtggcggccgctctagaactagtggatcccccgggctgcaggaattcgcacgagaccattacctagaacatcctaatcgaaaactttttttcttcgatctccgcaatctacagctttgcttctcccggctcgagcggctagggtttcgggagtgcgcggtgagacggcatgacaacgcggggagctaagcgcgcggccacctccgaccccgccgcacccgatttaccaagtaagagagtaatggacggaccctcttttgatgttcacagggcggagtcttcccatcagcatgtgatggcaggacccgctagtttagatcctcgncgggcggaggctgctagcnaacatgtgaggccacttaatacccagtttgcaagctgggttcanttgcagctgcaaatcatcagctgaactttgggaggacgccctaaagaataccttcacatgcttcggaatcatgaaaaattcagggatgttgccactggctaagcaaaaacacgagtttcaaaaagtgtttcttccccagcccctgaaggggggataaccccatcctccccaacaaagaaacaagttcttaaacacccccaggtaaaaaaacaaaagaaggccccaattgggggtcaaaatttctcttttttaaaaaacagagtaaagaaacttttttctcccccctcttcaaaaaa

SEQ ID NO: 31798 - protein, 80 aa, Zea mays
  misc_feature: Ceres CLONE 1408250-F
  misc_feature (59)..(59): Xaa is any aa, unknown, or other
  misc_feature (73)..(73): Xaa is any aa, unknown, or other
MTTRGAKRAATSDPAAPDLPSKRVMDGPSFDVHRAESSHQHVMAGPASLDPRRAEAASXHVRPLNTQFASWVXLQLQIIS

SEQ ID NO: 31799 - DNA, 755 bp, Zea mays
  misc_feature: Ceres CLONE 1408251-F
  misc_feature (46)..(46): n is a, c, t, g, unknown, or other
  misc_feature (398)..(398): n is a, c, t, g, unknown, or other
  misc_feature (491)..(491): n is a, c, t, g, unknown, or other
ggggttggttttggggggggaataggtgttgtttatagaggaaagnaaaaaacgggggagaaaactggagctcaccgcggtggcggccgctctagaactagtggatcccccgggctgcaggaattcgcacgagaccattacctagaacatcctaatcaaaaaaattcatcttcttcgtcttcatcgcagcatcggcgctccatcttctgctccctcccccacttcgtgctcgggttccatcttccgctccttcccccactcgcggtcggcacgcaggctcggccggcgtcagcggctccccatcccgccagtacaggaagagggccgccgcttggagctcgcgggaggtagcgtcgccgccgccgcatgaaggtcccgaatggctgaatcctgaccgnctgcctggagagtctcgcgcctaaatcacatcatattgagctcttcgccctttggatcccgtcttattatttgctcacactgaaagaattagnttgcacttttggaggaaaaatgagtgctgcctcccaaggaggtggctccgaggaaaggaagtcacctccacaaccaacaaaacgccccttttggatgacagcaagtttggaattcgagcccctgcgaaaaattaatttcagtcccggtggggaagggaatttccatgggtttcttctggaaccggggaaggaaaaaatctgccaaaaatttcaaccggggagggggcccccgcggaaagaaaaagaagaggcccaactcggaag

SEQ ID NO: 31800 - DNA, 693 bp, Zea mays
  misc_feature: Ceres CLONE 1408256-F
  misc_feature (234)..(234): n is a, c, t, g, unknown, or other
  misc_feature (235)..(235): n is a, c, t, g, unknown, or other
  misc_feature (243)..(243): n is a, c, t, g, unknown, or other
  misc_feature (270)..(270): n is a, c, t, g, unknown, or other
  misc_feature (271)..(271): n is a, c, t, g, unknown, or other
  misc_feature (275)..(275): n is a, c, t, g, unknown, or other
  misc_feature (276)..(276): n is a, c, t, g, unknown, or other
  misc_feature (284)..(284): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (298)..(298): n is a, c, t, g, unknown, or other
  misc_feature (376)..(376): n is a, c, t, g, unknown, or other
cgcggtggcggccgctctagaatagtggatcccccgggctgcaggaattcgcacgagaccattacctagaacatcctaatcgaaaaccttgtctacagggttttccgctgtcttatcccttcgtccacgctccctgcagccgccgcccaaaccctagcaacccgtcctccgccatggccgacgaccactactcctctaagaggaagtacgacgacccctcgcccgccgcggggnngcacgggntttctcttcgggcccgccgcctgctgnnccgnntcgggggnggnnnccccgtcgnaaaacaggggggcccacgcccccccgaggaaaccccgctccgcaaacaacgccgcgcaagaaaacccggggcgggaancttttagccccccaaaggccaagggggccccccgggcgaaaaaggggaaaaataaaacgggggggattttggccccccccctggcataaaatggttgggggggggccccctcccggcgggggaaggtcttcggtttctcgcctctcacgcggggggagggaccgacctctttcttccacacaattttttttcgatgaatgggcggctcccgtcacgcccctcgtggggatgcgagctcggattacatgtatgagacttgtgttatgcgcgtgcggcgggcgcggcggtctatttttgaggatatgggggtattcctg

SEQ ID NO: 31801 - DNA, 682 bp, Zea mays
  misc_feature: Ceres CLONE 1408257-F
  misc_feature: Translation starting site: 387
  misc_feature (607)..(607): n is a, c, t, g, unknown, or other
aaagctggagctccccgcggtggcggccgctctagaactagtggatcccccgggctgcaggaattcgcacgagaccattacctagaacatcctaatcgaaaaaggatgacaaaatttcccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgcccgccgcatgatctgcgcgatctccggtgaggtgccggacgagccggtggtatcgaagaaagtcggggcttctcttcgagcggcggctcatcgagcgctacattgaggaccatggcaagtgccccatcaccaaggatgagcttactatggatgatatcgtgccggtcaataccaacaaaggtcgtgaagcccaggcctttgcaggctgcaagcattccaggactccttgggattttccaaaacgagggggatggctcccatgctttcaaatttgggtttggagcagccgctaccccccggaagaacaagactttagtcatgcactctaccanaatgaccctggcctgcccgggtaatacccagtttaaaaaagggaaaagaagtggggttaaagcacttttgggctc

SEQ ID NO: 31802 - DNA, 864 bp, Zea mays
  misc_feature: Ceres CLONE 1408258-F
  misc_feature (1)..(1): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (33)..(33): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
nttgcccccccccccccccnnnnntannntcancgtgggcgcgnnnnnggaccaaagctggagctccaccgcggtggcggccgctctagaactagtggatcccccgtggctgcaggaattcgcacgagaccattacctagaacatcctaatcgaaaaagagagagaaaggggagggaggggcagataaagaacactgcaccatttgtgtggtcacttgatttcaaaggtggacctcccctcttcttcgtcctcccctcatctccttccaacagcggcataaccacagcttccctctcctcctctctcttgttgcacggaatatgacgccataaccacagcttccccgtggaacgacaagggagaaacagagagggctacctagggcacatgtagggggactataggataagaactatacaggtagggaggtaccggcagggagggagcacgcccccccgcagtaggggatggtaacaagaaaccagcttccaagaactggggccgcacaggaacctggttccacgcgtggcattccataaccggtggcactgggggaagggggccccggactcaccaccgcaggtgttttaccggggcggggccgaccccccctgtcaacggggggagaacccttcggggggggccccgagccgggggtggcgcccatcggttccccggcccggggggcgaagccaccgcccggcttgccccgaaagagcccccccgccggcgcgggccgtggtgcgccgtcgcgccgggcgcgggtcgctttataccgggcggggggagaggggggagcgatcggtacttacacaacctgtctccctatcactatacaaaccccgggctgtgacggggagaac

SEQ ID NO: 31803 - DNA, 695 bp, Zea mays
  misc_feature: Ceres CLONE 1408262-F
  misc_feature: Encodes the peptide sequence at SEQ ID NO. 31804
taatgctggagctccccgcggtggcggccgctctagttcctgtggatcccccgggctgcaggaattcgcatgagaccattacctagaacatcctaatcgaaaaattttttcatttcttcccctcttctcgtcacgtccaaaggggggaaaacttctttctctctcttttttttccctcccccgcccgaatctgatgcttaaaccctcgccgggaggaggattccaatcccgacgcaccagcccgcgcccgccacctacagccgcgcccggatctccgccatggccgccgcgccgcaccaggcccagggccccgcagatagtgtgattccgctgcagtctgaacccgcacttgataataacccctccaagagtgcaaacgccagggaccagattctttctggtacggagaatgtgactacaggcaatgcacgcggcggcagctccttgaaatcgcaaaaaggcccgccagagaaggctagctctgttggaaaacctggagaacaaccttttccctaccagcaaaatgtgtatgcaccacagccacaaccactctatcctggaggctacatgaacccttcaggacaatgggaggaatatccccattatgtgagtatggaggggctccatcccgtatctcccggaatctacaatgacaaccaatccctcatgctatctcctggatatgcaaacaaccc

SEQ ID NO: 31804 - protein, 138 aa, Zea mays
  misc_feature: Ceres CLONE 1408262-F
MAAAPHQAQGPADSVIPLQSEPALDNNPSKSANARDQILSGTENVTTGNARGGSSLKSQKGPPEKASSVGKPGEQPFPYQQNVYAPQPQPLYPGGYMNPSGQWEEYPHYVSMEGLHPVSPGIYNDNQSLMLSPGYANN

SEQ ID NO: 31805 - DNA, 648 bp, Zea mays
  misc_feature: Ceres CLONE 1408265-F
  misc_feature: Encodes the peptide sequence at SEQ ID NO. 31806
  misc_feature (359)..(359): n is a, c, t, g, unknown, or other
  misc_feature (360)..(360): n is a, c, t, g, unknown, or other
  misc_feature (364)..(364): n is a, c, t, g, unknown, or other
  misc_feature (369)..(369): n is a, c, t, g, unknown, or other
  misc_feature (392)..(392): n is a, c, t, g, unknown, or other
tcaccgcggtggcggccgctctagaactagtggatcccccgggctgcaggaattcgcacgagaccattacctagaacatcctaatcgaaaagcaaggatggttttcagcaactagtttctgaacagcgtgtccgctgtctggtctgtcaaaataatcttggtaaccagtgccaaaatgattgctgggggaggctattttgatggttctcatgaccatattctcatggaaggatcaatgatccatgattcttcacaatcttccatctatgaccatacagatgttgaacagcagaactttcagatttgcgcccttaatacatagaagatcactccaatccagccaaccttaactctgaggnntgcnagggntgatagaccaaattcaacaccgncttggggaatgacatcgagcagaaaccatagtgatccatgaaggcgaggaaggtccctcagcaaaactggaaaaatttgggttctgctgggccaaaggggggggtaaaaaaccttttccctaagcacccaaataaaaaaaggccccataaacaaaaactgggggaaaaaaacaggggcccctgggttttttacccccgggcccttaattatcaaaatggccccttattggcagcttgccaattgattttttctaag

SEQ ID NO: 31806 - protein, 48 aa, Zea mays
  misc_feature: Ceres CLONE 1408265-F
MIAGGGYFDGSHDHILMEGSMIHDSSQSSIYDHTDVEQQNFQICALNT

SEQ ID NO: 31807 - DNA, 694 bp, Zea mays
  misc_feature: Ceres CLONE 1408266-F
  misc_feature: Encodes the peptide sequence at SEQ ID NO. 31808
  misc_feature (294)..(294): n is a, c, t, g, unknown, or other
aaaagctggagctccccgcggtggcggccgctctagaactagtggatcccccgggctgcaggaattcgcacgagaccattacctagaacatcctaatcgaaaaccttcgcattaatggccgctctctccctatcccctttcgtctcgctctcggagtaggacactcgcccgcttccggcttaaccttcaagattctccctcctcctcctacttcttcccgcttgggcgggcgcggcaccttccggttctgggcctcctatatatatacgcgcgcgaccgtcccccttccatacntcctagcatgctcggctcgcaccccggattgatcgagctcgcccgtcgccgcgatggattcggtgccttccccctcctcttctacccgggcccacgctgctcccggtccctgctgccgctttgacgcgctgcggagggcgtgcgccaggaacgccgccgcccgcgcgggggccgccgggggggcgctcggggcgctgctcacctgggtcttccgcggggggggtctcctcgggggaaatcttcatggggggcttcagggggatgccaacaaaaaggggatttgtcccgggggttgggggcgaaaaaacctccggaagaacttttcccattggggggggtggggcccgcgatcaaaatttggggggccccacctttgggaaaaaaaaccatttttctatgg

SEQ ID NO: 31808 - protein, 115 aa, Zea mays
  misc_feature: Ceres CLONE 1408266-F
MDSVPSPSSSTRAHAAPGPCCRFDALRRACARNAAARAGAAGGALGALLTWVFRGGGLLGGNLHGGLQGDANKKGICPGGWGRKNLRKNFSHWGGWGPRSKFGGPHLWEKKPFFY

SEQ ID NO: 31809 - DNA, 684 bp, Zea mays
  misc_feature: Ceres CLONE 1408270-F
  misc_feature: Encodes the peptide sequence at SEQ ID NO. 31810
  misc_feature (353)..(353): n is a, c, t, g, unknown, or other
  misc_feature (374)..(374): n is a, c, t, g, unknown, or other
  misc_feature (438)..(438): n is a, c, t, g, unknown, or other
  misc_feature (443)..(443): n is a, c, t, g, unknown, or other
  misc_feature (455)..(455): n is a, c, t, g, unknown, or other
  misc_feature (465)..(465): n is a, c, t, g, unknown, or other
aagagctggagctccccgcggtggcggccgctctagaactagtggatcccccgggctgcaggaattcgcacgagaccattacctagaacatcctaatcaaaaataccccgtctcggttctcaaacaccgccgccgccgttctcccgacatctccccgtccaggtcgttgggtcagcccctatccttcaccttcacgacttcacctgcttctccactgcgcgccccgcccccggccccgtcgtgcgccctgctcagatccatcgcacggggcttgccgcaccactgcgccaagcaaaaggtgggcggccagcggcgcgtgcgcagatcatgcactgttgtcttatgaagattgntaaggggagaaagaagatgangaataaacagcgaaaatcatctgcccctcgttctgatgcaggatggggatcttctttatcttgnattgnatggagcttggngggttttggncttggctgcttcctttttcctaaacatcaagcagacagtggtcagacccatgtttatttcagtcctcttcatgcgaccagaaaattagaggacatcgaggaggatcatttccgctttgcaactccctcacaaggtgaattcctcgtgcagtgaagaaggagggggacctcgtaacaacccaagggttatagatgattatctgaaggagtcttcagcaga

SEQ ID NO: 31810 - protein, 96 aa, Zea mays
  misc_feature: Ceres CLONE 1408270-F
  misc_feature (9)..(9): Xaa is any aa, unknown, or other
  misc_feature (16)..(16): Xaa is any aa, unknown, or other
  misc_feature (37)..(37): Xaa is any aa, unknown, or other
  misc_feature (39)..(39): Xaa is any aa, unknown, or other
  misc_feature (43)..(43): Xaa is any aa, unknown, or other
MHCCLMKIXKGRKKMXNKQRKSSAPRSDAGWGSSLSXIXWSLXGFGLGCFLFPKHQADSGQTHVYFSPLHATRKLEDIEEDHFRFATPSQGEFLVQ

SEQ ID NO: 31811 - DNA, 654 bp, Zea mays
  misc_feature: Ceres CLONE 1408271-F
  misc_feature: Encodes the peptide sequence at SEQ ID NO. 31812
  misc_feature (437)..(437): n is a, c, t, g, unknown, or other
  misc_feature (455)..(455): n is a, c, t, g, unknown, or other
  misc_feature (554)..(554): n is a, c, t, g, unknown, or other
  misc_feature (589)..(589): n is a, c, t, g, unknown, or other
  misc_feature (597)..(597): n is a, c, t, g, unknown, or other
tggagctccccgcggtggcggccgctctagaactagtggatcccccgggctgcaggaattcgcacgagaccattacctagaacatcctaatcgaaaacgggatcgctctctctttgggctaccggctccgccgccgctccgccgccctaagccaggtgctgaaggccttcgtcggtcttttcaccggcgacgacgacccactaggaaaagaattttcctggcatatttttgtttccagaaatattcgtgtcaagttggtatgtcagggatcacagcaatttggcgtcggtcatgtccattagctgctagtcagattctaatggagacatattttggcccatctgtatcttctggtgttctgaggtgggtcagcagcggcactaagcactcaagaaaacctgaattttctgttgctaacatatcagggtggtggattngcattctgcttctgcagntaattatgtgtcaacgatcagaagggtgcccctttcatgccgtatggacactaattggttgattacttcaaagtccagacatggtgcattgccagaatncttaggtgtttcagcttctatcggggatactctcnatactggnaatcagcaggagcttcgcagagggtgtctctaatctccttctacgaaggctctgagt

SEQ ID NO: 31812 - protein, 85 aa, Zea mays
  misc_feature: Ceres CLONE 1408271-F
  misc_feature (60)..(60): Xaa is any aa, unknown, or other
  misc_feature (66)..(66): Xaa is any aa, unknown, or other
MSGITAIWRRSCPLAASQILMETYFGPSVSSGVLRWVSSGTKHSRKPEFSVANISGWWIXILLLQXIMCQRSEGCPFHAVWTLIG

SEQ ID NO: 31813 - DNA, 672 bp, Zea mays
  misc_feature: Ceres CLONE 1408273-F
  misc_feature (335)..(335): n is a, c, t, g, unknown, or other
  misc_feature (376)..(376): n is a, c, t, g, unknown, or other
  misc_feature (392)..(392): n is a, c, t, g, unknown, or other
tccccgcggtggcggccgctctagaactagtggatcccccgggctgcaggaattcgcacgagaccattacctagaacatcctaatcgaaaagagcagcagaccacgaccagcacgcccacttgcctgcgattactttgcgccagagggcagaggccttggccctgccatcgttgttcttatccccccttcctctttctttctcctccctcttgcggcttctctctggactcgcccctccctccgtctcgtctcccaggtcatggcaaagctggaacacccgtgaatatagcaagtgggagataaacaggaagagctagggtgaatactaaatacnagtagcagtagaagaaaaagagtcagtccgcccgtgactanagtgatttgttggggngggggggggtttttttggggtccccttttttgggggggggctttttggggggcccggggggggccccccccctgggggggcccgttttttgggggttttcctggggcccctctcggcgcccgggggccggggctctccgggttctctgttgcccggggcggcccccttgggggccccgggggggtttgggggggggggtttccccccggtggccgcccccggggggtttcccccccgccccgctgtgctgggctctcggggccggggtctctgctcggcg

SEQ ID NO: 31814 - DNA, 677 bp, Zea mays
  misc_feature: Ceres CLONE 1408276-F
  misc_feature: Translation starting site: 328
  misc_feature (334)..(334): n is a, c, t, g, unknown, or other
aaagctggagctccccgcggtgcggccgctctagaactagtggatcccccgggctgcaggaattcgcacgagaccattacctagaacattctaatcgaaaaagatctagggttctctcgtgctctgttctcatcttctgctcgctggtgtcccctctctctcacccatggcttcggcggcggcggcaactcaggtggggacttacttcctgcggaactactacaacctgctgcaacaaacccccgatgtcgtccaccagttctacagcgaagccagcaccatggtccgcgtcgacgacctcaccggcacgaccgcggctgcaacaacatgatgnacatacactcgctcatcatgtctttgaacttccaccaaattgaaatcaagactggcaatttttgtgactcatggggcgatggggtgctaagtatggtctctggtctagggcagaccaaggagtaccgccaccaaaggaaatttatccagatggtcttccttgcccctcaagagaagggtactttggcctcaacgattacttttcacttcgtgaccaagaacatgggcagcctgcgccagtgattgctcaagaagactacgagagcgattgggcacccaacacagtttgttgagaccgctcctgagtacgttcacgagggaagaagctcaccaatagcacctga

SEQ ID NO: 31815 - DNA, 667 bp, Zea mays
  misc_feature: Ceres CLONE 1408278-F
  misc_feature (303)..(303): n is a, c, t, g, unknown, or other
  misc_feature (376)..(376): n is a, c, t, g, unknown, or other
  misc_feature (413)..(413): n is a, c, t, g, unknown, or other
  misc_feature (414)..(414): n is a, c, t, g, unknown, or other
  misc_feature (446)..(446): n is a, c, t, g, unknown, or other
  misc_feature (447)..(447): n is a, c, t, g, unknown, or other
  misc_feature (456)..(456): n is a, c, t, g, unknown, or other
  misc_feature (475)..(475): n is a, c, t, g, unknown, or other
  misc_feature (497)..(497): n is a, c, t, g, unknown, or other
  misc_feature (500)..(500): n is a, c, t, g, unknown, or other
  misc_feature (586)..(586): n is a, c, t, g, unknown, or other
tccccgcggtggcggccgctctagaactagtggatcccccgggctgcaggaattcgcacgagaccattacctagaacatcctaatcgaaaagagcagcagaccacgaccagcacgcccacttgcctgcgattactttgcgccagagggcagaggccttggccctgccatcgttgttcttatccccccttcctctttctttctcctccctcttgcggcttctctctggactcgcccctccctccgtctcgtctcccaggtcatggcaaagctggaacacccgtgaatatagcaagtgggagatnaacaggaagagctagggtggatactaaatacaagtagcagtagaagaaaaagagtcagtccgcccgtgatacnagtgatttgtttggggggggggggttttgttgagggnnctttgattggaggggggtttggtggtggtttnnaaggggggncccccccttgggggtcccntttttcgggggttcccctggcngcnggacgggggaccagaacccggggtttccggtctcttatggcccggaaacgtcctccgggggaccagggggtgaaggggggaagatnattttctggggaacctgctccggggtaagttccggggccccgggggggatatacgcgaagtagttggtggtaggtgtacgg

SEQ ID NO: 31816 - DNA, 828 bp, Zea mays
  misc_feature: Ceres CLONE 1408279-F
  misc_feature: Encodes the peptide sequence at SEQ ID NO. 31817
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (21)..(21): n is a, c, t, g, unknown, or other
  misc_feature (22)..(22): n is a, c, t, g, unknown, or other
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
tgggggccccccnnnnnnccnnccccccccccgcntnntttcccnnnnnnnacaaaactggagctccccgcggtggcggccgctctagactagtggatcccccgggctgcaggaattcgcacgagaccattacctaaaacatcctaatcgaaaaacaccgccactcgcccacacgcgaaggcacctagcagccgccactcgccgaactgaggaacacgccgggcgacgggatacagcagcagcgcgcccctctatgcccgacgcgacggcgccctgcagctgcagataaacctgtcccaatgaccaaacaaaaaagagggttgcggacaaaagaactgctaggaagacgatccgatctacggaagggtgtgcaaagagcattaactttcgagaaggaaacaaacaaatcgagacgctgtgcaggcttcccgatcctgccgaagggacatccctagggcaaccatacctaatcccggggttgacatttccgaagaatccctcccacagaaggggccctggctttccccaaaaccctgggcggggggatcgggagaaaaaaggctgggtggcccgaaaaacctgggcccttcaaccaagtggcccccactgtgttccccaccccggggaaaatagggagagattccaaaccttcccagggcgcccaccttttgggccaggggagaagcgcaacgggtgttggctgggggggcggggttacacacatcccaccccacatcccttaaaaaaagttctgggaaaaaaacaatcccggggcggggggcaggcgaaaacccaccctcccccaaggcacaacagtagttgttactc

SEQ ID NO: 31817 - protein, 51 aa, Zea mays
  misc_feature: Ceres CLONE 1408279-F
MTKQKRGLRTKELLGRRSDLRKGVQRALTFEKETNKSRRCAGFPILPKGHP

SEQ ID NO: 31818 - DNA, 875 bp, Zea mays
  misc_feature: Ceres CLONE 1408281-F
  misc_feature: Encodes the peptide sequence at SEQ ID NO. 31819
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (46)..(46): n is a, c, t, g, unknown, or other
tggcccccccccnnnnnnnnntccccacccgccccgcctccgcccnttttcaaagctggagctccaccgcggtggcggccgctctagaactagtggatcccccgggctgcaggaattcgcacgagaccattacctagaacatcctaatcgaaaaacacagcaagccagcagagcagaaagcagccgcagccccagcccccacaagacgaggcaacaatggcgctagaagcagccaccgccccccgcgcactcctcgccgcgtgcctcgtcctgctggtcctcggcgggggcaccggcccgtcgtcggggcttgcgcggcgccggggcgcaggccggcgggcagtggctgccgcaactgacccgcctcctgcggtgccgcgcggaaccgggggcccgggcgcgccgtaccccaatggaggacttgttggaacgccgttgaagcgccgggcctgcacaaagtggcgccctggccccccccttggggcattcaatcaaaaaggcctggcccgggccgggtgtccccccttccccacccaaacccaacggggctcccgccttggaaaacaagggaacccggggaacccctctttgctgccaagtggggattgggcacaggtctcggggaaaacaggaactagggagaggcggtttcccatttcttcaccacatcacacaatacgattatcatgtttcccaaacgttttggcccatccgctcgcgctctcccccccttcttctctgggaattcctcaaaatctcttgtgcgtttggggggggcgataaatttttttcagttataatattgtttactgaagcaatttcgcgcccagagccggggtagacggagacccggacggacgccccaaacaagcctc

SEQ ID NO: 31819 - protein, 188 aa, Zea mays
  misc_feature: Ceres CLONE 1408281-F
MALEAATAPRALLAACLVLLVLGGGTGPSSGLARRRGAGRRAVAAATDPPPAVPRGTGGPGAPYPNGGLVGTPLKRRACTKWRPGPPLGAFNQKGLARAGCPPFPTQTQRGSRLGKQGNPGNPSLLPSGDWAQVSGKTGTRERRFPISSPHHTIRLSCFPNVLAHPLALSPPSSLGIPQNLLCVWGGR

SEQ ID NO: 31820 - DNA, 639 bp, Zea mays
  misc_feature: Ceres CLONE 1408283-F
  misc_feature: Encodes the peptide sequence at SEQ ID NO. 31821
  misc_feature (358)..(358): n is a, c, t, g, unknown, or other
  misc_feature (359)..(359): n is a, c, t, g, unknown, or other
  misc_feature (499)..(499): n is a, c, t, g, unknown, or other
  misc_feature (546)..(546): n is a, c, t, g, unknown, or other
aagctggagctcaccgcggtggcggccgctctagaactagtggatcccccgggctgcaggaattcgcacgagaccattacctagaacatcctaatcgaaaagacgggggcgtttctcgatctgacgctcgcctgggcctgcctctgcctcgccgcgctcgccgccgccgccgcgcgcctcctcgcgctcctcggtctcccgctcccctgcacctgtgcgcgcccgcacctgccctgcctcctcgccttcctggtgcgctaccctccccgcgccgtcggatcccttcacgccgccctccgcgcccgcttccccttcgccggccccaccgacgacgaggcacgccttcagaaaggggtgnnagaaaaaggggaggaggaggccatcgatgtgcggaaaggagaaggggattttcgtcgccgcgtggaagcgcgcgccgagctgcagatggagctcgagaaagagcgcagcgccgcggcgtcggcggccgaagaggccatgntcatgatcctgcgcctgcagaaagagaagtcggcgcttgagattgangcgcgacagcagcgccgaaccgctgacgagcgctgcgccctctacgaagacgaggtcgaggagctccgggacatcgtgctcgggggggagcgg

SEQ ID NO: 31821 - protein, 65 aa, Zea mays
  misc_feature: Ceres CLONE 1408283-F
  misc_feature (1)..(65): Pfam Name: DUF593 Pfam Description: Protein of unknown function, DUF593
  misc_feature (19)..(19): Xaa is any aa, unknown, or other
  misc_feature (34)..(34): Xaa is any aa, unknown, or other
MELEKERSAAASAAEEAMXMILRLQKEKSALEIXARQQRRTADERCALYEDEVEELRDIVLGGER

SEQ ID NO: 31822 - DNA, 726 bp, Zea mays
  misc_feature: Ceres CLONE 1408285-F
  misc_feature: Encodes the peptide sequence at SEQ ID NO. 31823
  misc_feature (385)..(385): n is a, c, t, g, unknown, or other
aaagctggagctccccgcggtggcggccgctctagaactagtggatcccccgggctgcaggaattcgcacgagaccattacctagaacatcctaatcaaaaaacgttgacggccaccccgcccacagccgcgacaaactcttcctcagacccacgccacgtacgatgcctctctccccttcccctccgcccaacgccgccgccgccgccgccctacccctcctcctgctgctcgtctgcgccagcagcattgccgcgcagccgctggcgtcgtcgcagggcaaggcgctcctcggggtgcgccgcctgctgttctacccgccgccgctcgagccgctgcgcggggcgccggacccctgcgcgctgccgcccgcgccggccctcgnagtcgcctgcgaggggcggccaggtcacggcgctctccctcctgggagaccgcgacccggaacccgccctggcggcgccgcgctggcggccagcttctcctccgagggcgctgttcaccacgctcaccagggtcccggcggttcgggggcctcttcgttcggacggcctccggggcctgggggccccgctcccgggggcccaaaactccgccggggtccaaggggctggaggaagctcaaccttcaagctccaactaacttttaacgggggcccgcccccgatggggcctccccccggctttatatttgggtggaaaaaaccctcagtgttgtcccgggaa

SEQ ID NO: 31823 - protein, 161 aa, Zea mays
  misc_feature: Ceres CLONE 1408285-F
  misc_feature (74)..(74): Xaa is any aa, unknown, or other
MPLSPSPPPNAAAAAALPLLLLLVCASSIAAQPLASSQGKALLGVRRLLFYPPPLEPLRGAPDPCALPPAPALXVACEGRPGHGALPPGRPRPGTRPGGAALAASFSSEGAVHHAHQGPGGSGASSFGRPPGPGGPAPGGPKLRRGPRGWRKLNLQAPTNF

SEQ ID NO: 31824 - DNA, 620 bp, Zea mays
  misc_feature: Ceres CLONE 1408288-F
  misc_feature: Encodes the peptide sequence at SEQ ID NO. 31825
  misc_feature (96)..(96): n is a, c, t, g, unknown, or other
tggagctccccgcggtggcggccgctctagaactagtggatcccccgggctgcaggaattcgcacgagaccattacctagaacatcctaatcgaanaacacacactaatcaacaagcaggaccagctagctagctcctcccactgctatcacccgggccccggccagccatctcgctgaaagagaaaagcgcagccatggagactactagctcgggcattgcagtcgtcctcctggtggcgatgctggcagtccagtccgcggtgggcgacatctcgtgttccgacgggttcacgaactggcggccgggctgccccttctggaggggaaaggaggccaacccagggagaggaacaacagtgttgcgaacgcgggagggccctgtaaccggcggggggaaacacggccccaagggagggacccgggccggtgccccagggggcctaaaattaggggccccctgggggtccccccgcgggaaaaagtttccccgcgaatggtgccctccccgggttttaaaaaaaaaccccccccaattttttggggggaaaaatgaatgggggggggtttttgtggcctttaccaaaaaaaaaataaagggggggggggttggtgtccctg

SEQ ID NO: 31825 - protein, 141 aa, Zea mays
  misc_feature: Ceres CLONE 1408288-F
METTSSGIAVVLLVAMLAVQSAVGDISCSDGFTNWRPGCPFWRGKEANPGRGTTVLRTREGPVTGGGKHGPKGGTRAGAPGGLKLGAPWGSPRGKKFPREWCPPRVLKKNPPQFFGGKNEWGGVFVAFTKKKIKGGGVGVP

SEQ ID NO: 31826 - DNA, 706 bp, Zea mays
  misc_feature: Ceres CLONE 1408289-F
  misc_feature: Encodes the peptide sequence at SEQ ID NO. 31827
  misc_feature (352)..(352): n is a, c, t, g, unknown, or other
  misc_feature (524)..(524): n is a, c, t, g, unknown, or other
  misc_feature (706)..(706): n is a, c, t, g, unknown, or other
aaagctggagctccccgcggtggcggccgctctagaactagtggatcccccgggctgcaggaattcgcacgagaccattacctagaacatcctaatcgaaaaaaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagcaaatggtttctggtgcgggtcatggtgggtacggcggcggcgacgacgggcaggccgtcgacttccggggcaacccggcggacaagtcgaggaccggaggctgnctgggcgccgggctgatcctgggcacggagctgccggagcgcgtgtgcctgatgggcatctccatgaccctggtgacgtacctcgtcggggaactgcacctctccactcccagtccgccaccggggtgaccaaactccatgggaacgctcaaactgctcgccctcgttgggnggtttcctcgccgacgccaagctcggccgctaccttaccatccgccatcttcgcccaaaattcgccgccacgggcgggaagcttgcctgacgggggaacacaacggtggccaaacattgcgctccccccgggggtgccttggaaccccccgggggccccccggccgaaaaaaattgtcttgn

SEQ ID NO: 31827 - protein, 76 aa, Zea mays
  misc_feature: Ceres CLONE 1408289-F
  misc_feature (34)..(34): Xaa is any aa, unknown, or other
MVSGAGHGGYGGGDDGQAVDFRGNPADKSRTGGXLGAGLILGTELPERVCLMGISMTLVTYLVGELHLSTPSPPPG

SEQ ID NO: 31828 - DNA, 676 bp, Zea mays
  misc_feature: Ceres CLONE 1408293-F
  misc_feature: Encodes the peptide sequence at SEQ ID NO. 31829
  misc_feature (267)..(267): n is a, c, t, g, unknown, or other
  misc_feature (506)..(506): n is a, c, t, g, unknown, or other
ggagctccccgcggtggcggccgctctagaactagtggatcccccgggctgcaggaattcgcacgagaccattcctagaacatcctaatcgaaaaccacctccaaagtccaaaagcgaagcctacgcccgccccaacggtgaaaacgtcggaaccctagatccctctcacggtcgcgcctgtgctccaaaaccttagatccgacatgcatcagcccagagcccgctacccacccgggtatggctccagcgggggaggcggtggcggnggaggcggtagtggagtaggaagaggaggcagcggcggcggaggaaaccacaactactacggccggaacacacatccacagcatcaacaccactaccagcagcagcagcagcactcgcataggaactcctcgcaccagcagcagtggctgcggcgagaccagggccccgccgttgcggggccagtgtctggaaacgctgtgcctaaaaccgcgcctcagcttgacgctgttgactcgangtctcaagaatggaaggctcaactaaatataccagttccagacacacgctacgggacagaggatgtcactgcaacaaaaggcaatgaggactgaggattatttctggaaacgtgagttgctaatgggattatttaagaagggatttgaaatgcccatctctattcaaaag

SEQ ID NO: 31829 - protein, 131 aa, Zea mays
  misc_feature: Ceres CLONE 1408293-F
  misc_feature (101)..(101): Xaa is any aa, unknown, or other
MHQPRARYPPGYGSSGGGGGGGGGSGVGRGGSGGGGNHNYYGRNTHPQHQHHYQQQQQHSHRNSSHQQQWLRRDQGPAVAGPVSGNAVPKTAPQLDAVDSXSQEWKAQLNIPVPDTRYGTEDVTATKGNED

SEQ ID NO: 31830 - DNA, 601 bp, Zea mays
  misc_feature: Ceres CLONE 1408294-F
  misc_feature: Encodes the peptide sequence at SEQ ID NO. 31831
aagctggagctccccgcggtggcggccgctctagaactagtggatcccccgggctgcaggaattcgcacgagaccattacctagaacatcctaaaaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgccctcttcgcgccccccgatcgcccgatccttcagggccaggtacagatgttccagtgtttaccaacagagtttctcgtacgtacgggccaatccttgacagtccagatccgggggtggtgtgggcccttgggatacaatgaagttgcccctgccctgatggaccctatttaacagcttgaagaacctggatccttctggcatggggacttggaaagtttttgcccctccatgggaaaaccggtttttttttgtttgggcccccccccccaggggccttcggaatccccataaaattggcccc

SEQ ID NO: 31831 - protein, 79 aa, Zea mays
  misc_feature: Ceres CLONE 1408294-F
MRRWWSPALAAVEPRSVQLLLLGVALVAASFYAGTLFGSSASPALVLPSSRPPIARSFRARYRCSSVYQQSFSYVRANP

SEQ ID NO: 31832 - DNA, 621 bp, Zea mays
  misc_feature: Ceres CLONE 1408295-F
  misc_feature (348)..(348): n is a, c, t, g, unknown, or other
  misc_feature (374)..(374): n is a, c, t, g, unknown, or other
ggagctccccgcggtggcggccgctctagaactagtggatcccccgggctgcaggaattcgcacgagaccattacctagaacatcctaatcgaaaaattacttactggtcctcactcccacaccaaccaaccaacctcctctgcctgccgcttctcctgctgcgggcggtcacggctgcaagtactagaggaggacatccgcttccattactgcgcctgcggaggatcggaggaaccagtagcggaggcttcgattttcggcgggcgcaataaatttccgcatggggctcggaagggccgcgtcctcgctcgtctcccgctgcttcctggggagggcccctggccggngcggccgcccgctgcccccctctggnctgggcaaggaaaagtgccctgcaaaagggaaaggccaaggttggttgccaagtgtccctcaaaaggttccccacctgccgccaacagtaaaaggaaccccatccccgcccgtaggccatggtggaacaaaacaaagccccccctttaaaggggaacttttttgtaattcccccaacccggaaaaaaccttccccaattccggacccccctaaaagagggaagagggattctcctcggggcttaaag

SEQ ID NO: 31833 - DNA, 757 bp, Zea mays
  misc_feature: Ceres CLONE 1408304-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (37)..(37): n is a, c, t, g, unknown, or other
  misc_feature (40)..(40): n is a, c, t, g, unknown, or other
  misc_feature (51)..(51): n is a, c, t, g, unknown, or other
  misc_feature (673)..(673): n is a, c, t, g, unknown, or other
  misc_feature (757)..(757): n is a, c, t, g, unknown, or other
nnnnnnnnnnnnnnnnnnncccccaccccgcccaagngangttttttcttncaaaactggagctccccgcggtggcggccgctctagaactagtggatcccccgggctgcaggaattcgcacgagaccattacctagaacatcctaatcgaaaaaaaatcaaatgattccttgcttgcccccctttccctccaaaattctcgctgaggacctcgtcttcctcctcttcttcttctgtaaagtgccaagtgccaactgcattctggcttacttggaacaccactccttgattccttcccattccaccagtctcatcttgcatagtgctagaacttatccatttgcttgctactgctcttgcccagcatgagcaaacggccgatgatgacaacgccggcgggcggagaagacggtgagccatccagcggcgctcgcggagccggtgcgccgccgccgtctcagccggtcggtaccggccgctacgcaagactgcagagcgccggcaccgggaccagtgccgccgacggcgaccggcccagacgtcatgtgacctatatggaaggccgcttttgaagccgacggagcagcccgccaaccgaatgaacggttacgggtgcccgggggaacactgcccccggcccccagaagggcgcaacgccaacagcccccagggnccgaaccctaccacccccttggatggtcgcaaaaaaggaagaaccaagaaagcccggacgaaattggaatagaagcgacacccn

SEQ ID NO: 31834 - DNA, 633 bp, Zea mays
  misc_feature: Ceres CLONE 1408305-F
  misc_feature: Translation starting site: 217
  misc_feature (359)..(359): n is a, c, t, g, unknown, or other
  misc_feature (384)..(384): n is a, c, t, g, unknown, or other
cgctctagaactagtggatcccccgggctgcaggaattcgcacgagaccattacctagaacatcctaatcgcaaacttcgtcgatcggtgtccctagcctccccctgcccggctgtcctcctcgatttcgcaagctcctggttacggcggcatctatcgttccgcctcaagggccgcatcgtctctctcgcgacgctgccccagaccgccgagataatggctggccaccgaaacagtcatggaaagcgccagtctgattttactgaaaatggaggcagtaagagaagaaatcctggcgatgatacatatgcacctggtcctgatgacactgtgtatcgctacctctgtgcctctagaanaattgggagtatcatttggcagggngtggagaatttgcaaagcagttgaggactgagacccaagctaagatcaggattgggcgagagtgtcccctggatgtgatggagcgagttgttaccatatttagcacaagcaggaaaactattaccatcgatggtgcttaaaagatgaggtttgcccctgctcaggatgccctcttttagagttcatgagaggcttgcccagtgtttgaggtccttggcaacgaaaaaacgcgaacaaatgtcccctccg

SEQ ID NO: 31835 - DNA, 644 bp, Zea mays
  misc_feature: Ceres CLONE 1408306-F
  misc_feature: Encodes the peptide sequence at SEQ ID NO. 31836
  misc_feature (378)..(378): n is a, c, t, g, unknown, or other
aagctggagctccccgcggtggcggccgctctagaactagtggatcccccgggctgcaggaattcgcacgagaccattacctagaacatcctaatcgaaaaccttcgcattaatggccgctctctccctatcccctttcgtctcgctctcggagtaggacactcgcccgcttccggcttaaccttcaagattctccctcctcctcctacttcttcccgcttgggcgggcgcggcaccttccggttctgggcctcctatatatatacgcgcgcgaccgtcccccttccatactccctagcatgctcggctcgcaccccggattgatcgagctcgcccgtcgccgcgatggattcggtgccttcccccctcctcttctanccggggccacgctgctcccggtccctgctgccgctttgacgcgctgcggaggccgtgcgccaggaacgccgccgccgccgggggggccgccgggtgggcgctccgcgcgctgctcactggggtcttccccgccgggggctcactcggccggaatcttcatggtgccttcatggggatggctacagaaagcggcatgttccccgggcttggggtcgaaacagttccgggaccatcttttccattggaggtgggtaagcccggctcaa

SEQ ID NO: 31836 - protein, 32 aa, Zea mays
  misc_feature: Ceres CLONE 1408306-F
MGMATESGMFPGLGVETVPGPSFPLEVGKPGS

SEQ ID NO: 31837 - DNA, 670 bp, Zea mays
  misc_feature: Ceres CLONE 1408307-F
  misc_feature (181)..(181): n is a, c, t, g, unknown, or other
  misc_feature (273)..(273): n is a, c, t, g, unknown, or other
  misc_feature (275)..(275): n is a, c, t, g, unknown, or other
  misc_feature (281)..(281): n is a, c, t, g, unknown, or other
  misc_feature (282)..(282): n is a, c, t, g, unknown, or other
  misc_feature (384)..(384): n is a, c, t, g, unknown, or other
aaagctggagctccccgcggtggcggccgctctagaactagtggatcccccgggctgcaggaattcgcacgagaccattacctagaacatcctaatcgaaaagcatcagcacagctccgccagcctcggccacggccagcctcgctcctcactcactcccccagccagcgttacaataggnaaggaggggagagcaacctagcggcagccacagcagcagcgtagctgtagccacagcagagcagcggcggctgcgttcagacgactactacntngtcggnntgtcctccctctccctcctgctcctcccccaattccaccccccctcaatataaacaaatccaaagcagcgaggaggtgaacaccgtcccccagggaacaggnaccgcgggggttgcaggctttccaccctgggggaagggtgcaaattcccgaaatccgggccccccccatgaccaaggggcccggggaaacccggccggaatccggggcacccgggtgcccccctggagggggagccaaaacaacccccccaagggagggcccgggcccccccatacccccccaaaattttccccgggcccagggccaaaggaaaaaaaaaccctccccaaagatttggaaaaaaaaagggggggctcaaggcgctttgaaaaaaaggccggttgga

SEQ ID NO: 31838 - DNA, 599 bp, Zea mays
  misc_feature: Ceres CLONE 1408309-F
  misc_feature: Encodes the peptide sequence at SEQ ID NO. 31839
  misc_feature (205)..(205): n is a, c, t, g, unknown, or other
  misc_feature (208)..(208): n is a, c, t, g, unknown, or other
  misc_feature (248)..(248): n is a, c, t, g, unknown, or other
  misc_feature (269)..(269): n is a, c, t, g, unknown, or other
  misc_feature (316)..(316): n is a, c, t, g, unknown, or other
ccgctctagaactagtggatcccccgggctgcaggaattcgcacgagaccattacctagaacatcctaatcaaaaaagctttcaaagcgttgggagagatggcagaggagacgcaaccagaggccgcagccgccgccgcgcccgccgcggccgaggtagtcgtgaccgaagctgcgccggcgggaggcggaggtgcctgcggcgncgnaagctgaagccgaggcccaggatgagaaagaaggtgacgnaggcgagctcaccgcgatgancccggggggtgggggaccggttcgttcaaggagggaagcaacctggntggaagactggccgacccggaaaaaaaggggtttcgaaaggttaaggaatttgatccttgtgcccctccccgcgggggagttcaaattggttcccccgcggcggggggccaaaggccaggaaaaaaaagggggggagaaccccaggcccggggacccccccaaaaaaacccccgggccccagggggggaaaccaaaggccccggggtttgggtttcccccccttttgaggaacaaaaaaaaaagggcccccccccccccagaggcccaggttttatatttttg

SEQ ID NO: 31839 - protein, 111 aa, Zea mays
  misc_feature: Ceres CLONE 1408309-F
  misc_feature (2)..(2): Xaa is any aa, unknown, or other
  misc_feature (18)..(18): Xaa is any aa, unknown, or other
MXPGGGGPVRSRREATWXEDWPTRKKRGFERLRNLILVPLPAGEFKLVPPRRGAKGQEKKGGENPRPGDPPKKTPGPQGGKPKAPGFGFPPLLRNKKKRAPPPPEAQVLYF

SEQ ID NO: 31840 - DNA, 657 bp, Zea mays
  misc_feature: Ceres CLONE 1408310-F
tggagctccccgcggtggcggccgctctagaactagtggatcccccgggctgcaggaattcgcacgtgaccattacctagaacatcctaatcgaaaagccacaacatcacgaaaggaccggatcttggtgagctcgagggtacatgacgcggttcttcctatcgcggcaggtgaccaggacctctatcccctccttgatggaggtcggggactgggatggaggccagggactcgacggcggtgggcctggaggtggcggcaaaggcctcggcgtcgacggccgcggcggtgcgcatttctcggctcgttcattcttgtgccctccttcgattacttcatttcgtcgcgtccccaatcggtcgatggaaaaatgaatctcgatggcttttggtaaatctggattgctatgcatgtctagcgatgcacttggatttttggtacagtgagattggtagccgcacatggggaatctcgatggcttttgttaaatctggattggtatgcatgtctaacgatccacttggatttctgggaccgggaaaatgggtaattgcaaatggaaaacaggggggccttaatggaaggtggaaacaaaaaaacctggaaaattgggggggggacaccttcctttcccctcttgggaagcttaaaaaatag

SEQ ID NO: 31841 - DNA, 652 bp, Zea mays
  misc_feature: Ceres CLONE 1408313-F
  misc_feature (206)..(206): n is a, c, t, g, unknown, or other
aaagtggagctccccgcggtggcggccgctctagaatagtggatcccccgggctgcaggaattcgcacgagaccattacctagaacatcctaatcgaaaaaacttagtcttatttcttattttgccagcaggaaaaaactttgcacgagtcggcgacactccatcccggaagagctaaagaggtgactccccaacgcggccatggntgaaggcagtattccttttccctcacaactttaagtccggtggggaaaaactctctggggaaggtcaaatgggagttaaaggtggttttctttttttctaaaagggccccctttttttttttttttgcccccaaaaaaaaggaaaaaaacttcttcgttttttggggggggggggtgttttttggggaaatgggaaaagaggttcccccgggggggtggagatttctttaaaggaatttgttggtttcttggaagctctcccccccaaatttttttcggggaaggtttttcccaaaaaaaaaacttgatggggggggggggaaaaaaaaccttttttaaaaaaaggtggggccccctccttttttttttttttgggtgtaaaaaaaaaggagggggcccaaaccgttttttgggggtttttttctcaaaaacaaaaaaaacttgtt

SEQ ID NO: 31842 - DNA, 649 bp, Zea mays
  misc_feature: Ceres CLONE 1408317-F
  misc_feature: Encodes the peptide sequence at SEQ ID NO. 31843
  misc_feature (492)..(492): n is a, c, t, g, unknown, or other
  misc_feature (539)..(539): n is a, c, t, g, unknown, or other
  misc_feature (590)..(590): n is a, c, t, g, unknown, or other
  misc_feature (591)..(591): n is a, c, t, g, unknown, or other
cttgaacaagtggatcccccgggctgcaggaattcgcacgagaccattacctagaacatcctaatcgaaaaatcacaggcctcccggcctcccgtgcgctattctctatcagcttacccagcacacagtacacactctaatctccacacgacccaatagatatacggggctgaaggatgaagcttagagcaaaagggatcggcctcctgcttctccttgtcttgcttgctctttgctccaccattgaagtcggcgaggcaagaagaggcaagcattggaggtcgtcgaggagctcaccgggctcatcccagctcaagaaagacaagggaaagaagagcagctccccgccggcagtacggcgcccaccggccaggtccgaagccaccggtcagctcgacaccaaagcctctggtgctgccaaggggaaatcatcagaatccttaccaaccaagcccaagtccaagcccgaatgcccctgacatccctcctatngcaagccctgccaaatggcagcaggcattccactcccgagcgcgggntccagaggttggggggaaagggtcagcagcagccatcacagccgccgcagnngacctccgaaaggtgcagaatattcaaggggggttgattttggacccaaggggtgaag

SEQ ID NO: 31843 - protein, 100 aa, Zea mays
  misc_feature: Ceres CLONE 1408317-F
MKLRAKGIGLLLLLVLLALCSTIEVGEARRGKHWRSSRSSPGSSQLKKDKGKKSSSPPAVRRPPARSEATGQLDTKASGAAKGKSSESLPTKPKSKPECP

SEQ ID NO: 31844 - DNA, 688 bp, Zea mays
  misc_feature: Ceres CLONE 1408320-F
  misc_feature: Translation starting site: 178
  misc_feature: SWISSPROT Homolog: EC 1.1.1.42 Isocitrate dehydrogenase (NADP(+))
  misc_feature (504)..(504): n is a, c, t, g, unknown, or other
  misc_feature (574)..(574): n is a, c, t, g, unknown, or other
  misc_feature (678)..(678): n is a, c, t, g, unknown, or other
ggagctccccgcggtggcggccgctctagaactagtggatcccccgggctgcaggaattcgcacgagaccattacctagaacatcctaatcgaaaaatctctcttcctccttccacaagcgccgccgcagccccttctcgatctttgaggcaaagctacgactccaccaccgctggcatggcgttcgagaagatcaaggtctccaacccaatcgtcgagatggacggtgatgagatgaccagagtattctggcagtctatcaaggacaagcttatctttccatttctggacctggacatcaagtactatgacttggggatactgcaccgtgacgcaactgatgacaaggtcacagtggaggctgcagaggctactctcaagtacaatgtggccattaagtgtgcgaccattactccagatgaaactagggttaaggagttcaatttgaagcacatgtggaagagcccaaatggcacaattaggaaacattataatggtactgtngtcagagaaccaatatatgcaaaaacgttccaagggcttgtcccagatggacgaaagccatctgcattgnaagtcatgcctttcgtgatcagtaccgagctactgatgcagttctgaaggggcctgggaagctgaagctagtttttgagggaaaagagaacagattgatctggnagtgtcaact

SEQ ID NO: 31845 - DNA, 644 bp, Zea mays
  misc_feature: Ceres CLONE 1408325-F
ggagctccccgcggtggcggccgctctagaatagtggatcccccgggctgcaggattcgcacgagaccattacctagaacatcctaatcgaaaaagtgtgagagctcgattcgttgccgtccacttgtctcacggcctgtcgccatctccttcctggttttttcatccgaccatccccggctcctccggccgtcggcgacgactccatcgagtcactcggccgcagcaaccggcgaccatgtaccgagcgcctccggctcgcgccctcaagagcatgggcaaatgctcaatgatgaagctgcattaggtgtgccagcacaagtgttgacagagtcttccgggcttgtggactgttgactgtgcgcgttcaatgaatacctcctcagatttcacacttccggagtgactattctcctcgctgcctgacatgtggaggctgcaaacaagagtcacacacttcccaatggtgtaaatagcctctgagcatctgcgggatcatctgtctgttggagttatgttgattgtggtctgatatgaagacctgaaacacagtgccagtcactggtgagacatggcctcacaacactgccacaggagtgagttgttgtgcgtgaattgaggaaatagtgcagtgcaaagatctg

SEQ ID NO: 31846 - DNA, 756 bp, Zea mays
  misc_feature: Ceres CLONE 1408326-F
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (428)..(428): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (455)..(455): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (464)..(464): n is a, c, t, g, unknown, or other
  misc_feature (465)..(465): n is a, c, t, g, unknown, or other
  misc_feature (468)..(468): n is a, c, t, g, unknown, or other
  misc_feature (469)..(469): n is a, c, t, g, unknown, or other
  misc_feature (473)..(473): n is a, c, t, g, unknown, or other
  misc_feature (476)..(476): n is a, c, t, g, unknown, or other
  misc_feature (480)..(480): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (513)..(513): n is a, c, t, g, unknown, or other
  misc_feature (542)..(542): n is a, c, t, g, unknown, or other
  misc_feature (549)..(549): n is a, c, t, g, unknown, or other
  misc_feature (566)..(566): n is a, c, t, g, unknown, or other
  misc_feature (579)..(579): n is a, c, t, g, unknown, or other
  misc_feature (593)..(593): n is a, c, t, g, unknown, or other
  misc_feature (594)..(594): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (609)..(609): n is a, c, t, g, unknown, or other
  misc_feature (629)..(629): n is a, c, t, g, unknown, or other
  misc_feature (654)..(654): n is a, c, t, g, unknown, or other
  misc_feature (656)..(656): n is a, c, t, g, unknown, or other
  misc_feature (672)..(672): n is a, c, t, g, unknown, or other
  misc_feature (688)..(688): n is a, c, t, g, unknown, or other
  misc_feature (694)..(694): n is a, c, t, g, unknown, or other
acaagctggagctccccgcggtggcggccgctctataactagtggatcccccgggctgcaggaattcgcacgagaccattacctagaacatcctaatcgaaaaaccgctctcccatcccacccaaatcgccgaccgataggagagaactcgagctgaggagagagagagcagcaggcggcggcgcggagtaacacgcgaaggggaatgcgcagcccgtgtgagcctctcgcccccgcgaaaccccaccgattctgattccgccggcgaaatcgggcgcctcgcggctcggccggctaagcggtggacggcggcgccgaggggttcgttcgatacggtgagggtgaggccgtgaggagcagcagccacggcgggggaatgtaaagtgaannnnnnnnnnntnnnngnnnnnnnnnngnnnnnnnnnntntnnnnnnnnnnnnnnnnntgnnnngtntnnnnnngnnttnnatgntgntggngggtnnngttggtgttgtggggaatgggggggntttggttttgggggggagggggggtgggnggggggngggttttgttgtatgangtgggggggggtnggtttttgggggannannnnnnggggtganggaataattggttttggggnaaaatgagaggttatggaggggggnanaaatggaatataaatntgggtggtaaaagggnaagggnttggtgaaggtgaattaagttgtatgtgaagtggagggattgaaattgttggaaaggatgat

SEQ ID NO: 31847 - DNA, 680 bp, Zea mays
  misc_feature: Ceres CLONE 1408330-F
  misc_feature: Encodes the peptide sequence at SEQ ID NO. 31848
  misc_feature (492)..(492): n is a, c, t, g, unknown, or other
  misc_feature (633)..(633): n is a, c, t, g, unknown, or other
aaagctggagctccccgcggtggcggccgctctagaactagtggatcccccgggctgcaggaattcgcacgagaccattacctagaacatcctaatcgaaaacctccccatcgcgtctgtccgctacccctccccgaccagatcgctacgagacgccgcgcgatccgacccaggccgacgccgacgacccctctcgccgccggcggccatggcgtacggcgaccgcgtcaccaccttcgaggactccgagaatgagagcgagtacggctatgtccgcaaggtctctggacctgtggttgtggctgatggaatgggtggtgctgccatgtatgaacttgttcgtgtcggacatgataacctcattggggaaattatccgtcttgagggcgattcagctacaatccaagtttatgaggaaacagctggactgatggttaatgaccctgtattgagaacaagaaagcctctttcagttgaatggggacctggaantcttggaacatttttgacggtatccagcgacctctaaaaccatcgctattagtcaggagatggtatattcctcgtggtgtttcagttcctgcctttgacaaagatgtattgtggggatttcagccacgaagctagggtgtngagatgtcatcaccaggtgagatctatacgctactgtttttgagacc

SEQ ID NO: 31848 - protein, 106 aa, Zea mays
  misc_feature: Ceres CLONE 1408330-F
  misc_feature (22)..(84): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (95)..(95): Xaa is any aa, unknown, or other
MAYGDRVTTFEDSENESEYGYVRKVSGPVVVADGMGGAAMYELVRVGHDNLIGEIIRLEGDSATIQVYEETAGLMVNDPVLRTRKPLSVEWGPGXLGTFLTVSSDL

SEQ ID NO: 31849 - DNA, 648 bp, Zea mays
  misc_feature: Ceres CLONE 1408332-F
  misc_feature: Encodes the peptide sequence at SEQ ID NO. 31850
  misc_feature (511)..(511): n is a, c, t, g, unknown, or other
  misc_feature (597)..(597): n is a, c, t, g, unknown, or other
  misc_feature (611)..(611): n is a, c, t, g, unknown, or other
  misc_feature (613)..(613): n is a, c, t, g, unknown, or other
ggagctccccgcggtggcggccgctctataatagtgtatcccccgtgctgcaggaattcgcacgagaccattacctagaacatcctaatcgaaaaatataccccggtctactatcaggttgtgcaaaatagggctcgggctgggggaaccgttctctgctgatataagatttcgcaaggagctcaacgtttcgctgtaaactatagctcaccgcacccatggctcgacactaaacaaactgctcataagccctgtgaagggaaggctccaatgaaacaacttgcaatcaagggtgcccgtaggtctgcacctacagctggaggagtagagaactctcaccgctaccgccctgaaactgatgctcttcgtgaaatccgcaagtatcataagagcactgacctgctcataaggaagcttccgttacaaaggcttgtcaggcagattgcccaggatttcaagactgatcttcgtttccagagccatgcggtgcttgcgctgcaggaggctgcgnaggcgtacctggtggttctattcgaggacactaatctgtgcgccatcatggcaagcgcgtgacatcatgcccaggacattcagtgnctaggaggatccgngngaaaggcctaaatctctattattgctactggaagg

SEQ ID NO: 31850 - protein, 100 aa, Zea mays
  misc_feature: Ceres CLONE 1408332-F
  misc_feature (41)..(101): Pfam Name: Histone Pfam Description: Core histone H2A/H2B/H3/H4
  misc_feature (81)..(81): Xaa is any aa, unknown, or other
MKQLAIKGARRSAPTAGGVENSHRYRPETDALREIRKYHKSTDLLIRKLPLQRLVRQIAQDFKTDLRFQSHAVLALQEAAXAYLVVLFEDTNLCAIMASA

SEQ ID NO: 31851 - DNA, 660 bp, Zea mays
  misc_feature: Ceres CLONE 1408333-F
  misc_feature: Encodes the peptide sequence at SEQ ID NO. 31852
tggagctccccgcggtggcggccgctctagaactagtggatcccccgggctgcaggaattcgcacgagaccattacctagaacatcctaatcgaaaaatcagacagacgcagactctctcacccgactcgtcagacgtcagccagcagttcgaaaccaaggattgatccaggagcttccggaaggcgaggcgcgcgcgcagcgtcgaggtgctggtgccggtgccgcccatggatcgggctcgcggatccgcgttcctgctcggcgtcctgctcgcaggatccttgttcgcgttttcagttgccaaagaggagaccaagaagctcgggaccgtgatcggtatcgatctcggtaccacctactcctgtgtcggtgtgtacaagaacgtgcatgccgagatcatcgcaaatgactagggaatgcgaatcacagcctcatggattgcctgcaccgatagcgagaggctcctcggcgaggctgttacgaagcatgctgtcgttcaccctgagaagaccatctttggagatcagagtccagtacaaaaaacagtgccggataacgtacatggaggggaccatgaatgcccatggccatcaaatgtttagggggatcccgggccaaagttcaagactctctagtgttggctagagaaaaggtcttc

SEQ ID NO: 31852 - protein, 61 aa, Zea mays
  misc_feature: Ceres CLONE 1408333-F
MDRARGSAFLLGVLLAGSLFAFSVAKEETKKLGTVIGIDLGTTYSCVGVYKNVHAEIIAND

SEQ ID NO: 31853 - DNA, 730 bp, Zea mays
  misc_feature: Ceres CLONE 1408334-F
  misc_feature: Encodes the peptide sequence at SEQ ID NO. 31854
  misc_feature (509)..(509): n is a, c, t, g, unknown, or other
cagagctggagctccccgcggtggcggccgctctagaactagtggatcccccgggctgcaggaattcgcacgagaccattacctagaacatcctaatcgaaaaagtttcgacagtcgtcgtcccctctactctcccggcttccgcagaatcccagcttctctggccctctcactccaaacatcgggctccaggccgtctcccgccaacccaaattcgcttcccgccgctccccattaaacccgcttgaaaggtcgcgccctcgagcagagcaacccctgaccacaaatccgatccgtagccgccgtgcctcgatttcgtctcttcccctctgctcgagtacgagcggctactcccggcggcggcggcggcggcggcgatgagcgcggtgagctcgaccatatcaaggagctgatcaagtggggaacagactacatcctcaaaaccttcaattcatctgctgacacgatagacaggattgtcgctcaggtgggtgtaggtgacacctctnaaggcagcagtcagcctaatgaccattactgctggatgagaccagaggacatcgactacaaaaggccagtcaccgagtgtcactcttgctcagatctagcgtctgaaatggctgctgccctggctgcagcttccatagtgttcaaggacagcaaaacctactccgacaagctcgtcaaaggcgcaaaagccctgtacaagttcggaaggctgcagcgcggg

SEQ ID NO: 31854 - protein, 62 aa, Zea mays
  misc_feature: Ceres CLONE 1408334-F
  misc_feature: SWISSPROT Homolog: EC 3.2.1.4 Cellulase
MRPEDIDYKRPVTECHSCSDLASEMAAALAAASIVFKDSKTYSDKLVKGAKALYKFGRLQRG

SEQ ID NO: 31855 - DNA, 744 bp, Zea mays
  misc_feature: Ceres CLONE 1408338-F
  misc_feature: Encodes the peptide sequence at SEQ ID NO. 31856
  misc_feature (719)..(719): n is a, c, t, g, unknown, or other
  misc_feature (744)..(744): n is a, c, t, g, unknown, or other
caaagctggagctccccgcggtggcggccgctctagaactagtggatcccccgggctgcaggaattcgcacgagaccattacctagaacatcctaatcgaaaaatcgaacccccgccaccaccagtccagcagcaccaggccagacaggcacacctcgaagaacaagagctggtcctcctggtaataagcgagagagagagagaggccaatggcagccaagtggtggctcgtcgcctccctgctgctctgcctcgccgtcgcatcggcggcgggaagagcaacgccccgcgactgcgacactactgccgccttcgcggcgggcgacggcagtgccggcgccgtggacgaggacgacgagcaggccaagacccgccgacgtgtttcggtggccggacccgggggcggcggccctcttcgggggggtccacgggcccgttgggcgggcgggggtcctttggttccgccccctttcgggggggcccgtcccccggggcgggccccgtttccggggggttcggaaggggcggcgcccctcggggggggggggaggagcaccccccgctaacaccccttgtcctcgcttagcggcgccctggcgcggaggcgcacgggggcgccggcgcccctccccgccgctgccttcctcgctgcctcccccactacgccccgccctctcccggtcccgacgaccggccccgcgtccgggctcccgtccgcntacgctcccacgccgccgcgcggcn

SEQ ID NO: 31856 - protein, 118 aa, Zea mays
  misc_feature: Ceres CLONE 1408338-F
MAAKWWLVASLLLCLAVASAAGRATPRDCDTTAAFAAGDGSAGAVDEDDEQAKTRRRVSVAGPGGGGPLRGGPRARWAGGGPLVPPPFGGARPPGRAPFPGGSEGAAPLGGGGRSTPR

SEQ ID NO: 31857 - DNA, 729 bp, Zea mays
  misc_feature: Ceres CLONE 1408342-F
  misc_feature: Translation starting site: 237
  misc_feature (599)..(599): n is a, c, t, g, unknown, or other
aaaagttgagctcaccgcggtggcggccgcttcaaaactagtggatcccccgggctgcaggaattcgcacgagaccattacctagaacatcctaatcgaaaaacacatctgtcaccgtgaaatctcggctacctccttctgacttctggtacctcgccgccggggacccaactccgatccccacccccaccataaccaaagccaccgcggctgcggctgcggcttccgcatcatcaatggtgctgatcactctcgtccgcgactacttcgaccgcatggctccacgacattcccttggcattgaaggtcctcgtccttcgacccccaaaccgttgggaatggtgagcgtggtgtacagccagtcggatcttgctgcggaaggaggtctttcctcgtcgaagaccattggacaacgcctccagctccagggagtccattggcgcacctcaaggccgtctaactttcctccgaccctccgcttaacaacgtccagaaagcttccgcaggcaccttcgccattgccgcgctttcgccgagtaccaccttttcttctccagtatatttgaaggtcccgcagattcaaatacttgctgactcgngatgaacaggaggttgtgcagcaaagttcaggagttctattgctgattttttgtgccattgacccataccattttcactctcaacatacaaaataaccacatgtatattgctccccaacagtggtcgacc

SEQ ID NO: 31858 - DNA, 724 bp, Zea mays
  misc_feature: Ceres CLONE 1408345-F
  misc_feature: Encodes the peptide sequence at SEQ ID NO. 31859
  misc_feature (320)..(320): n is a, c, t, g, unknown, or other
  misc_feature (323)..(323): n is a, c, t, g, unknown, or other
  misc_feature (432)..(432): n is a, c, t, g, unknown, or other
aaagctggagctccccgcggtggcggccgctctagaactagtggatcccccgggctgcaggaattcgcacgagaccattacctagaacatcctaatcgaaaaatccccgttccccaacccccaaagccgagagccatcccgcccgcagccgcaaccaggcaagcaagcgggagccgccaactcgtgcctctcggcagcggcgtctgaactctgaaccgaccgaccgaccgaccgttccgttccgttcaccccaccatggaggcgccgccgggaccggggcccatggagctggacgccccacctcccgccgccgccgccgnggngattcctcccgccggcagcgacaagcacaaggacggggaagggggagacgctgtgacggggcatatcatctccaccaccatcggcgggaagaacggcgagcccaagcgnaccatcagttacatggcagaacgtgtcgtgggcacaggctcatttgggatcgtcttccaggctaagtggctggaaaccggagagaccttcgccatcaaagaaggtgctgcaagatccggctttacaagaacccgggagctgcaactttatggggggccatgggaacaccccaaccgtcatcttgcctgaagaactggtttttttctccaacacggagcaggggaacaatttgtgttttaaacacctggccgatggaaattcccccccctggaaacttctatataccggggcg

SEQ ID NO: 31859 - protein, 121 aa, Zea mays
  misc_feature: Ceres CLONE 1408345-F
  misc_feature: SWISSPROT Homolog: EC 2.7.11.1 Non-specific serine/threonine protein kinase
  misc_feature (22)..(22): Xaa is any aa, unknown, or other
  misc_feature (23)..(23): Xaa is any aa, unknown, or other
MEAPPGPGPMELDAPPPAAAAXXIPPAGSDKHKDGEGGDAVTGHIISTTIGGKNGEPKRTISYMAERVVGTGSFGIVFQAKWLETGETFAIKEGAARSGFTRTRELQLYGGPWEHPNRHLA

SEQ ID NO: 31860 - DNA, 708 bp, Zea mays
  misc_feature: Ceres CLONE 1408346-F
  misc_feature (458)..(458): n is a, c, t, g, unknown, or other
  misc_feature (560)..(560): n is a, c, t, g, unknown, or other
caaagctggagctccaccgcggtggcggccgctctatatactagtgtatcccccggtgtgcaagtaattcgcacgataccattacctaaaacatcctaatctaaaaattaaacataaccatacgcacaacgaaatccgaagttattaataaccacatcaatcctttagatgaggttagatactgcacgacggcgggcggcgttgtgtgttactagctcataagagcgggccagggcactcgaaggagatctcgcagccctccaccggcgtgagcgtgatgacgtgcctgaccgagatcatgaaagaaggcaggcgcgcggcggcctggcagacgcacgagttgtcgaggcccatgagcctgcggcagcacgccgtgtcgcgcgggtcctcgccctccccgtcctcgctgcgccggcgctggtgccggcgccgggaccgcctcccgccgtggctgtcgncgtcgtcatcgctccgggactgcagcacctgactgacagtgctggcggtggtgggcgtcgacggcgacgtcgtctcgttgagctgctgctgccgcaggaggnccccgcgcctcacccccgccccggtctctctcctcagctgcgtccggcaccctcgatcaccttgagtcgccgcctttcgcgcgtccggctgcccggaacccctcctcctatccatgggatcgattcggacgaaggtagaaaaggacca

SEQ ID NO: 31861 - DNA, 714 bp, Zea mays
  misc_feature: Ceres CLONE 1408350-F
  misc_feature: Encodes the peptide sequence at SEQ ID NO. 31862
aaagctggagctccccgcggtggcggccgctctagaactagtggatcccccgggctgcaggaattcgcacgagaccattacctagaacatcctaatcgaaaaaaaaaaaaataaaaatcgcagccaaaacacgcttctcccttcccatcttttcctttcccctcctccctcctcggctcgtctctgttcccctttccctcctgcgcacccgtcttctcctccccgcgtcaaaccccagcacaaaaagctaccgcccgccgcctcctcgttcctctcccgaatcagccgtcgcggtgcctaatccggccgatcccccctccgatccgcgggtgcccgccgcagaggcggcgcctccgggcctcccccgatgtatagcaacttcaaggagcaggcgatcgagtacgtcaagcaggcggtccaggaggacaatgccggcaactacgtcaaggcgttccctctctacatgaacgcgctcgagtacttcaaaacccacctcaagtacgagaagaaccccaagatcaaggaggccatcaccgccaagttcaccgagtacctccgccgcgccgaggagatccgggcggtcctcgatgagggcggcgcagggcctggggccaacggtggcgacgcagctgtcgccacgcgccccaagaccaagggcaaggacggggacggaggcaacggaggggatgactccgagcagtccaagctgagggc

SEQ ID NO: 31862 - protein, 115 aa, Zea mays
  misc_feature: Ceres CLONE 1408350-F
  misc_feature (5)..(73): Pfam Name: MIT Pfam Description: MIT (microtubule interacting and transport) domain
  misc_feature: SWISSPROT Homolog: EC 2.7.11.1 Non-specific serine/threonine protein kinase
MYSNFKEQAIEYVKQAVQEDNAGNYVKAFPLYMNALEYFKTHLKYEKNPKIKEAITAKFTEYLRRAEEIRAVLDEGGAGPGANGGDAAVATRPKTKGKDGDGGNGGDDSEQSKLR

SEQ ID NO: 31863 - DNA, 645 bp, Zea mays
  misc_feature: Ceres CLONE 1408353-F
aagctggagctccccgcggtggcggccgctctagaactagtggatcccccgggctgcaggaattcgcacgagaccattacctagaacatcctaatcaaaaaattccaatcaatcggaccgacaccggctaaccctagcttctgtttggctgttgccttgcgggtggcggctgctttggtgcgctgcgcagtgcgctccgtccgtccgtcgaccggaaggccgtcccctggcccctgctcgtcgtcttcctcgggcgctcgtcttcctccgaacgcgcgcgggccgccgacctgcttgttctcctggaggagcgcgcccggcgggcaggcgacgcagtccagcggcgggttgaggaagaagcgagcgaccggtggatccccgtccagccgtcccctgctcctcttcctcgggtcgggcgctcgtcatccactcttcctccagccctccatctgatccccgtacgaccgtcccctgctcgtcttccctggtgcctcggtgctccagtgctcggcccctactgcagtgctgctccgtcgcgtcggcacctgctgcagatctgctcgacctcggctgctcggctcctgggaaactggttccctgctgaaggctgattctaaagtctgctgccgacgtttaggagatccg

SEQ ID NO: 31864 - DNA, 835 bp, Zea mays
  misc_feature: Ceres CLONE 1408355-F
  misc_feature: Encodes the peptide sequence at SEQ ID NO. 31865
  misc_feature (1)..(1): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (790)..(790): n is a, c, t, g, unknown, or other
  misc_feature (835)..(835): n is a, c, t, g, unknown, or other
nccccccccccccncnnnnccaccacccccnnnnntgtggannttttcaaagctggagctccaccgcggtggcggccgctctagaactagtggatcccccgggctgcaggaattcgcacgagaccattacctaaacatcctaatcgaaaaaccaacccttgtagtctcagtcaatctgtagattgagactacgatgagcctgtcaccgctcgactcctcctccccgccggccgcggctgcggctgctgctacggaggtgcccctcgccccgggcttccgcttccaccccacccgacgagggagctcgtctcctactacctccgccgccgcgtcctcggccgccgcctccgcgtcgacgccatcgccgagatcgacctctaccgccctcgagccctggggaccttcccctccctctcccgcaatcccgcagccgcgaacgcccagtgggtactttcttcccccccgtctcgaaccggcaaggtcccccggcgcctggccgcccggggggccgggggcgggtcccccggaaaacaggaaccaaaccggggttaacgccggagggggggtaacctgggaaagaccccgggggcaagggacccgcggagggtgcacccacccgggaggaaaggcccggggggggaatggaagaaaaaacggttctggttctttccagccccgggggaggggcgcccataagggcgaaaagggacccaactggggttcatggcccaaattacacggcctcccttcgatgggaaaccggacccctcagggattcgggaagtggggntttttgaaaaatccctccccaaaagacctgggggtgtggaacccn

SEQ ID NO: 31865 - protein, 28 aa, Zea mays
  misc_feature: Ceres CLONE 1408355-F
MGNRTPQGFGKWGFLKNPSPKDLGVWNP

SEQ ID NO: 31866 - DNA, 722 bp, Zea mays
  misc_feature: Ceres CLONE 1408356-F
  misc_feature: Encodes the peptide sequence at SEQ ID NO. 31867
  misc_feature (422)..(422): n is a, c, t, g, unknown, or other
  misc_feature (525)..(525): n is a, c, t, g, unknown, or other
  misc_feature (597)..(597): n is a, c, t, g, unknown, or other
caaagctggagctccccgcggtggcggccgctctagaactagtggatcccccgggctgcaggaattcgcacgagaccattacctagaaatcctaatcgaaaaaccttgtctaaagggttttccgctgtcttatcccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgcctcgccgctcgcgggcggcgccccgtcgtacaacagcgtgccaccgccccccgatgagatccagctcgcgaagcagcgcgcgcaggagatcgcggcgcggatctttaacgccgcagaggccaagcgtcctcgcgtcgacnacggcgacgatgacagcggcggcttcggtgtaggcctgggcagcactgggtggcggtggccgcatcgggcggcggaggacttcgcttctcgtcctctggcggntgggtgggcacgggggcttctatcccaacattatcttctcagagcagcgcacctcagaactcttcttatggngggaaatccgggtacaagcaaaaaaatggaattccaagggggaggggttggggttatcatttgaaaagccggggaaactttttagggtattcccctttcatccggggcaaaatttcaggtcccaa

SEQ ID NO: 31867 - protein, 156 aa, Zea mays
  misc_feature: Ceres CLONE 1408356-F
  misc_feature (78)..(78): Xaa is any aa, unknown, or other
  misc_feature (112)..(112): Xaa is any aa, unknown, or other
  misc_feature (136)..(136): Xaa is any aa, unknown, or other
MADDHYSSKRKYDDPSPPPRRTGFSSGPPPASPLAGGAPSYNSVPPPPDEIQLAKQRAQEIAARIFNAAEAKRPRVDXGDDDSGGFGVGLGSTGWRWPHRAAEDFASRPLAXGWARGLLSQHYLLRAAHLRTLLMXGNPGTSKKMEFQGGGVGVII

SEQ ID NO: 31868 - DNA, 715 bp, Zea mays
  misc_feature: Ceres CLONE 1408358-F
  misc_feature: Encodes the peptide sequence at SEQ ID NO. 31869
  misc_feature (540)..(540): n is a, c, t, g, unknown, or other
cagagctggagctccccgcggtggcggccgctctagaactagtggatcccccgggctgcaggaattcgcacgagaccattacctagaacatcctaatcaaaaaacccaaaatcctacgcagagacatgagtggcggcggcggcggcggcggggaggaccggatcagcatcctcccggacggcgttatcggcgagatcgtcacccgccttcccaccgccgatgccgtccgcgttcaggtcctctctcgccgttggcggcacatatggatctcctgtccgttgaacctcgatctcggttccccaaactactacaccgactacaagcgcgtcgtgtccggaatcctcgcggcccaccctggcccctgccgccgcctcaaagttgactggccgtacgacgacggcgagtcgtacaaccactggctccagtctccccgccttggtcggtcttcaggagctcgggatcgagccagagtactcttccttgtggctagacaagaaacactggcgcggggagacacacgagagcactgccagagggggncattattccagttcgctcccccgttggggctcctaagggattgctaaccatccttccccctttggcgggggccgggggggggctcccgggggccaacccccggggtacttccgttttgggggggggggaacttcccggaaaccccccccccccgggggggtcccccccccccccg

SEQ ID NO: 31869 - protein, 153 aa, Zea mays
  misc_feature: Ceres CLONE 1408358-F
  misc_feature (11)..(58): Pfam Name: F-box Pfam Description: F-box domain
  misc_feature (139)..(139): Xaa is any aa, unknown, or other
MSGGGGGGGEDRISILPDGVIGEIVTRLPTADAVRVQVLSRRWRHIWISCPLNLDLGSPNYYTDYKRVVSGILAAHPGPCRRLKVDWPYDDGESYNHWLQSPRLGRSSGARDRARVLFLVARQETLARGDTREHCQRGXLFQFAPPLGLLRDC

SEQ ID NO: 31870 - DNA, 734 bp, Zea mays
  misc_feature: Ceres CLONE 1408359-F
  misc_feature: Encodes the peptide sequence at SEQ ID NO. 31871
aaagctggagctcaccgcggtggcggccgctctagaactagtggatcccccgggctgcaggaattcgcacgagaccattacctaacatcctaatcgaaaaatccatcaaagtcacagagacgaccagctgaagcgaacacagagctgctcgccgtgtaacgcagcaggcagcagcacccagaggcgggaggtcacacacacagcacacgcagatcttcgatcaccaccatgggttctctcggcagcgccgcgcagcagcagcagcaaccgcacgccgtgtgcctgccgtacccagggcaggggcacatcaccccgatgctcaacgtggcgaagctggtgcacgcccggggcttccccgtcaccttcttcaacaccgagaaaaacaagggccgcctcctccggacccggggggagggggccggggccgggctccccgggtttccgtttccccaccatcccccaacggccttgccgccctcgggaggaacaacgaacgtcccggaaggaaatcccccctcccttggggcaagtccacccaggggagacctgccctcgattctctttcccccggcttggttcggggaaactcacaagaacccccccggaaaacctgggggcgctcctccaaacccgggtaggggggtttcccccatccgagcgccccccaaggggaggttcggcccttcccctaaaggtcaagtctttggggacgcccaaacaaacaataaagcttt

SEQ ID NO: 31871 - protein, 168 aa, Zea mays
  misc_feature: Ceres CLONE 1408359-F
  misc_feature: SWISSPROT Homolog: EC 2.4.1.121 Indole-3-acetate beta-glucosyltransferase
MGSLGSAAQQQQQPHAVCLPYPGQGHITPMLNVAKLVHARGFPVTFFNTEKNKGRLLRTRGEGAGAGLPGFPFPHHPPTALPPSGGTTNVPEGNPPSLGASPPRGDLPSILFPPAWFGETHKNPPGKPGGAPPNPGRGVSPIRAPPKGRFGPSPKGQVFGDAQTNNKA

SEQ ID NO: 31872 - DNA, 879 bp, Zea mays
  misc_feature: Ceres CLONE 1408362-R
  misc_feature: SWISSPROT Homolog: EC 3.1.1.11 Pectinesterase
  misc_feature (827)..(827): n is a, c, t, g, unknown, or other
gatttggaacggggccccccctccaggtcgacggtatcgataagcttttttttttttttttttaattaattatatattgataccgtatcaatacatataaataatacaccgaatcataacaagcacgtgtacatatatatgggacggttaaattaaataaatatattggcctgcgtccccaagcacaaaataatcaactacagtaacacgaccggatcgatacggtgctttttttagctctgattgaaatgaacgaacgtatgaacgacgaacttccgccgccaatttggtttattgccttccctttgccgtgaaacccctcgtacgtagcacacgacggccgcgcgctcacaagccggtggtgaaggggatggacgtgccggcgagccagaggtcgccgtcaatgaagttgccaacggtgaaggcgctggcctccgcggccgctggtgatgacgcggtaccccttccacttgacccgcccggacgtgccggcgccgggccccgtgttcaatgtaccccccctaaaagagcgtgttcaaccccgaaaattcccttcccacttcaagcagcccggcggggtcaaccaactaattcaggctccgacttgcaggtacaccctggggggaatactgcttcccatggggcggcccaagttaggtcttgggggaaagagatacttgggcggggactttggagggcgggtactatgtggcggggtgtgtttagagggctgtattccgggtcaagtagtaaaaaattacacgagatatggaaaaggtattcattcatagtctaattgcgggagaaaaaattgcaaggatgtaaangtgagcgataatcaccacgttgatcatattttgtcatcgagtgtgaaccacg

SEQ ID NO: 31873 - DNA, 730 bp, Zea mays
  misc_feature: Ceres CLONE 1408363-F
  misc_feature (341)..(341): n is a, c, t, g, unknown, or other
  misc_feature (353)..(353): n is a, c, t, g, unknown, or other
  misc_feature (368)..(368): n is a, c, t, g, unknown, or other
  misc_feature (389)..(389): n is a, c, t, g, unknown, or other
aaagctggagctccccgcggtggcggccgctctagaactagtggatcccccgggctgcaggaattcgcacgagaccattacctagaacatcctaatcgaaaagaatcgttattatcagtgggctagaacatactaatgcgagtgctgtgctgctaaatctaatctgcgtgcgattggtcgatgggcaggttcggtggagatcgccgccgttggcgtttcgatcgccatatttaaccaagtctccaaggtctgcatctaccctctcgttagcgtcacaacgtcgttcgtcgcggaggaagacgcgatcatcagtaagggcgtccccgagaacagcagccagnagggagacgtgnagaaagctcccacgntggctttgatccgagaccagncatctgcatgcatctggccctgcaggtatggcagaatgcgtgaactcgtgtatccctacggagtgcgcagcagatccctctggcaggcaaagggcggtgcgagaagaagtacgtggccgtcgttcccgtcggcgctaatagccggttccattcctcggcctggttcagggccggcttcctgggccctttcggccaaattcggggtccaacatcatggggtggtaaacccgggatcccccatggaagaggcccggggggggcgctacctaacgaaaaggggcccttggggcccccccttggtgtttttttccttggcacaagaaaggggttttccccggggg

SEQ ID NO: 31874 - DNA, 755 bp, Zea mays
  misc_feature: Ceres CLONE 1408364-F
  misc_feature: Encodes the peptide sequence at SEQ ID NO. 31875
  misc_feature (13)..(13): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (27)..(27): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (755)..(755): n is a, c, t, g, unknown, or other
tcccccccccccncccctnnngtgttntttttnnnnnttaccnnnnccaaagctggactccaccgcggtggcggccgctctagaactagtggatcccccgggctgcaggaattcgcacgagaccattacctagaacatcctaatcgaaaactactgtccggggaacccagcccagcccccgagccccacaccacacacagggttgcccacccacgccacgcacgcgcagccgcggcggaagccacccacccgggggtgggctccgatgggttgctgcggctcctcgcagcgggcggggacgcacccggagaagaagccgccgggggcgctccccccgcaccgtccctcctactcgctcaaccagcaccaggcgccgccgccgccgcctccctccgcggctcgcgccggcgcccgccaggtgccgccgctcaaggagttctcgctcgcggagctgcgcgcccccacggccggcttcgcggcggggaacatcgtgtcggagagcggcgagagggcgcccaatttcgtgtacgggggccgcctcaaggccggccgccgcgcgatcgccgtcaagaagttcaccaagatgggggggccccgatccccaccagttccccggaggaggccaagggggccgggaaagttgcccccactgccgccctggacaaaccttcatccggctattggttgcgaacggggaaaaaacgccctggctccgtccgccgagtttccatgggccaacggaaaaagcttccgcn

SEQ ID NO: 31875 - protein, 163 aa, Zea mays
  misc_feature: Ceres CLONE 1408364-F
MGCCGSSQRAGTHPEKKPPGALPPHRPSYSLNQHQAPPPPPPSAARAGARQVPPLKEFSLAELRAPTAGFAAGNIVSESGERAPNFVYGGRLKAGRRAIAVKKFTKMGGPRSPPVPRRRPRGPGKLPPLPPWTNLHPAIGCERGKNALAPSAEFPWANGKSFR

SEQ ID NO: 31876 - DNA, 661 bp, Zea mays
  misc_feature: Ceres CLONE 1408368-F
  misc_feature: Encodes the peptide sequence at SEQ ID NO. 31877
  misc_feature (366)..(366): n is a, c, t, g, unknown, or other
  misc_feature (516)..(516): n is a, c, t, g, unknown, or other
  misc_feature (518)..(518): n is a, c, t, g, unknown, or other
  misc_feature (527)..(527): n is a, c, t, g, unknown, or other
  misc_feature (535)..(535): n is a, c, t, g, unknown, or other
  misc_feature (539)..(539): n is a, c, t, g, unknown, or other
  misc_feature (580)..(580): n is a, c, t, g, unknown, or other
  misc_feature (653)..(653): n is a, c, t, g, unknown, or other
  misc_feature (659)..(659): n is a, c, t, g, unknown, or other
  misc_feature (661)..(661): n is a, c, t, g, unknown, or other
tccccgcggtggcggccgctctagaactagtggatcccccgggctgcaggaattcgcacgagaccattacctagaacatcctaatcgaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcntgttccgcgggccgtggctcgcccgcgcggacttcctgctgacgtgcgacccggcggccgtccagcactgcctggcgtccaaccacgggggctacgacaggggccgagacttttgcggagatgttcgacctcctgggcgacgggctgctngnttgcgacgncccccggntccntgggcgcgtccagcggcacggtcgccgccaccgtctcgggnaaccccggggggtttccgggtccttcgtcctgtgccaccatggcgcgcaagaaacggcgcgggctggcctcgntgcggntn

SEQ ID NO: 31877 - protein, 171 aa, Zea mays
  misc_feature: Ceres CLONE 1408368-F
  misc_feature (74)..(74): Xaa is any aa, unknown, or other
  misc_feature (124)..(124): Xaa is any aa, unknown, or other
  misc_feature (130)..(130): Xaa is any aa, unknown, or other
  misc_feature (145)..(145): Xaa is any aa, unknown, or other
MGALRSLAISYPEFLVAGLCFVSLSALRHAMRERRQRAPLSWPVVGMLPFVLANLGRLYDAITDALHGSGCTLXFRGPWLARADFLLTCDPAAVQHCLASNHGGYDRGRDFCGDVRPPGRRAAXLRRPPXPWARPAARSPPPSRXTPGGFRVLRPVPPWRARNGAGWPRCG

SEQ ID NO: 31878 - DNA, 707 bp, Zea mays
  misc_feature: Ceres CLONE 1408382-F
  misc_feature: Encodes the peptide sequence at SEQ ID NO. 31879
caaagctggagctccccgcggtggcggccgctctattcctagtggatcccccgggctgcaggaattcgcacgagaccattacctagaacatcctaatcgaaaacctttcgggcagaaagagccagagagagagagagagagaggtcggggctggggagcacacacccatcacccatggcctgactgacctccggactctccctgcttccgtcgccgccgcgggccgcccagctgactgctcctgccctccgcccgccctccatggcgtccgtcaagctcggctccaagcctgacgccttcaagcggcaaggccaggcatggttctgcacaacaggacttcctagcgatgtcaccgttgaggttggggatatgtctttccaccttcacaagttccctttactttcaaaaagtgcctttcttgaacggtcaattgaagaaaattctgaccaagaagaatgcatcatcaaactaaatgacattcctgggggtgccaagtcatttgagctagttgcaaggttctgctatggtgtgaaaatagagctttcacctgcaaatgttgtctacctacggtgtgcctcagagcatctagaaatgactgaagaagtagctgaggaaaacctgattgcacagtcagaaatgttcctcaaccaagtggttctccgtaactggaaagattccttggcagcattgggaacatgtgatgaccc

SEQ ID NO: 31879 - protein, 148 aa, Zea mays
  misc_feature: Ceres CLONE 1408382-F
  misc_feature (23)..(124): Pfam Name: BTB Pfam Description: BTB/POZ domain
MASVKLGSKPDAFKRQGQAWFCTTGLPSDVTVEVGDMSFHLHKFPLLSKSAFLERSIEENSDQEECIIKLNDIPGGAKSFELVARFCYGVKIELSPANVVYLRCASEHLEMTEEVAEENLIAQSEMFLNQVVLRNWKDSLAALGTCDD

SEQ ID NO: 31880 - DNA, 709 bp, Zea mays
  misc_feature: Ceres CLONE 1408399-F
  misc_feature: Encodes the peptide sequence at SEQ ID NO. 31881
  misc_feature (388)..(388): n is a, c, t, g, unknown, or other
  misc_feature (469)..(469): n is a, c, t, g, unknown, or other
  misc_feature (623)..(623): n is a, c, t, g, unknown, or other
  misc_feature (634)..(634): n is a, c, t, g, unknown, or other
  misc_feature (643)..(643): n is a, c, t, g, unknown, or other
caaagctggagctccccgcggtggcggccgctctagaactagtggatcccccgggctgcaggaattcgcacgagaccattacctagaacatcctaatcgaaaaacactacaatacttgctgcgcgctagcggtagcgctcgcgctcccacttcgcaccacagcacgccaccgctgctgccggctcctccccgcgctcgcattgcgatttgcgacctagcgcgagggtaccgggggtggtgcgcgtgctccgtgatccgggaagcgccgcgagatggccgggggcggaaggcggcggtgccgcgccgaagcacgacgacttcacgccgcaccccgtcaaggaccagctccctggggtctcctactgcatcaccagccctcccccgtggnctgaagccgttcttcttgggttccaacattatctggtcatgcttggtaccactgtgatcataccaactgcacttggtccancaatgggaggaaaccatgaagaccaagcagtggttattcagaattggctggtcgttgcaagtattcacaaccttctgcagaggttctttggtaccatggtggcctgcaggattcgcgggtcatacaccttttgtctggctaccatttcgatcantcctggctggnacgtatgcntatgaacctaatccacatattaaattttctcgcatcatgcgtgggacacaagggtgcgttgattgt

SEQ ID NO: 31881 - protein, 72 aa, Zea mays
  misc_feature: Ceres CLONE 1408399-F
  misc_feature (15)..(15): Xaa is any aa, unknown, or other
  misc_feature (66)..(66): Xaa is any aa, unknown, or other
  misc_feature (70)..(70): Xaa is any aa, unknown, or other
MLGTTVIIPTALGPXMGGNHEDQAVVIQNWLVVASIHNLLQRFFGTMVACRIRGSYTFCLATISIXPGWXVC

SEQ ID NO: 31882 - DNA, 683 bp, Zea mays
  misc_feature: Ceres CLONE 1408403-F
  misc_feature: Encodes the peptide sequence at SEQ ID NO. 31883
  misc_feature (428)..(428): n is a, c, t, g, unknown, or other
  misc_feature (432)..(432): n is a, c, t, g, unknown, or other
  misc_feature (612)..(612): n is a, c, t, g, unknown, or other
aagagctggagctccccgcggtggcggccgctctagaactagtggatcccccgggctgcaggaattcgcacgagaccattacctagaacatcctatcgaaaagttgtttcgtctccaccgccgctctcctttccagtctccaccaccgctcgtctccccgtaccgcccgcaacccccctcccctgcgagatccggggcgcgatgtggcgcagctgcgtctcgcggggcctctccagggccaaggcctccgcctccaggctcctctccacggcgtcgtcgtcctacacggtggtcgaccacacctacgacgcagtggtggtgggggccggcggcgcggggctccgggcggcgatcggcctctccgagcacggcttcaacaccgcgtgcatcaccaagctcttccccacgcgctcgcacaccgtcgcggntcanggagcataaatgctgcacttgaaacatgagtgagatgactggaggtgcatatgcatgacactggtaagggaaagcgatggctgggtgaccagattctattcagtatatgtgcagagagggaccaaagctgttatggagctggagactatggactaccattttcagaactggagagggaangtattaccacgtggctttgggaggccgaagttaaattttggcaagggggacaaccctacccgtgggccggg

SEQ ID NO: 31883 - protein, 79 aa, Zea mays
  misc_feature: Ceres CLONE 1408403-F
  misc_feature: SWISSPROT Homolog: EC 1.3.5.1 Succinate dehydrogenase (ubiquinone)
  misc_feature (76)..(76): Xaa is any aa, unknown, or other
  misc_feature (77)..(77): Xaa is any aa, unknown, or other
MWRSCVSRGLSRAKASASRLLSTASSSYTVVDHTYDAVVVGAGGAGLRAAIGLSEHGFNTACITKLFPTRSHTVAXXGA

SEQ ID NO: 31884 - DNA, 726 bp, Zea mays
  misc_feature: Ceres CLONE 1408404-F
gtatatggttgttgtagatgggaaagaacagacagaggggggcccccccctcacaaaaaacaaagctgggactcaccgcggtggcggccgctctagaactagtggatcccccgggctgcaggaattcgcacgagaccattacctagaacatcctaaaaaaaatttctgacctcttctggaatcctgcagagaggtggacgaaatggcctcgtcctcctctgactccggccgcatcgccggaaccctaaccttgcgtacgagctcggccttagcggaggcgtggataatcccggggctcccggacgacgttgcagctgtcattctctgcctgctcaccgtccccgaccagtcccgcctccgcgccacctcgcgcgcttggtgcttgctcctctctgcggatacgctcctcccgctccgccgtagcctccgtctcccgcgccgacaccttctctgcctcttccccaccgacccatccctcgcctccccgatcctgctcgaccccgccgcacctaccacctgggtggcccctcccgccgctcccctgttcgccgaacttttacggactcgccaactttaccgcccctcgccgggtgggcgccaccctctacggccctcgggggggttttggctttcgaaaccacgcaggtttacccttttgggaaaaaaaccctcccaccttcgggggggtgggcctacccgggctttggaccctttgcccaaactcct

SEQ ID NO: 31885 - DNA, 637 bp, Zea mays
  misc_feature: Ceres CLONE 1408407-F
  misc_feature: Encodes the peptide sequence at SEQ ID NO. 31886
gctctagaactagtggatcccccgggctgcaggaattcgcacgagaccattacctagaacatcctaatcaaaaaaattgcgacgccgccgccgtcactgtcgccgcaggagtgcgaaccacgctgccgcccgctcccgccgcccaaacagctttatccgagccccgattcgccggatcacatgctgcggccacctctcaaatgacctctcaactccagagcactttgctcctgctcccgctcttcgccgccgctgctttgggccgcggcggagacgcctcgactgcgccgtcgctggagttccaccatcggttctccgcaccgctgcggcggtgggtggaggcccgagggcgcgcgctccctggcgggtggccggctcccggcacccccacgtacgtcgccgcccttgccgggcacaatcgccaccgggcggtgccggcagaagggggtagaaaaagagacgcaccaccgctcactttcgccgagggaaatgccaccctcaaggtcagaaacctcggcatttttgcactatgcttctggtgaccgttggcacacccgacacaaacgttcattgggggacgcgtgacacaggccacccatctctttccggattgccttggccagggtgaacgcctgcc

SEQ ID NO: 31886 - protein, 113 aa, Zea mays
  misc_feature: Ceres CLONE 1408407-F
MTSQLQSTLLLLPLFAAAALGRGGDASTAPSLEFHHRFSAPLRRWVEARGRALPGGWPAPGTPTYVAALAGHNRHRAVPAEGGRKRDAPPLTFAEGNATLKVRNLGIFALCFW

SEQ ID NO: 31887 - DNA, 651 bp, Zea mays
  misc_feature: Ceres CLONE 1408408-F
  misc_feature: Encodes the peptide sequence at SEQ ID NO. 31888
  misc_feature (467)..(467): n is a, c, t, g, unknown, or other
  misc_feature (543)..(543): n is a, c, t, g, unknown, or other
  misc_feature (544)..(544): n is a, c, t, g, unknown, or other
  misc_feature (547)..(547): n is a, c, t, g, unknown, or other
  misc_feature (555)..(555): n is a, c, t, g, unknown, or other
  misc_feature (651)..(651): n is a, c, t, g, unknown, or other
ggagctccccgcggtggcggccgctctagaactagtggatcccccgggctgcaggaattcgcacgagaccattacctagaacatcctaatcgaaaaaactcgccgtctcgccagtcgccaccatctaaagccgcggctccaatcccaccgcaggacaggcaggcagagcgcgccccgcgccatttcagccatgtcgacgacgtcgtcgtcgtcgtcgtcgtcgtcgtcgtcgtcgttccagtggcgcccatgggtggcactctcctccatccccgtcgtcgtcggcgccaacaacgagcgggcacggaggctcgcgcccggtgcctccgacctctttctcgacatccagctcccacagcacggcgcctcctacctgttcctgcccgagcgcatcataccggagcccaggaattcgtattcaggccggcaccccttcaccatcctgtccgcctgctccgacgcttctncttcattggggggtggggggtacccgagcccgagggcgtctcgaaaccccgcctgcttcctcgggaacgcccaggnnagnaccgccgntcggcttccccgaagtccccgcccacctcgggggtcaacatcatactgcggaacaggattgggcctcatcggcgacccggggaaacgggggccaan

SEQ ID NO: 31888 - protein, 153 aa, Zea mays
  misc_feature: Ceres CLONE 1408408-F
  misc_feature (93)..(93): Xaa is any aa, unknown, or other
  misc_feature (118)..(118): Xaa is any aa, unknown, or other
  misc_feature (119)..(119): Xaa is any aa, unknown, or other
  misc_feature (122)..(122): Xaa is any aa, unknown, or other
MSTTSSSSSSSSSSSFQWRPWVALSSIPVVVGANNERARRLAPGASDLFLDIQLPQHGASYLFLPERIIPEPRNSYSGRHPFTILSACSDASXSLGGGGYPSPRASRNPACFLGNAQXXTAXRLPRSPRPPRGSTSYCGTGLGLIGDPGKRGP

SEQ ID NO: 31889 - DNA, 681 bp, Zea mays
  misc_feature: Ceres CLONE 1408413-F
  misc_feature: Encodes the peptide sequence at SEQ ID NO. 31890
ggagctccccgcggtggcggccgctctagaactagtggatcccccgggctgcaggaattcgcacgagaccattacctagaacatccctaatcaaaaaagcaaccacttctgctctgaatcccgtctgggcctctgcatttgtgtggttgctgttcccttctcccaccgaccaactcgatccccgcgccatggatcgcgccgaccccgtgcggggactccttgccgtgctctcctcacacctcagtggtgcagcgtccgaggagtgcgcggggcttgtacagtccacggtatcggcgccggggtccggttcccgcgacggcgaatttgcctggatgaccgagacaaccgaaaaacgcgacgaggtcaaggtctctgaaaaacggcatcgcgtgccgccacgacttttacaatattaccagtggtcaggctgcaccagggcctttaatatttaagaaccttggttaccattaacattgccccatgttattttcggccattctggttaattcaatgtgaccagaaggaatactgttccggtataagggttttattccaaaccgaagaaatgggcttgaaaggaaacttatttttgttaaaagagggccacccctttttattgggagcggcaaaacttgcccaaacccaaaagccaatttggcaagggcctgggaatattttctt

SEQ ID NO: 31890 - protein, 87 aa, Zea mays
  misc_feature: Ceres CLONE 1408413-F
MDRADPVRGLLAVLSSHLSGAASEECAGLVQSTVSAPGSGSRDGEFAWMTETTEKRDEVKVSEKRHRVPPRLLQYYQWSGCTRAFNI

SEQ ID NO: 31891 - DNA, 652 bp, Zea mays
  misc_feature: Ceres CLONE 1408417-F
  misc_feature (473)..(473): n is a, c, t, g, unknown, or other
ggagctccccgcggtggcggccgctctagaactagtggatcccccgggctgcaggaattcgcacgagaccattacctagaacatcctaatcgaaaacagaaggcttcagggtagacttggtaaccgttaccacggcttaccagaagatgaaatcattatgcaacaatctacgaagtgaaatttttactgatattgaaatccataatcagcacatacttcccagttttgttgatctgccaaatttagctgcctccatctatagtgtagagctgtcaaatcgtctacgcgcttttcttgttgcttgccctcctgctggtccagcatcacctgttgctgatttggtggtgccacagctgattttcagaaggatctggctagctggaatatctgcatataaaagcaggtgtatgccaaagagctgttccatttgtacattgtattgtggattgaagacaaacgcaggatgttactgnaaaactgcagactggacaaggtcaaatggtcagggagttaggaccagcatatgacaacactttttgtggatgagaatgtatgattttgctgaagaagacattgaccggagtatgaagttatccttttgtcgatgccaaaaaaaacttatttgttctcgagatgcatttttgcaatggtg

SEQ ID NO: 31892 - DNA, 721 bp, Zea mays
  misc_feature: Ceres CLONE 1408418-F
  misc_feature: Encodes the peptide sequence at SEQ ID NO. 31893
  misc_feature (1)..(1): n is a, c, t, g, unknown, or other
naaagctggagctccccgcggtggcggccgctctagaactagtggatcccccgggctgcaggaattcgcacgagaccattacctagaacatcctaatcgaaaactcgcttccaacttctccggcccggtgtgctccgcaggctccacctccgcgtcctctcaagtctcaaactctcaaggactcaccggagaccgcgccgcgccccgcgtacttcaggtaactcgggatggcctccggcggctcggccgcacgtgacgcgtacgacgaggaggacgtcgtccgccgccccctcgagctcgatagccgagacgccgccgactcgtcctccgaccactgggccggggggaatgccatgcctaggtatcaagtgggctggggaaggatgattcaagaaatagacactctgagtggcggcaacccagcaacgatgaggtgcgcaagtagaagctcgggccaggatccttcacggcggaagggggggggcctggcccctaaaaaaaatggaactggcaatgcccatttttggggcagggggtcctggggccttgcacgcggttggctgggggttttttccttaaaaaatgttttctcccttttaaaaccccgtgtgaaaccgcccggcggttttgggtttttcccccccttggggggggtgtgcacaaccctcctttcgtgggttttcggggatatcccctcccccccctttgataataaacaaag

SEQ ID NO: 31893 - protein, 164 aa, Zea mays
  misc_feature: Ceres CLONE 1408418-F
MASGGSAARDAYDEEDVVRRPLELDSRDAADSSSDHWAGGNAMPRYQVGWGRMIQEIDTLSGGNPATMRCASRSSGQDPSRRKGGGLAPKKNGTGNAHFWGRGSWGLARGWLGVFSLKNVFSLLKPRVKPPGGFGFFPPLGGVCTTLLSWVFGDIPSPPFDNKQ

SEQ ID NO: 31894 - DNA, 660 bp, Zea mays
  misc_feature: Ceres CLONE 1408420-F
  misc_feature: Encodes the peptide sequence at SEQ ID NO. 31895
  misc_feature (151)..(151): n is a, c, t, g, unknown, or other
  misc_feature (317)..(317): n is a, c, t, g, unknown, or other
  misc_feature (331)..(331): n is a, c, t, g, unknown, or other
  misc_feature (389)..(389): n is a, c, t, g, unknown, or other
acaagctggagctccccgcggtggcggccgctctagaactagtggatcccccgtgctgcaggaattcgcacgagaccattacctagaacatcctcatcgaaaagcggttccgacgctccgcactccgctcccctctcccaagcaaacacangccgagtccacgcacgcctcccatcattcctcaaccgcctcgccggagcaaggggagtagcggaggatggagattgaccaggctgcgcgggtgcagcgaccgccgcatgcgcaccaagtacagcaacgccgtctacgtcgtccagcgggccttcgcgctctacccnattgaggaaagtgncctcagctttaatggtgggaggggatcaactgtgctcctgcattttgatcgagctggntactaccctttacagaaggactttggtgatgtagccccaacagatgctgttaaaaaactggcactggcaactaacaatttcaaaggccttggggctttcccggaaaccaattctttccttaaggaaacggccccaactttaggggtaccccctggaaacattcctttccaaattccaagttgggctaaaaagggctttctgaagggaaaccccccaaaaaaatttttcttgggaaaaaaaatgggggaccccaaaaggggggggcaaaaaa

SEQ ID NO: 31895 - protein, 134 aa, Zea mays
  misc_feature: Ceres CLONE 1408420-F
  misc_feature: SWISSPROT Homolog: EC 2.7.7.2 FMN adenylyltransferase
  misc_feature (25)..(25): Xaa is any aa, unknown, or other
MRTKYSNAVYVVQRAFALYPIEESXLSFNGGRGSTVLLHFDRAGYYPLQKDFGDVAPTDAVKKLALATNNFKGLGAFPETNSFLKETAPTLGVPPGNIPFQIPSWAKKGFLKGNPPKKFFLGKKMGDPKRGGQK

SEQ ID NO: 31896 - DNA, 722 bp, Zea mays
  misc_feature: Ceres CLONE 1408421-F
  misc_feature: Encodes the peptide sequence at SEQ ID NO. 31897
acaagctggagctccccgcggtggcggccgctctagaactagtggatcccccgggctgcaggaattcgcacgagaccattacctagaacatcctaatcgaaaacacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacacctccccgggctcgcccgcgcagcgcttcgtgtcggaggacggcgtcatcaactcgcgcccgcgggtgctgggcggcggcagctgcatcaacgccggcttctacacgcgggccagcgacgactacgtgcggcgcgtctggtgggacctgggcgccgccggggcggcgtaccggtgactggaggacgtggtggtgttccgccggactgggggcccataggcaggctagctgcagtgcggtctgcgtcaaggtcgttgtcgcgacggacaat

SEQ ID NO: 31897 - protein, 158 aa, Zea mays
  misc_feature: Ceres CLONE 1408421-F
  misc_feature: SWISSPROT Homolog: EC 4.1.2.10 Mandelonitrile lyase
MSGRSRHFTMSTLLATSFFFVLLCSSLQVRGVNYTFVKDAALAPSVSYYDYIIVGGGTAGCPLAATLSERFRVLLLERGASPYDDDRIGDMARFADTLSDTSPGSPAQRFVSEDGVINSRPRVLGGGSCINAGFYTRASDDYVRRVWWDLGAAGAAYR

SEQ ID NO: 31898 - DNA, 666 bp, Zea mays
  misc_feature: Ceres CLONE 1408433-F
gctctagaactagtggatcccccgggctgcaggaattcgcacgagaccattacctagaacatcctaatcgaaaagaaaaaaaagaatagtctcagaaccatctagagacagcggcccgtggagcggacagcggagcgagcaagcctgcgccgccgccggcgtcctcccgaagtagaagctgttctgatccacagctctcgattccggaagagttggtcaagaactggggatcctgagttgaatatgatatcaatccggggtactggtatagtttcggacccggatagaattggtagggatgccagattggagggtgcgtgagtttgaaggaaattcactgatggagttgcccacgtaccaacaacaaacatgaaaggggagttgaggctccctggtgtcactagtaataaagaagttgaaacatgcaggttggccggtgaaaaaaaattcaagggggccatcccctgaaataaataagcctccagaatccacagaaatggtatttccaaagaaactcccaacatggagaaacaggatagtattcccaaaaaaataaaccgggggctgggggacttgcatttgaagactggaaaaaaaaggtttccaaggcctttctctttcaaggggaaaaaaaaaacaaatccgcttgaaaccaagaagggcccg

SEQ ID NO: 31899 - DNA, 622 bp, Zea mays
  misc_feature: Ceres CLONE 1408436-F
  misc_feature (1)..(1): n is a, c, t, g, unknown, or other
  misc_feature (24)..(24): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (37)..(37): n is a, c, t, g, unknown, or other
  misc_feature (38)..(38): n is a, c, t, g, unknown, or other
  misc_feature (54)..(54): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (284)..(284): n is a, c, t, g, unknown, or other
  misc_feature (306)..(306): n is a, c, t, g, unknown, or other
  misc_feature (336)..(336): n is a, c, t, g, unknown, or other
  misc_feature (337)..(337): n is a, c, t, g, unknown, or other
nggggggggggggggggcgggggncgnnnnnnggggnngggggggggggggggnggcnnnnnnnnnnnnnnnnnnnnnnnnncaaagctggagctcaccgcggtggcggccgctctagaactagtggatcccccgggctgcaggaattcgcacgagaccattacctagaaatcctaatcgaaaaactagtcccaactcccaaccaccgccagccgtccgctctccgcaagcgcgaccttccggccagatccgccgcgtcgcgccgacgagcggtccttctgccntagttctccgccagcgagcggncgggtcctcggagattcccgctggccgcgnngatccattggtgactgctcgcgttgcgcctgggatctggtttggggacgggaggagggaaccccgaacggggatcggggggagggggggaacgcccttcagtggctccggcggggggttttgggctcctttcttcgggggggaaaatggggaaggggtttcgggggaatcccggccaaaaatttgggcccaaggaaaagacccgtgtgtttcctggggggggggcacggggagaaacctcgctcttcccggggggggggagaaaaccaaagtttctccttttttt

SEQ ID NO: 31900 - DNA, 633 bp, Zea mays
  misc_feature: Ceres CLONE 1408437-F
  misc_feature: Encodes the peptide sequence at SEQ ID NO. 31901
gctctagaactagtggatcccccgggctgcaggaattcgcacgagaccattacctagaacatcctaatcgaaaaacggtccaccgacgactcttcttcctcacctcctcccgctccagctccagctcgtctctctcctcgcctcgcgtagggtttcgcttcccgtctcgccgccgtcagcatgggggacaactacgatgacgaaggcgagccgatcgtgaacctcgacgaacgggaaccctcccctgagcatcagccgtacgaagacctcgatgacgacctcgacggcggcggcgattggacccgcgaccgctctccgacccccgtccacggcgacgacggcggggcagggtcctcctccaagccccgaaagcgccttctcaagaagggcgggggtggaggcatgcccggcgatgacgggctggatgactttggggtggaggacgaggacgcggaccctttcggctgaggcgagaaagaggaagggctcgtcgtcgctgagggacctcgcgaggggcggggcgggcaaggaaaagaaggctaagaaatgcgatggcaaggacaacgggaagggggagggaaactggggatggggggggaataggcggggattcagggaggaagggactcaggg

SEQ ID NO: 31901 - protein, 95 aa, Zea mays
  misc_feature: Ceres CLONE 1408437-F
MGDNYDDEGEPIVNLDEREPSPEHQPYEDLDDDLDGGGDWTRDRSPTPVHGDDGGAGSSSKPRKRLLKKGGGGGMPGDDGLDDFGVEDEDADPFG

SEQ ID NO: 31902 - DNA, 666 bp, Zea mays
  misc_feature: Ceres CLONE 1408446-F
  misc_feature (333)..(333): n is a, c, t, g, unknown, or other
gctctagaactagtggatcccccgggctgcaggaattcgcacgagaccattacctagaacatcctaatcgaaaacagactacagagcgtagagcgagtgggtatcggacacttctctggcaattgcagattatctccgaatctgtatgaactgactgccgcggtctattccgtctgaagaccctcctcctacctaattatttttctctgtcgtgacgtgaaatcccagcgcgcagcttcttgatccgttccggctgatcccgtggaccggacttggggttggggggaggccctctgtctccatggatgaggcagcagggctgctggtgcaagnaaaggggggaggggggggaccaagaaagctctcctccttccacttccccagggatgttggcctttacacaggggatgggttcttggtgggtggcaaagggccgccctgggggtaaaggggccctaccgggaattgggaaaggatttttttttcatcctaagggaaagaatggtgtggggaaagggtgggcccaacttacggaatttggaaaaaaacctagtttctttattttgaaagggggaggcttccttctaggcaacccctcgagggtggcaagacttggtacccccctggggaaggggaaaatgctatctccatccccccctgggtggg

SEQ ID NO: 31903 - DNA, 639 bp, Zea mays
  misc_feature: Ceres CLONE 1408447-F
  misc_feature: Encodes the peptide sequence at SEQ ID NO. 31904
  misc_feature (423)..(423): n is a, c, t, g, unknown, or other
  misc_feature (432)..(432): n is a, c, t, g, unknown, or other
tccccgcggtggcggccgctctagaactagtggatcccccgggctgcaggaattcgcacgagaccattacctagaacatcctaatcgaaaaattccccccgcgggcgacgaagaacatcactgtagactgaccaaattccccgcgggcttgcggccaaacctttcaccatcggtcggcgaggccgcaccctcccgtgcatgtcactcctgccggcgccgggcgtcctatggtagagactcgccgctcagcgcggaggagcggcagcggttcgctccccggcgacggagcgccgtccgagccggcatccagctcccctgcaactccctccccccgcgggagaataatggcttggttatctctaatgacacacattgaagcagacccgtggaggtagaaaaacagagaggaaggggtaagagggncttagtggntcatgaaattggatgagttgaatggaggattctgggtcactgatgaggcccgccggttggcttccctgcgtgggaaaaatagggggaggtttgccaaaaaaaaaatggctccatcaacaagaatacacttcccccatgtcccggataatgttcccatcaaggatggagatttgcatatctttttccaagggggggaaaaaggaaagt

SEQ ID NO: 31904 - protein, 55 aa, Zea mays
  misc_feature: Ceres CLONE 1408447-F
MVETRRSARRSGSGSLPGDGAPSEPASSSPATPSPRGRIMAWLSLMTHIEADPWR

SEQ ID NO: 31905 - DNA, 675 bp, Zea mays
  misc_feature: Ceres CLONE 1408449-F
  misc_feature: Encodes the peptide sequence at SEQ ID NO. 31906
  misc_feature (290)..(290): n is a, c, t, g, unknown, or other
  misc_feature (374)..(374): n is a, c, t, g, unknown, or other
  misc_feature (400)..(400): n is a, c, t, g, unknown, or other
  misc_feature (641)..(641): n is a, c, t, g, unknown, or other
tccccgcggtggcggccgctctagaactagtggatcccccgggctgcaggaattcgcacgagaccattacctagaacatcctaatcgaaaaataaataacacacaaagttgtccgatcaaagcttgcgcgtttacaatgtctggacgatcaatgaacttcacaatgtccacccttctcgctacgagcttcttctttgtactcctatgcagctcgctacaagtacgtggcgtgaactacacgttcgtgaaggacgcgtcgctggcgcccagcgtgtcgtactacgactacntcatcgtggggcggcggcacggccgggtgcccgctgccgccaacgctgtcggagcgcttccgcgtgctgcttgctggagcgcgncgcctcgccctacgacgacgacccgncatcggggacatggcccgcttcgccgaaaacgctgtcggacacctccccgggctcgccgcgcaacgctttcgtggtcggaaggaccgcgtcatcaactcccgcccccgggggggcttgggcgggcgcaaactgcaatcaacgccggcttctacacgggggccaggaagaataacgtgggggggcgcgccggtggaaacctgggcgccggccgggggggaaaaccggggggttgaaaaaacntttgggccttccacccgaagtgggtaccccttgg

SEQ ID NO: 31906 - protein, 165 aa, Zea mays
  misc_feature: Ceres CLONE 1408449-F
  misc_feature (52)..(52): Xaa is any aa, unknown, or other
  misc_feature (80)..(80): Xaa is any aa, unknown, or other
MSGRSMNFTMSTLLATSFFFVLLCSSLQVRGVNYTFVKDASLAPSVSYYDYXIVGRRHGRVPAAANAVGALPRAACWSAXPRPTTTTRHRGHGPLRRKRCRTPPRARRATLSWSEGPRHQLPPPGGLGRAQTAINAGFYTGARKNNVGGRAGGNLGAGRGGKPGG

SEQ ID NO: 31907 - DNA, 718 bp, Zea mays
  misc_feature: Ceres CLONE 1408452-F
  misc_feature: Encodes the peptide sequence at SEQ ID NO. 31908
  misc_feature (526)..(526): n is a, c, t, g, unknown, or other
  misc_feature (556)..(556): n is a, c, t, g, unknown, or other
  misc_feature (627)..(627): n is a, c, t, g, unknown, or other
  misc_feature (628)..(628): n is a, c, t, g, unknown, or other
  misc_feature (652)..(652): n is a, c, t, g, unknown, or other
  misc_feature (677)..(677): n is a, c, t, g, unknown, or other
aaagctggagctccccgcggtggcggccgctctagaactagtggatcccccgggctgcaggaattcgcacgagaccattacctagaacatcctaatcgaaaaacacaccacagcactaaagtctattcatctctggctccccaaattcagctggagagcactttttcccatcatggataagaactacggtgaactctacaacatcctcggatggggtgaggagtacttcgcggtgaacacggaggggcacctcagcgtgaagcctttcggccgctggacggagcccgggcaggagatcgacgtgcactcggtcatcgtggaagctctagcgacccaacccaacgacagcaccagcaaatctcagttccccatgatccttcgcttccccgacgtgctcaagaaccgtatcgagacgctccataacgcattcaacagcgccatggagtccaccgggtacacgtccaggtaccaaggcgtgttcccgatcaaggtgaaccagaacaagcacgtcgtgcaggaccatggnttaggttcggccagcaatggaactatgggnctcgaggctggctccaagccagaactgctcatcgccatgagctgcctccccgtcaccgaagcgagcccagnncgtacttgatctgcaacggtaccnaggacgcggactacatcgcgtcggnttttttcggggcgggccatgggcctgaacccatatcgtgtt

SEQ ID NO: 31908 - protein, 154 aa, Zea mays
  misc_feature: Ceres CLONE 1408452-F
  misc_feature: SWISSPROT Homolog: EC 4.1.1.19 Arginine decarboxylase
  misc_feature (152)..(152): Xaa is any aa, unknown, or other
MDKNYGELYNILGWGEEYFAVNTEGHLSVKPFGRWTEPGQEIDVHSVIVEALATQPNDSTSKSQFPMILRFPDVLKNRIETLHNAFNSAMESTGYTSRYQGVFPIKVNQNKHVVQDHGLGSASNGTMGLEAGSKPELLIAMSCLPVTEASPXRT

SEQ ID NO: 31909 - DNA, 710 bp, Zea mays
  misc_feature: Ceres CLONE 1408453-F
  misc_feature: Encodes the peptide sequence at SEQ ID NO. 31910
  misc_feature (262)..(262): n is a, c, t, g, unknown, or other
  misc_feature (443)..(443): n is a, c, t, g, unknown, or other
  misc_feature (447)..(447): n is a, c, t, g, unknown, or other
aaagctggagctccccgcggtggcggccgctctagaactagtggatcccccgggctgcaggaattcgcacgagaccattacctagaacatcctaatcgaaaaatctctctcgctttctctagccatgacgctggtgaggatgccttgccgcctctgctgcttcctgctcgtcgtcgccgcctccgccgtctccgggcgggggcgggtggtcaccaccctcccgggctacgagggccgcctccccttccacctcgaaacaggntatgtggaggtggacgaggacgccggcgcggagctcttctactacttcgtccgggccgagtccggcgccgacgacagcgacaccccgttcgtcctccggatccccggcggcaacgctgctccgccttcagcgggctcgcctacgagataggtcccatcatgtttcgtcgtggagccctacnacgncagcttggcgcgcctgcgctacaccccaaactcgtggacaaaggtgcgcatattctttttgtggatccccagtggggggccgggttttctttcttccaagaggccaagggtacaacggctggagcgtattcacccccctgcactttgggaaagtcctcaaaaagggggtacaagaacctcctgggaaccagggaaatctttttcaaatcggggggaaatcaaagcggggaaaaatggcccttcttggcaaagatttcaaaggg

SEQ ID NO: 31910 - protein, 95 aa, Zea mays
  misc_feature: Ceres CLONE 1408453-F
  misc_feature: SWISSPROT Homolog: EC 2.3.1.91 Sinapoylglucose--choline O-sinapoyltransferase
MTLVRMPCRLCCFLLVVAASAVSGRGRVVTTLPGYEGRLPFHLETGYVEVDEDAGAELFYYFVRAESGADDSDTPFVLRIPGGNAAPPSAGSPTR

SEQ ID NO: 31911 - DNA, 714 bp, Zea mays
  misc_feature: Ceres CLONE 1408454-F
  misc_feature: Encodes the peptide sequence at SEQ ID NO. 31912
  misc_feature (343)..(343): n is a, c, t, g, unknown, or other
  misc_feature (344)..(344): n is a, c, t, g, unknown, or other
aaagctggagctcaccgcggtggcggccgctctagaactagtggatcccccgggctgcaggaattcgcacgagaccattacctagaacatcctaatcgaaaaacattagattttttgtatgaaacgcccgcaaccgacttgctcctcaagcctccctgcctgccagctcactcgccttcttcctcccattcccctcgaatcaaccagcagcgattcagatcgaaacgaaacgaaccaaaccaaccaactcgccaccctccaaagccgcagccccaatcccaccgccggccaggcaggcagagcgcgccccgcgccatgtcagccacgtcgtcgttcacagcgnnggagtcgtctcgagctggcgagcaaccggagcgcgacgaggtggtcgagttcctggactgcccttgggtagcactctcctccgccatcgtcgtcatcggcgcccacgacgagcggccacggatgctcgcgcccggtgccttcgacatcttctcgacctccagcccccgctggtcggggcctcctatctggtcacgccggagggaatcgtccggaataacaggtatcagggtaccaaacctgggtttggcccgctgggtcaaatggccccttttctgggtatccaagcagagggggtttgaaccggggcttttttcttggaaaaccccccccccaaccggtttccccctcccaaaagccccccccccttgg

SEQ ID NO: 31912 - protein, 133 aa, Zea mays
  misc_feature: Ceres CLONE 1408454-F
  misc_feature (10)..(10): Xaa is any aa, unknown, or other
MSATSSFTAXESSRAGEQPERDEVVEFLDCPWVALSSAIVVIGAHDERPRMLAPGAFDIFSTSSPRWSGPPIWSRRRESSGITGIRVPNLGLARWVKWPLFWVSKQRGFEPGLFSWKTPPPTGFPLPKAPPPW

SEQ ID NO: 31913 - DNA, 671 bp, Zea mays
  misc_feature: Ceres CLONE 1408455-F
  misc_feature: Translation starting site: 225
  misc_feature (551)..(551): n is a, c, t, g, unknown, or other
  misc_feature (625)..(625): n is a, c, t, g, unknown, or other
  misc_feature (627)..(627): n is a, c, t, g, unknown, or other
aaagctggagctccccgcggtggcggccgctctagaactagtggatcccccgggctgcaggaattcgcacgagaccattacctagaacatcctaatcaaaaattcccgttccccaattcgaaatcgagtcgggtcggtcttgccgtgcgtgcgtggctgcgcgaaccagcccacgctcccactccccgcccgccaccgccgggtccctctagggttttgccgcgatgtcgctccggccgagcgagcgggagcagatgcggaagggcaactacaagcagacggtggacgccgaggagagccgccgccgccgcgagggccagatggtcgacatccgcaaggccaagcgagaggaaagcctccagaagaagcgccgcgatgggttccccgccgccggcgccgtgccgccgatgggccactccaccgcactccagcagaagctcgatggcttgccggcgatggtacaggccgttcactccaacgaccccactgtgcagcttgaggccaccacgcagttcaggaagctgctctccatagagcgtagtccccaattngaaagaggtgatcagcacaggagtcgtgcccgaattcattgagttccttacacgtgaggacatccacactccangnttgaggctgcatgggcgctcaccacattgatcaggacataagaa

SEQ ID NO: 31914 - DNA, 736 bp, Zea mays
  misc_feature: Ceres CLONE 1408456-F
  misc_feature: Encodes the peptide sequence at SEQ ID NO. 31915
  misc_feature (1)..(1): n is a, c, t, g, unknown, or other
  misc_feature (356)..(356): n is a, c, t, g, unknown, or other
  misc_feature (495)..(495): n is a, c, t, g, unknown, or other
  misc_feature (515)..(515): n is a, c, t, g, unknown, or other
  misc_feature (562)..(562): n is a, c, t, g, unknown, or other
  misc_feature (564)..(564): n is a, c, t, g, unknown, or other
  misc_feature (605)..(605): n is a, c, t, g, unknown, or other
  misc_feature (606)..(606): n is a, c, t, g, unknown, or other
  misc_feature (626)..(626): n is a, c, t, g, unknown, or other
  misc_feature (644)..(644): n is a, c, t, g, unknown, or other
naaagctggagctccacgcggtggcggccgctttagaacaagtgggaacccccgggctgcaggaattcgcaacgagaccattacctagaaacatccctaaatccaaaaagagcaaagcaagaagctttgcagtgaacgagtgagtatgtgcggcatacttgctgtgctcgggtgcgccgacgaggccaagggcagcagcaagaggtcccgggtgctggagctgtcgcggcggctgaagcaccggggccccaactggagcggcctccggcaggtgggcgactgctacctctcccaccagcgcctcgccatcatcgacccggcctctggcgaccagcccctctacaacgaggaccagntctgtgggtcgtcgccgtcaaacggcgagatctacaaccacctggacctcaggagccgcctcggccggcgcaggccacagcttcaggaccggcagggaactgcgaggtcatcgcgcacctgtacgaggagcgtgggagnaaaaagttcgtggacatgcnctggacggcgtctttctcctttcgtgctgctggacactcgccatggngnaccgcgcgggcagcagctttcttcatggctgctcggaccgnncattcggtgtgacgccctcntactcgggatggggagcnaaaaggggccggggggtggaatttcgtccgaagatgaaggccctgcacgacgagtgtgaacccacttcgagatctttcccctccggggcatc

SEQ ID NO: 31915 - protein, 185 aa, Zea mays
  misc_feature: Ceres CLONE 1408456-F
  misc_feature: SWISSPROT Homolog: EC 6.3.5.4 Asparagine synthase (glutamine-hydrolyzing)
  misc_feature (71)..(71): Xaa is any aa, unknown, or other
  misc_feature (117)..(117): Xaa is any aa, unknown, or other
  misc_feature (124)..(124): Xaa is any aa, unknown, or other
  misc_feature (140)..(140): Xaa is any aa, unknown, or other
  misc_feature (154)..(154): Xaa is any aa, unknown, or other
  misc_feature (161)..(161): Xaa is any aa, unknown, or other
  misc_feature (167)..(167): Xaa is any aa, unknown, or other
MCGILAVLGCADEAKGSSKRSRVLELSRRLKHRGPNWSGLRQVGDCYLSHQRLAIIDPASGDQPLYNEDQXCGSSPSNGEIYNHLDLRSRLGRRRPQLQDRQGTARSSRTCTRSVGXKSSWTCXGRRLSPFVLLDTRHGXPRGQQLSSWLLGPXIRCDALXLGMGSXKGPGGGISSEDEGPARRV

SEQ ID NO: 31916 - DNA, 701 bp, Zea mays
  misc_feature: Ceres CLONE 1408461-F
  misc_feature: Encodes the peptide sequence at SEQ ID NO. 31917
  misc_feature (468)..(468): n is a, c, t, g, unknown, or other
  misc_feature (524)..(524): n is a, c, t, g, unknown, or other
  misc_feature (526)..(526): n is a, c, t, g, unknown, or other
  misc_feature (527)..(527): n is a, c, t, g, unknown, or other
  misc_feature (600)..(600): n is a, c, t, g, unknown, or other
  misc_feature (667)..(667): n is a, c, t, g, unknown, or other
  misc_feature (682)..(682): n is a, c, t, g, unknown, or other
  misc_feature (701)..(701): n is a, c, t, g, unknown, or other
aaagctggagctccccgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgggncgcaaggtgtggggggaggccacctacgacctcgccaccgtggctcgcttcctcgncnngtctcgcttcaccatctccgtctacatcatgtccaggcccaggcccgtgtacctcatcgacttcgcatgctancagccggccgacgagctcaaggtgtccaaggcggagttcatcgacctggcgcgcaagtccgggcagntcgacgaggacagcntgggcgtccagtcgcgtcn

SEQ ID NO: 31917 - protein, 164 aa, Zea mays
  misc_feature: Ceres CLONE 1408461-F
  misc_feature: SWISSPROT Homolog: EC 2.3.1.119 Icosanoyl-CoA synthase
  misc_feature (106)..(106): Xaa is any aa, unknown, or other
  misc_feature (107)..(107): Xaa is any aa, unknown, or other
  misc_feature (131)..(131): Xaa is any aa, unknown, or other
  misc_feature (154)..(154): Xaa is any aa, unknown, or other
  misc_feature (159)..(159): Xaa is any aa, unknown, or other
MAREEQALLSTEIVNRGVEPSGPDAGSPAFSVRVRRRLPDFLQSVNLKYVRLGYHYLISHGVYLATIPVIVLVCGAELGSLSRDELGRKVWGEATYDLATVARFLXXSRFTISVYIMSRPRPVYLIDFACXQPADELKVSKAEFIDLARKSGQXDEDSXGVQSR

SEQ ID NO: 31918 - DNA, 726 bp, Zea mays
  misc_feature: Ceres CLONE 1408462-F
aaagctggagctccccgcggtggcggccgctctagaactagtggatcccccgggctgcaggaattcgcacgagaccattacctagaacatcctaatcaaaaagcggcggtgttgacccacccacccgttcctcccccaccccatcagcgctggaggcggcggtgcgtaagtcccccggacccttcggcggcggcggcggcgcgcggttatgccgagaggctcccaggtttcatcatcgtgctctgctggagttatagcattttcagcaaggatatggagtacaccccctgcacagcaagttcctctgtatcccacatctcgctgctcgaggaagttcttggctggaggttttgtctttacggagaacttcctggtcattctcttttgtcaacttgcacttgaggatcaacccacgcttaatgactgccttgcctggtcccattgctgtcagaacattaaagttgcccagtgattacacttttaacagtgcagctgtagcacattttaatttgagcatggtggatctgtttcttcttggcaacattccagtaatcttttgtcttggtgctaatcagccagcagaagttaccatcaagacatctttggacacttggatcttaacgcttagagctttgccttcgcatataggctctaggttttgggttttcgttttctgctagctttcttcttactctaccacttgtagttttcagtctgatcggtcca

SEQ ID NO: 31919 - DNA, 720 bp, Zea mays
  misc_feature: Ceres CLONE 1408463-F
  misc_feature: Translation starting site: 175
  misc_feature: SWISSPROT Homolog: EC 1.11.1.6 Catalase
  misc_feature (417)..(417): n is a, c, t, g, unknown, or other
  misc_feature (463)..(463): n is a, c, t, g, unknown, or other
  misc_feature (682)..(682): n is a, c, t, g, unknown, or other
caaagctggagctccccgcggtggcggccgctctagaactagtggatcccccgggctgcaggaattcgcacgagaccattacctagaacatcctaatcgaaaaatgtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatccccggagcgcgtggtgcacgcgcgcggggcctccgccaagggcttcttcgagtgcacccacgacgntgacgtcgctgacgtgcgccgacttcctgcgcgcgcccggcgtgcnggacgcccgtgatcgtgcgcttctcgacggtgatccacgagcgggggtccccggagacgatccgcgacccgcgcgggttccgccgtggagttctacacccgcgagggcaactgggacctgctgggcaacaacttccccgtcttcttcatccgcgacggctcagggttccccgacgtgatccacgcgttcagccccacccgcggtcgcacgtgcagaagnaactgggcgggtgttcgacttcctgtcgcacctccccg

SEQ ID NO: 31920 - DNA, 710 bp, Zea mays
  misc_feature: Ceres CLONE 1408468-F
  misc_feature: Encodes the peptide sequence at SEQ ID NO. 31921
  misc_feature (691)..(691): n is a, c, t, g, unknown, or other
aaagctggagctccccgcggtggcggccgctctagaactagtggatcccccgggctgcaggaattcgcacgagaccattacctagaacatcctaatcgaaaagccgcttccaaatcccaataataccatcgcgtaaatccagatatcagggcagctggaactgaaggtggcgggagccgagtgatccggcggtgagctgagcggggcgggatggcggcggagcaggggcggtcgctggcggagacgcccacctggtccgtggcaaccgtcaccacgctcatggtcgctgcctgcttcctcgtcgagcgctccctctcgcgcttcgccaagtggctgcgcaagaccaagcggaaggccatgctcgccgcgctcgagaagatccgcgaagagctgatggctgctcggagtcatctcgctgctgctcagccagacggcgcggcttcatatcggagaatctgcgtgccgtcctcgctcttcaccagccgcttctacatctgctccgagagcgactaccaggacctgctgcgcaacacggacgccaaccagacggcgctcgacagaaacaatgttcggtggccaacggctgcacgtcttggtggcgagggcatgaaaaccttttgtttcgtacgagggccttgagcagcttgcaccggtttctcttcatccttgtatcacctctgtggttgtacgntttggaacccaggggttcg

SEQ ID NO: 31921 - protein, 142 aa, Zea mays
  misc_feature: Ceres CLONE 1408468-F
MAAEQGRSLAETPTWSVATVTTLMVAACFLVERSLSRFAKWLRKTKRKAMLAALEKIREELMAARSHLAAAQPDGAASYRRICVPSSLFTSRFYICSESDYQDLLRNTDANQTALDRNNVRWPTAARLGGEGMKTFCFVRGP

SEQ ID NO: 31922 - DNA, 704 bp, Zea mays
  misc_feature: Ceres CLONE 1408470-F
  misc_feature: Translation starting site: 182
  misc_feature: SWISSPROT Homolog: EC 4.1.3.4 Hydroxymethylglutaryl-CoA lyase
  misc_feature (1)..(1): n is a, c, t, g, unknown, or other
  misc_feature (545)..(545): n is a, c, t, g, unknown, or other
naaagctggagctccccgcggtggcggccgctctagaactagtggatcccccgggctgcaggaattcgcacgagaccattacctagaacatcctaatcgaaaagtttcctctctccaattcccacccgcgtcaaggagcttctcgtctgagcccgagctaacaagctcaccggcgggcaggatgctggcggcgtccaccaaggtcggctctaggctggcctctccgcacgcctccttgtccgccggtgctgcagcggcggcgctggcgagctcccccgtgctgggctctgggatgctcccaggcgccgggttcggcgagacgggagtcaccacgcggcggacgcgccgccgccgctgccttgcagttcctcgggcgattcaagggaatattatcagtggaagagactggtgaatcaaaggcagtcaacgctagatggaggcaaagtgcctgctgcattgggccaccatggtttttggtgcgggcttttcctcacggaaccaacatatctacagatatttttcatcttctcatcaagggagtatantgggccgggagcaaggttctacatgacctgccagggtatgtaaaaattgtgggactagggccacgagatggtctacagaatgagaaggacatcgtgccaacacctgtaaagggtgagcttatacgaagattggcacatccggattacctgttgtggagg

SEQ ID NO: 31923 - DNA, 723 bp, Zea mays
  misc_feature: Ceres CLONE 1408472-F
  misc_feature: Encodes the peptide sequence at SEQ ID NO. 31924
  misc_feature (370)..(370): n is a, c, t, g, unknown, or other
  misc_feature (372)..(372): n is a, c, t, g, unknown, or other
  misc_feature (373)..(373): n is a, c, t, g, unknown, or other
  misc_feature (460)..(460): n is a, c, t, g, unknown, or other
  misc_feature (478)..(478): n is a, c, t, g, unknown, or other
  misc_feature (479)..(479): n is a, c, t, g, unknown, or other
  misc_feature (482)..(482): n is a, c, t, g, unknown, or other
  misc_feature (506)..(506): n is a, c, t, g, unknown, or other
  misc_feature (507)..(507): n is a, c, t, g, unknown, or other
aaagctggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgaacatttatgcgtgtaccaggcagaccagcccggcagccacgcgtacacttctgccgcaaagctaaacgcgccactccgcggcaagctgctctgctgctcccacagncnnacgcacgagtgccaatggcgactgcagcgagttcgacgccgggcgcgcggcagcctactctggtctgcgcgtcactgaccgcgcggntgcctccggagaatgcanncgnagttgcccgcgctgcggcgtcggnngccgacgtggcggacttcaaggtcggttgcctccacaggttcgagcatgcagggaccttgccggggttttggccaagcccggtggttcccggaatggcactaaggggcggaattgggaggggggccccaccccggcaaaaaagacccggttttgggggcttttatgggaaggggctggggattgaaatttcctgtgggagttaggggtggcccccc

SEQ ID NO: 31924 - protein, 107 aa, Zea mays
  misc_feature: Ceres CLONE 1408472-F
  misc_feature (25)..(25): Xaa is any aa, unknown, or other
  misc_feature (31)..(31): Xaa is any aa, unknown, or other
  misc_feature (32)..(32): Xaa is any aa, unknown, or other
  misc_feature (40)..(40): Xaa is any aa, unknown, or other
MATAASSTPGARQPTLVCASLTARXPPENAXXVARAAASXADVADFKVGCLHRFEHAGTLPGFWPSPVVPGMALRGGIGRGAPPRQKRPGFGGFYGKGLGIEISCGS

SEQ ID NO: 31925 - DNA, 726 bp, Zea mays
  misc_feature: Ceres CLONE 1408474-F
  misc_feature: Translation starting site: 474
  misc_feature: SWISSPROT Homolog: EC 3.6.3.14 H(+)-transporting two-sector ATPase
  misc_feature (300)..(300): n is a, c, t, g, unknown, or other
  misc_feature (407)..(407): n is a, c, t, g, unknown, or other
  misc_feature (573)..(573): n is a, c, t, g, unknown, or other
  misc_feature (663)..(663): n is a, c, t, g, unknown, or other
  misc_feature (671)..(671): n is a, c, t, g, unknown, or other
  misc_feature (723)..(723): n is a, c, t, g, unknown, or other
caaagctggagctccccgcggtggcggccgctctagaactagtggatcccccgggctgcaggaattcgcacgagaccattacctagaacatcctaatcgaaaaaaaacccaatccatccaaacccatttccctcgctcccatcccgtcccgccccttgtctcttccgcttccccccgaccccgcgcgccgcggaccagcagccatgtcgtgctcccacctctccaccgcctggtcctcctcggcgctcgccagcagcgcctccaccacccgacggcgctcccccccgcgctcgggtcccntgggtgcggtgttccctccgtgagctccgcacccgcatcgactccgtcaggaacacgcagaagatcacggaggccatgaagctggtggccgccgccaaggtccggcngcgcgcaggaggccgtcgtctcctctcgccctttctcggaggcgctgggtggaggtgctctacaacatgaaccaggagatccagacggaggacatcgacctgcccctcacccgcacccgcccccgtcaagaaggtggggccctcgtggtcctgaccggcgagcgcnggcctctgcgggagcttcaacaacaacgtggctcaagaaggcggaaacccgcatcgatgagctcaagcagctgggcctccagtacacgtncgtcagcntgggggggaaagaagggcaacgcctacttccagcgccgcccctacatcccgntgg

SEQ ID NO: 31926 - DNA, 747 bp, Zea mays
  misc_feature: Ceres CLONE 1408476-F
  misc_feature: Encodes the peptide sequence at SEQ ID NO. 31927
  misc_feature (1)..(1): n is a, c, t, g, unknown, or other
  misc_feature (430)..(430): n is a, c, t, g, unknown, or other
  misc_feature (431)..(431): n is a, c, t, g, unknown, or other
  misc_feature (455)..(455): n is a, c, t, g, unknown, or other
  misc_feature (456)..(456): n is a, c, t, g, unknown, or other
  misc_feature (468)..(468): n is a, c, t, g, unknown, or other
  misc_feature (515)..(515): n is a, c, t, g, unknown, or other
  misc_feature (518)..(518): n is a, c, t, g, unknown, or other
  misc_feature (519)..(519): n is a, c, t, g, unknown, or other
  misc_feature (525)..(525): n is a, c, t, g, unknown, or other
ncaagctggagctccccgcggtggcggccgctctagaactagtggatcccccgggctgcaggaattcgcacgagaccattacctagaacatcctaatcgaaaaaaacagcgaagaaggaagccggttagggtttccacctcctttcccctcctctccttcagcgtcgaccgcgggccacaccctcgatatccttcccctcggacccggaggcgagcagcagcctccagcgcctgccacgcctgcccgtctctttattgggaggattcgccatgtctgacatggagtccgtcgcagctcttatgaactcgacaagctccaagatacagcagcttcaggaggcatttgctgagcttgagagccagagcacggtttccatgaacctcaagtggaagcagcttgaaagacactttcgtggtctttgacagtccnntcagaaaaagtttgacgagctaannagagcaggaaanggagttcccagagactgtcgcaaaatcagagcaaaattctggagcancgnnaggcancctgttgtggcaaaggaactgcctcttttgaaaaaatttgaggaaaaaaaggaaactgcattaacttaggtcttttagcagggccgggttttccttactgtgtcctaccttaaccaatggaaagggggtaaaaaaattttgggggaagggggccaaaccggtttttggggagaaggggccctttgaagtgaaaattgtgtagaggccccccttttttggttt

SEQ ID NO: 31927 - protein, 50 aa, Zea mays
  misc_feature: Ceres CLONE 1408476-F
MSDMESVAALMNSTSSKIQQLQEAFAELESQSTVSMNLKWKQLERHFRGL

SEQ ID NO: 31928 - DNA, 691 bp, Zea mays
  misc_feature: Ceres CLONE 1408477-F
  misc_feature (664)..(664): n is a, c, t, g, unknown, or other
  misc_feature (671)..(671): n is a, c, t, g, unknown, or other
  misc_feature (675)..(675): n is a, c, t, g, unknown, or other
  misc_feature (676)..(676): n is a, c, t, g, unknown, or other
  misc_feature (679)..(679): n is a, c, t, g, unknown, or other
  misc_feature (680)..(680): n is a, c, t, g, unknown, or other
aaagctggagctcaccgcggtggcggccgctctagaactagtggatcccccgggctgcaggaattcgcacgagaccattacctagaacatcctaatcaaaaaaaaggaaacagctcgtccagtccgtagtccatagtactccatttgcaaattgcattgcattgcctcacctcaaccccacctcacctctcctctcctcggcctcacttcacaagtccacatcacgaaacaggagcgtcataaagacatgggcgtcgcagggtagcctcagaccagtgacgcagcggcagcggcagcggcagcgggcatggggtcctgactgactaactgcgaaggagatggctggagcgcgacggccccggagccattaatggggtgctcatcctcctcgtcctcgcctcctccccgccgggtcgcggacgcggtcggctccgccttttaaccggcctgtccgggagcggggcgccggaaccctagtgctgtgctggtggcacgcggcgcgccccatgggcatcgatctcaacatggtggacggcgagagccacgagcgccgcccggccgccggtggcgtggccgggagctgtggcacgcgtgcgcgggggcccgtggtcgcgctaccgcggcggggcaagcctggtcgtgaacctggcgcagggcactgggnctgcggngggnnggnncggggacgtcg

SEQ ID NO: 31929 - DNA, 686 bp, Zea mays
  misc_feature: Ceres CLONE 1408478-F
  misc_feature (558)..(558): n is a, c, t, g, unknown, or other
  misc_feature (563)..(563): n is a, c, t, g, unknown, or other
  misc_feature (580)..(580): n is a, c, t, g, unknown, or other
  misc_feature (583)..(583): n is a, c, t, g, unknown, or other
caaagctggagctccccgcggtggcggccgctctagaactagtggatcccccgggctgcaggaattcgcacgagaccattacctagaacatcctaatcgaaaaaaaaaaaaaaaaaagcttctcgtgccggcttctcgtgccgttttttttttttttttttggaaaatccataggtgaatattgatacaggattcaatggttcacacaaagatcataggaacatacagtgaaaattatcagtgctaccgttcaggaaagcaaatgctaaatctgtttcttggatccgagaaggccggcacatgttcagatgatgatgaaaggtcattcatgaatagaacggaagtatataatgatattcaacttccacactgctttgtccagatcattaaattcagcgcctaccagcccgtcttttactctgcctcctcgccctccgccgcctcaaccgggacacgggactcttcaagcgccgccgcgacgagcccgcttccgccgtccctgcctccgatctgactcctacacgcgccgaaacagccccattcgcaggaatcacccgntcggnattcactcccctctcancgnccgacgtagcggttccccgggatgctgctgagtcaaagcttgaaaggctgtcagaagctgtcgacaaactatgttcagatgacaccaccagtcagctcgagcc

SEQ ID NO: 31930 - DNA, 708 bp, Zea mays
  misc_feature: Ceres CLONE 1408479-F
  misc_feature: Translation starting site: 296
  misc_feature (375)..(375): n is a, c, t, g, unknown, or other
  misc_feature (435)..(435): n is a, c, t, g, unknown, or other
  misc_feature (439)..(439): n is a, c, t, g, unknown, or other
  misc_feature (454)..(454): n is a, c, t, g, unknown, or other
acaagctggagctcaccgcggtggcggccgctctagaactagtggatcccccgggctgcaggaattcgcacgagaccattacctagaacatcctaatcgaaaaaccgcctagacacgggtcgcgcgcaataacccaccgatcgagctgagcacgcacgacctggcgctcgctttaaactctcgctctcaatcgtcgtcgcctcaggctctcggcagacagctgcggcggcgtgcctggcagtgaagcggtagcaggtagagccagccagtctagcttagccaccacactagtgtgatggcgaccaccggcggcggcaaggcggcactggtgctggggcggcttctgcttctgctgtgcgtgctcggccatggagntgcgcagcggtacaacgccatctggagcttcggcgactccatctccgacaccggaacctntggntggggggggggcggntgcccttcctggctcaccacggggcagccgcccctacggggagaccttcttcggccgccccaccggacgcctgctccgacggccgcgtcatcgtcgacttcctggccgagcactttgggctgcccctgctgccggcttcgaaagccggcggcgaacttgaagaggggggcgaacatggcgatcatcggcgccccaccagggactttgacttcttcaagtccatcgggctcagcgacaagatctggaacaacggt

SEQ ID NO: 31931 - DNA, 697 bp, Zea mays
  misc_feature: Ceres CLONE 1408484-F
  misc_feature: Encodes the peptide sequence at SEQ ID NO. 31932
  misc_feature (377)..(377): n is a, c, t, g, unknown, or other
  misc_feature (447)..(447): n is a, c, t, g, unknown, or other
  misc_feature (465)..(465): n is a, c, t, g, unknown, or other
  misc_feature (466)..(466): n is a, c, t, g, unknown, or other
aaagctggagctccccgcggtggcggccgctctagaactagtggatcccccgggctgcaggaattcgcacgagaccattacctagaacatcctaatcgaaaaaaaaaaacgcacggggagcttggagacttcacgacaaatcgacgatcgccgcttctcttggccattgtagagggagagagagagcgcgagcgacctaggtcagtcggtttcggttttgggcgtcagcttcagctatccgcgaccgcgacgatgggtctgcgcgtggccgccaccgcgccagctccggccggcgtgcgcgtgctcggcaggggcgccgcgcgcgtgacgccgcgaccgtgggcggctgtcggcggcaggagacgcttctccccggncggatgtccgtcgcgaccaccgaggccaccaccaccaatcgccgtggggcgcctcggaggaccaggcgcntggaggctaggaactccnnagacggtggtggcggtcatcctcggcgggtggcgccgggaccaggctcttcccgcttaccagacgcagggcccaagcccgcggtggccaattggcggcgcgtacaggctcatcgacgtggcgatgagcaactgcataaacaggggaatcaacaaggtctacatcctcacgcagttcagctcgcaatccctcaatcgccacctcctcagagcctacgatttcagcaatgggt

SEQ ID NO: 31932 - protein, 148 aa, Zea mays
  misc_feature: Ceres CLONE 1408484-F
  misc_feature: SWISSPROT Homolog: EC 2.7.7.27 Glucose-1-phosphate adenylyltransferase
  misc_feature (42)..(42): Xaa is any aa, unknown, or other
  misc_feature (72)..(72): Xaa is any aa, unknown, or other
MGLRVAATAPAPAGVRVLGRGAARVTPRPWAAVGGRRRFSPXGCPSRPPRPPPPIAVGRLGGPGAWRLGTPXTVVAVILGGWRRDQALPAYQTQGPSPRWPIGGAYRLIDVAMSNCINRGINKVYILTQFSSQSLNRHLLRAYDFSNG

SEQ ID NO: 31933 - DNA, 736 bp, Zea mays
  misc_feature: Ceres CLONE 1408485-F
  misc_feature: Encodes the peptide sequence at SEQ ID NO. 31934
  misc_feature (340)..(340): n is a, c, t, g, unknown, or other
  misc_feature (616)..(616): n is a, c, t, g, unknown, or other
aaagctggagctccccgcggtggcggccgctctagaactagtggatcccccgggctgcaggaattcgcacgagaccattacctagaacatcctaatcgaaaaacacaccacagcactaaagtctattcatctctggctccccaaattcagctggagagcactttttcccatcatggataagaactacggtgaactctacaacatcctcggatggggtgaggagtacttcgcggtgaacacggaggggcacctcagcgtgaagcctttcggccgctggacggagcccgggcaggagatcgacgtgcactcggtcatcgtggaagctctagcgacccacccnacgacagcaccagcaaatctcagttccccatgatccttcgcttccccgacgtgctcaggaaccgtatcgagacgctccataaacgcattcacagcggccttggagtccaccggggtacccgtccggtaacaaaggcggggttcccgaatcagggggaccaaaaacaagcccgtccggggggaaaaggggtaaggttcccgccaaaaaagggaattaagggctccgggggtggttccaaaccaaaaagggttcaccccctggagttggccccccccncccagaaagggggcccaaaggcgtttttgtttttggcggggtaaaaaggggggggaaaaaacggggggcgggccttcgggggggggggggggggggggaaccccccctggggggggggaa

SEQ ID NO: 31934 - protein, 66 aa, Zea mays
  misc_feature: Ceres CLONE 1408485-F
  misc_feature: SWISSPROT Homolog: EC 4.1.1.19 Arginine decarboxylase
MDKNYGELYNILGWGEEYFAVNTEGHLSVKPFGRWTEPGQEIDVHSVIVEALATHPTTAPANLSSP

SEQ ID NO: 31935 - DNA, 716 bp, Zea mays
  misc_feature: Ceres CLONE 1408486-F
  misc_feature: Translation starting site: 219
  misc_feature: SWISSPROT Homolog: EC 1.4.1.2 Glutamate dehydrogenase
  misc_feature (134)..(134): n is a, c, t, g, unknown, or other
  misc_feature (189)..(189): n is a, c, t, g, unknown, or other
  misc_feature (415)..(415): n is a, c, t, g, unknown, or other
  misc_feature (417)..(417): n is a, c, t, g, unknown, or other
  misc_feature (418)..(418): n is a, c, t, g, unknown, or other
  misc_feature (456)..(456): n is a, c, t, g, unknown, or other
aaagctggagctccccgcggtggcggccgctctagaactagtggatcccccgggctgcaggaattcgcacgagaccattacctagaacatcctaatcgaaaaatcattgcaaaagcgaagcaaagcaatcgganattctctgcgatttctctagatctcgactaccccccactagttttggttcctccntttcgttcgagagagcgattctggtggcaatggcgaagagcgagggtccggcgatcgggatcgacctcggcaccacctactcgtgcgtcggcgtgtggcagcacgaccgggtggagattatcgccaacgaccaggggaacccgcacacgccgtcctatgtcggcttcaccgacaccgagcggctcatcggcgacgctgccaagaaacaggtcgccatgaaccccancnnacacgtcttcgatggcaagcggttgatcgggaggaggntctctgatccgtcagtgcaaagtgacatgagcctatgcccgtcaaggtatcccagggcctgggtgacagcccttgattgtggggactacagggcaaggaaacccatttgctgttgagggaatctccccagggccccaaccgaggaagggaattgttgacgcctacttgggttccccctaaaaaaacagggggggaaggggcggccaaattccccattctcgagggggggcccaggggcgcgggggttttgggggcctaag

SEQ ID NO: 31936 - DNA, 734 bp, Zea mays
  misc_feature: Ceres CLONE 1408487-F
  misc_feature (360)..(360): n is a, c, t, g, unknown, or other
  misc_feature (391)..(391): n is a, c, t, g, unknown, or other
  misc_feature (394)..(394): n is a, c, t, g, unknown, or other
  misc_feature (512)..(512): n is a, c, t, g, unknown, or other
  misc_feature (533)..(533): n is a, c, t, g, unknown, or other
  misc_feature (577)..(577): n is a, c, t, g, unknown, or other
  misc_feature (584)..(584): n is a, c, t, g, unknown, or other
  misc_feature (585)..(585): n is a, c, t, g, unknown, or other
  misc_feature (649)..(649): n is a, c, t, g, unknown, or other
caaagctggagctcaccgcggtggcggccgctctagaactagtggatcccccgggctgcaggaattcgcacgagaccattacctaaaacatcctaatcgaaaaacgagctctccatcttgccatctgctcctatttctgtcgcgagctggatgagggcatgatacagttcacgggatctggctccccgacggccaattcttcatctcgccttcgaaaacccggtccttgtcgggccgtcggactggagggaccacgccgccggcaaggaaggggtccagaggtaccgcatccgcaacctcccggacaacttccccggcctctacgagctaggcgttgcctgcgcggccgacgaagggcgntcaggtcccggaggcgtgacgcgcgaggggntcnttcgtgggtgtacctcggccaggccgacagtgggtccgggcgaggctgcagcagtatggccccgctcggggtcgcatctggacactaacgaactcgccgggctctttctgatagagantgcggcgaatgcgcttcgccngagggtcctggactcttccagagaagtgttctccagaggctacntccgtcnngggtttcgatgtggcgctgatggacaataaacaagaaagctgagaagactgaagcactactccntgagaagtattttgattatgcatgggaacagcttcagaaatggtggcttgtcgccgggcagaattactgcataagttagaactgc

SEQ ID NO: 31937 - DNA, 706 bp, Zea mays
  misc_feature: Ceres CLONE 1408488-F
  misc_feature: Encodes the peptide sequence at SEQ ID NO. 31938
  misc_feature (319)..(319): n is a, c, t, g, unknown, or other
  misc_feature (322)..(322): n is a, c, t, g, unknown, or other
  misc_feature (325)..(325): n is a, c, t, g, unknown, or other
  misc_feature (348)..(348): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (630)..(630): n is a, c, t, g, unknown, or other
  misc_feature (631)..(631): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
caaagctggagctccccgcggtggcggccgctctagaactagtggatcccccgggctgcaggaattcgcacgagaccattacctagaacatcctaatcgaaaaatgtcccaaagcaaagcaaagcttcaaagcatctctgcttggattttagcgagcggcaacgacgagcgacccaatggggttcgtgctggagatctctctgcccttcatcttcctctccatcctcctcggattcggatgctacttcctcggcaagcacaggtgccgggaggagatgcggaccgacgtcagcgcgcagatctacgtgacgccctgcgncgnccngagtgtcaacggatccatctcgnccgcgactgagacgtccacagcacgaaacaaggttccgagttgtgttgctgaaaatcaaacgctgctcatgcatccgtacactactatacttatatgtctgggcggaggagggtggattgaaacccttcatgtaaaatcccccgggggggcttggaaaaggaaatctggagcaaaaggggtttgggggggaaggttttaaccattccaaaccacataaatttccctgaaaccaagaaaaaaacagggggggaaaaaaagggttggggggtgcccccnnnncnncaaccctaacacctccgccccccggnnnnaaaattttttatccccccccccccgggggggccccggcccccatca

SEQ ID NO: 31938 - protein, 123 aa, Zea mays
  misc_feature: Ceres CLONE 1408488-F
  misc_feature (48)..(48): Xaa is any aa, unknown, or other
  misc_feature (49)..(49): Xaa is any aa, unknown, or other
  misc_feature (50)..(50): Xaa is any aa, unknown, or other
  misc_feature (58)..(58): Xaa is any aa, unknown, or other
MGFVLEISLPFIFLSILLGFGCYFLGKHRCREEMRTDVSAQIYVTPCXXXSVNGSISXATETSTARNKVPSCVAENQTLLMHPYTTILICLGGGGWIETLHVKSPGGAWKRKSGAKGVWGGRF

SEQ ID NO: 31939 - DNA, 662 bp, Zea mays
  misc_feature: Ceres CLONE 1408494-F
  misc_feature: Encodes the peptide sequence at SEQ ID NO. 31940
  misc_feature (432)..(432): n is a, c, t, g, unknown, or other
  misc_feature (493)..(493): n is a, c, t, g, unknown, or other
  misc_feature (571)..(571): n is a, c, t, g, unknown, or other
  misc_feature (599)..(599): n is a, c, t, g, unknown, or other
  misc_feature (617)..(617): n is a, c, t, g, unknown, or other
  misc_feature (645)..(645): n is a, c, t, g, unknown, or other
aagctggagctccccgcggtggcggccgctctagaactagtggatcccccgggctgcaggaattcgcacgagaccattacctagaacatcctaatcgaaaagattgattcacaagacgtcgatcccaaaccctaaccctttcaacggttccactccaccaccaacctcatgtgtcggcgcccgccgccgcacccaacccctccctcctccgtctgctcccggtcctcgcgtagccgcaacctccctcgttgccccacactacccacgtccctagcgtcatgcagatcaaaaccaaggggcaggcggcgacagtggttcagagtccgccgctgacggccctgcgaggaacgggtagattcgcttggtgtccgggcggctccgcgtcgccgaatccgatagcattgtggatctggagggtagaaaagggcttgntggtagacgtgaaggacgatggcgttcatggtcctagaagtaagcgcgatggtctcctcangcatcggcttcgtggacggctggttcttcccatcatagatcagaagaggactcgagtcataaaaaagttcatcattgntgcttgaaatccacgaaatggccgctgnttcttctcatttcggtgnagcatgcctagatctgtgaaatgggttngtttccttccgcttcgc

SEQ ID NO: 31940 - protein, 99 aa, Zea mays
  misc_feature: Ceres CLONE 1408494-F
  misc_feature (52)..(52): Xaa is any aa, unknown, or other
  misc_feature (72)..(72): Xaa is any aa, unknown, or other
  misc_feature (98)..(98): Xaa is any aa, unknown, or other
MQIKTKGQAATVVQSPPLTALRGTGRFAWCPGGSASPNPIALWIWRVEKGLXVDVKDDGVHGPRSKRDGLLXHRLRGRLVLPIIDQKRTRVIKKFIIXA

SEQ ID NO: 31941 - DNA, 718 bp, Zea mays
  misc_feature: Ceres CLONE 1408497-F
  misc_feature: Encodes the peptide sequence at SEQ ID NO. 31942
  misc_feature (364)..(364): n is a, c, t, g, unknown, or other
  misc_feature (383)..(383): n is a, c, t, g, unknown, or other
  misc_feature (409)..(409): n is a, c, t, g, unknown, or other
aaagctggagctccccgcggtggcggccgctctagaactagtggatcccccgggctgcaggaattcgcacgagaccattacctagaacatcctaatcgaaaaatccgctccccgccttccgcttccctaccccccgcatcacctaccaacgccgacaccatgggggccttcgcgaaggaggagcaccagttcctcgccgagctcggcctcgcgcagcgcaacccgggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttcgacngcgctaagacatggatggncgatccctgctcaagcggaggagagnatcgtaggcaaatcggtgatgcactgaaagcaaagctccatcacttggccagcttgtgtcacttgaaatgggggaaattcctcctgaagggaacgggggaggtccggaaatccatgacatgtggggattatggtggggggactaaaccgccactaaggggggccctttatccctttgaacgcccacatttgggtgggggggggggggggaccccctgggggggtggggggggataaaaggaaataattttcccggggggggggcttggggaaaaattccacttttcttggcggggaaaaaaggggcccc

SEQ ID NO: 31942 - protein, 161 aa, Zea mays
  misc_feature: Ceres CLONE 1408497-F
  misc_feature: SWISSPROT Homolog: EC 1.2.1.3 Aldehyde dehydrogenase (NAD(+))
  misc_feature (69)..(69): Xaa is any aa, unknown, or other
  misc_feature (75)..(75): Xaa is any aa, unknown, or other
  misc_feature (84)..(84): Xaa is any aa, unknown, or other
MGAFAKEEHQFLAELGLAQRNPGAFACGAWGGSGPTVTSTSPTNNQVIAEVVEASVHDYEEGMRACFDXAKTWMXDPCSSGGEXRRQIGDALKAKLHHLASLCHLKWGKFLLKGTGEVRKSMTCGDYGGGTKPPLRGALYPFERPHLGGGGGGTPWGGGGG

SEQ ID NO: 31943 - DNA, 750 bp, Zea mays
  misc_feature: Ceres CLONE 1408498-F
  misc_feature: Encodes the peptide sequence at SEQ ID NO. 31944
  misc_feature (363)..(363): n is a, c, t, g, unknown, or other
  misc_feature (560)..(560): n is a, c, t, g, unknown, or other
  misc_feature (561)..(561): n is a, c, t, g, unknown, or other
  misc_feature (563)..(563): n is a, c, t, g, unknown, or other
  misc_feature (564)..(564): n is a, c, t, g, unknown, or other
  misc_feature (719)..(719): n is a, c, t, g, unknown, or other
  misc_feature (729)..(729): n is a, c, t, g, unknown, or other
tgaagctccccgcggtggcggccgctctagaactagtggatcccccgggctgcaggaattcgcacgagaccatttacctagaacatcctaatcgaaaaaagatgaatgctacgtaggtagacagtgttcttgtggtgacgtgacctccacagagtgcagagatgggagaagctgaagaagcgccaggagacagcaatggtgaggcactggagctcctcatgtccatggcgtcctcttcgctggcctgctctgtctcgcagttcccagccaagtggcagtccatcaaggacaagctccagctgctctgctgcagcctcaattcactctgcggcggcggcggtgaccacgacgacgacgacgacnaggagcatcctgtgttggctgagcttctgcggctggcttcagcaaccgtgaggagcatccaggtcgttgcttctcagtgcagcgacgggtcatacaaggggtggaaggcttcgtctgaggagcgacctggacaacctgagctgcaagctcgatgcgcacatgaagcagcttcaggagatggccgtctcgtcccgggnngnnccgtccgcgtccaagggccattggttcgccgtcaggcccagcgcgagggccaaacgtgtggggtgttgaaaaaggctttctaacctcaaggatctctttttcagggaaattcaggattcgggcggcaaccggtccaagaggagccaggcactggncgcctttctnaggggggggttgtgtttttgt

SEQ ID NO: 31944 - protein, 161 aa, Zea mays
  misc_feature: Ceres CLONE 1408498-F
  misc_feature (68)..(68): Xaa is any aa, unknown, or other
  misc_feature (134)..(134): Xaa is any aa, unknown, or other
  misc_feature (135)..(135): Xaa is any aa, unknown, or other
MGEAEEAPGDSNGEALELLMSMASSSLACSVSQFPAKWQSIKDKLQLLCCSLNSLCGGGGDHDDDDDXEHPVLAELLRLASATVRSIQVVASQCSDGSYKGWKASSEERPGQPELQARCAHEAASGDGRLVPGXXVRVQGPLVRRQAQREGQTCGVLKKAF

SEQ ID NO: 31945 - DNA, 614 bp, Zea mays
  misc_feature: Ceres CLONE 1408499-F
  misc_feature: Translation starting site: 340
  misc_feature: SWISSPROT Homolog: EC 1.2.1.3 Aldehyde dehydrogenase (NAD(+))
  misc_feature (161)..(161): n is a, c, t, g, unknown, or other
  misc_feature (245)..(245): n is a, c, t, g, unknown, or other
  misc_feature (256)..(256): n is a, c, t, g, unknown, or other
  misc_feature (566)..(566): n is a, c, t, g, unknown, or other
tccccgcggtggcggccgctctagaactagtggatcccccgggctgcaggaattcgcacgagaccattacctagaacatcctaatcgaaaaatccgctccccgccttccgcttccctaccccccgcatcacctaccaacgccgacaccatgggggccttcngcgaaggaggagcaccagttcctagccgagctcggcctcgcgcagcgcaacccaggcgcgttcgcatgcggtgcgtggggcggntcaggtcccancgtcacctccacgagccccgaccgacaatcaggtcattcgaaaggttctgggaaggctcccgtggacaactaccaaggagggaatggcccccctggttccaatgcccccagaaaatggaatggggattcctggtcccaaggggggaaaaatctttttagcgaaaccggggggtgcccttggaaaaaaaaatcccctccccctgggggggggttggggcccctttaaattggggaaaaaatctttcctagaggggggcgggggggggttcaaaaaaaacccccccctggggggtgatattggggggggggncaaaaccccccccccaaaagggggggccttttttaacccggggggggg

SEQ ID NO: 31946 - DNA, 602 bp, Zea mays
  misc_feature: Ceres CLONE 1408501-F
  misc_feature: Encodes the peptide sequence at SEQ ID NO. 31947
  misc_feature (202)..(202): n is a, c, t, g, unknown, or other
  misc_feature (229)..(229): n is a, c, t, g, unknown, or other
  misc_feature (278)..(278): n is a, c, t, g, unknown, or other
  misc_feature (284)..(284): n is a, c, t, g, unknown, or other
  misc_feature (299)..(299): n is a, c, t, g, unknown, or other
  misc_feature (320)..(320): n is a, c, t, g, unknown, or other
  misc_feature (332)..(332): n is a, c, t, g, unknown, or other
ggagctccccgcggtggcggccgctctagaactagtggatcccccgggctgcaggaattcgcacgagaccattacctagaacatcctaatcgaaaaaatgccacattgccaccaagccacagttccacctttcgattcatgcacgctcagtcatgggcgccctccggagtttagccatctcctacccggagttcctcgtggncgggctgtgcttcgtctccctctcggncctgcgccacgcgatgcgtgagcggcggcacgcgcccccctgagctggnctgtgntgggcatgctcccgntcgtgctcgcgaacctcgggngcctctacgacngcatcaccgacggcctccacggggttcgggtgcacgctcatggttccgcgggcgtgggctcggcccggccgactccctgctgacgggggaacccgggggccgttcaaaattggctggggtcaaaccagggggttaaaaaaggggcccaaaaattttggggaaatttcaacctccctggcaaaggctttttggttcggacccccccctttgggggggcgccaaagggaaaatttcccccacctttttgaaacccccgcggggtttccgctc

SEQ ID NO: 31947 - protein, 39 aa, Zea mays
  misc_feature: Ceres CLONE 1408501-F
  misc_feature (17)..(17): Xaa is any aa, unknown, or other
  misc_feature (26)..(26): Xaa is any aa, unknown, or other
MGALRSLAISYPEFLVXGLCFVSLSXLRHAMRERRHAPP

SEQ ID NO: 31948 - DNA, 713 bp, Zea mays
  misc_feature: Ceres CLONE 1408503-F
  misc_feature: Translation starting site: 116
  misc_feature: SWISSPROT Homolog: EC 2.3.1.92 Sinapoylglucose--malate O-sinapoyltransferase
  misc_feature (253)..(253): n is a, c, t, g, unknown, or other
  misc_feature (704)..(704): n is a, c, t, g, unknown, or other
tggagctccccgcggtggcggccgctctagaactagtggatcccccgggctgcaggaattcgcacgagaccattacctagaacatcctaatcgaaaactctcgctttctctagccatgacgctggtgaggatgccttgccgcctctgctgcttcctgctcgtcgtcgccgcctccgccgtctccgggcgggggcgggtggtcaccaccctcccgggctacgagggccgcctccccttccacctcgaaacaggntatgtggaggtggacgaggacgccggcgcggagctcttctactacttcgtccgggccgagtccggcgccgacgacagcgacaccccgttcgtcctccggatccccggcggccaacgctgctccgccttcagcggcctcgcctacgagataggtcccatcatggttcgtcgtggagccctacaacggcagcttgccgcgcctgcgctacaacccaaactcgtggacaaaggtgggcgcatattctttttgtggattcgcagttggggggccgggttttccttctccagagatgccaaaggctacacgggctggagcggtatcaccacgctgcaccttggcgaaagttcctcaacaagtggttcaacgacccatcctgagtaccatgcaattctacatcgatggagaatcatacgctgggaaaaattgtaccattccttgcacagatgatttncagaaggta

SEQ ID NO: 31949 - DNA, 731 bp, Zea mays
  misc_feature: Ceres CLONE 1408510-F
  misc_feature: Encodes the peptide sequence at SEQ ID NO. 31950
  misc_feature (341)..(341): n is a, c, t, g, unknown, or other
aaagctggagctccccgcggtggcggccgctctagaactagtggatcccccgggctgcaggaattcgcacgagaccattacctagaacatcctaatcgaaaaaattgggaatttctcctcgccgcctcgtctctgccgggctcgctcgtacgtcactccccacccgcaatggaggacactttcgccctcctccttctcctgatcctgtcctcgtcgatccgcaccgtctccgacgccgtgaagtcgagaatcaccttcggatcctgcgacaaccagagcgagccacatcccatttgcaacgccgtcgcggggtacgaccctgaggaggtcatctggttcgnatacgacgactagcgtgatacaacgacccattccaggttgttcaaagcaaccgaaccgttgagccctggaaaaaagaagtgggtttctacccttacaccgaggagaatttgcgaaagctggaactatttaaccagggtgaaagctggaaaacgccagcctcaagaaagaagtattcatgtttcttaaaaaagggaaaggcccaggactaacggggcggaatgtaggcatggataagaaaatcattgggaaaaagggattgctccaagggacctatgttaatatgtttttggaagaaccccgaaggaaccaaaaacggttgcaaaacaaccgtttggtttaaggcccaaaaaacttgtttgggcccatagaagaaaaagcggggaaaagtg

SEQ ID NO: 31950 - protein, 61 aa, Zea mays
  misc_feature: Ceres CLONE 1408510-F
  misc_feature (58)..(58): Xaa is any aa, unknown, or other
MEDTFALLLLLILSSSIRTVSDAVKSRITFGSCDNQSEPHPICNAVAGYDPEEVIWFXYDD

SEQ ID NO: 31951 - DNA, 706 bp, Zea mays
  misc_feature: Ceres CLONE 1408513-F
  misc_feature: Encodes the peptide sequence at SEQ ID NO. 31952
  misc_feature (497)..(497): n is a, c, t, g, unknown, or other
  misc_feature (589)..(589): n is a, c, t, g, unknown, or other
  misc_feature (638)..(638): n is a, c, t, g, unknown, or other
  misc_feature (661)..(661): n is a, c, t, g, unknown, or other
  misc_feature (697)..(697): n is a, c, t, g, unknown, or other
ggagctccccgcggtggcggccgctctagaactagtggatcccccgggctgcaggaattcgcacgagaccattacctagaacatcctaattgaaaaacacaaaagagagaaccggcggcgagctaggagctagccatggacggacacggcgcggtctcaccgtggagcgtgctaggcggggcggcggctgtgctgctcctgtggttggcgtcgcaggtgctggagtgggcctggtgggcgccccggcgcgtgaaccgtgcgctgagggcgcagggcctgaggggcacccggtaccgcctcctctgcggcgacctcatcgaggagcagcgtctccgcgcggcggccctggcaaggcccgtccccgtggatcggccacacgacttcgtccctcgcgtcgcgcctttccttcaccgcgtcctccaagagcacggcaagctctcgtttacatggtttgggccgaccccaagagttctaatcaccgatcccgagcttgcccngggaagtgctgtcgaataagtgtggcgacttcgtgaagtcgctgctctctcccctgtcaacgctgctggttgctgggctcgtcgtccttgancgtgaaaagtgatcaagcatcgaaggattctgaatccgcattcacgcgnagaagctgagggaatgctgccgncattctagcatgtgcaccgactggttgacagatggnagaacagat

SEQ ID NO: 31952 - protein, 126 aa, Zea mays
  misc_feature: Ceres CLONE 1408513-F
  misc_feature: SWISSPROT Homolog: EC 1.3.3.9 Secologanin synthase
  misc_feature (121)..(121): Xaa is any aa, unknown, or other
MDGHGAVSPWSVLGGAAAVLLLWLASQVLEWAWWAPRRVNRALRAQGLRGTRYRLLCGDLIEEQRLRAAALARPVPVDRPHDFVPRVAPFLHRVLQEHGKLSFTWFGPTPRVLITDPELAXGSAVE

SEQ ID NO: 31953 - DNA, 709 bp, Zea mays
  misc_feature: Ceres CLONE 1408521-F
  misc_feature: Encodes the peptide sequence at SEQ ID NO. 31954
  misc_feature (505)..(505): n is a, c, t, g, unknown, or other
  misc_feature (506)..(506): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (577)..(577): n is a, c, t, g, unknown, or other
  misc_feature (618)..(618): n is a, c, t, g, unknown, or other
  misc_feature (694)..(694): n is a, c, t, g, unknown, or other
  misc_feature (700)..(700): n is a, c, t, g, unknown, or other
tggagctccccgcggtggcggccgctctagaactagtggatcccccgggctgcaggaattcgcacgagaccattacctagaacatcctaatcgaaaaaccctgtccctttccccgcgccaccgccctctccgtcgccgccgttcgaccgagcgccgctcacccaccccacgagctcccgcgcgggttcatgtccatctctccacacgaacgcaccggaggagcctattacccgcgcccgcacaaccctagccctagtccccaacatggcagcgacagacgccgccacggccgccgctcccctccggcatccgtctcgccacccggcgccgctgcggaagctagcgacggcggggtcggctcgagctccaacccagtggttccagctattggagaatctattaatgctcccgaaaaggtagttggatttataatatctggggaagagaatgatacatgtacacaagaggttggcaatgtttcagaatgccactcttcagaacaggnnggattccggtttgcctgtagatatttttgggctcagttgggtcatatcctgagagacctannnatggtggnatcccttcaggctgacatttttggcttcaggttctactggnactggggtaatgggactcagatagctgccaggaagaatcagaccgtgaatgctaatcacctactgaattttccagnatgatncctatttct

SEQ ID NO: 31954 - protein, 168 aa, Zea mays
  misc_feature: Ceres CLONE 1408521-F
  misc_feature (106)..(106): Xaa is any aa, unknown, or other
  misc_feature (127)..(127): Xaa is any aa, unknown, or other
  misc_feature (130)..(130): Xaa is any aa, unknown, or other
  misc_feature (144)..(144): Xaa is any aa, unknown, or other
MSISPHERTGGAYYPRPHNPSPSPQHGSDRRRHGRRSPPASVSPPGAAAEASDGGVGSSSNPVVPAIGESINAPEKVVGFIISGEENDTCTQEVGNVSECHSSEQXGFRFACRYFWAQLGHILRDLXMVXSLQADIFGFRFYWXWGNGTQIAARKNQTVNANHLLNFP

SEQ ID NO: 31955 - DNA, 720 bp, Zea mays
  misc_feature: Ceres CLONE 1408525-F
  misc_feature (501)..(501): n is a, c, t, g, unknown, or other
  misc_feature (568)..(568): n is a, c, t, g, unknown, or other
  misc_feature (591)..(591): n is a, c, t, g, unknown, or other
  misc_feature (592)..(592): n is a, c, t, g, unknown, or other
  misc_feature (618)..(618): n is a, c, t, g, unknown, or other
  misc_feature (676)..(676): n is a, c, t, g, unknown, or other
aaagctggagctccccgcggtggcggccgctctagaacaagtggatcccccgggctgcaggaattcgcacgagaccatttaccttgaacatcctaatcgaaaaagactcttagtgtaccccagtcccggggtctaagtctgagggccgttcccattggccaaccgggcgaggccacttccacgccattctaacattgaccagcagcttcccattgacccttgacaagtgggcgcacctcgtcaaggagtacgcctcgcaatccttgctccgggaagccgcccttcgtctaacgccaggaacctgccccgccggacgcaccaccagccccttcctccccgtcctcctcaaggccgccgctgcctcctccccgaccgagctaggtctcggcaagtccctccatgcggaggccctcaagtccgcctttgcccgcgatctgctcgtcggcaccacgatcgtgtcgatgtactgcaagtgtggcgcactcgccgacgcgcgcaggncgttcgacgaaatgccggaccggaacgtcatcagttagcacgcgcttctcgccgggtacgccgtggncggggacatggacggtgccctgnnctctgttcggtggcatgcgctcctgnacgcacgtcacgtgggcgacgcttgatccgccgttttcgcgaagaagccgacatgcgnagggtttccggagggttgttcgagccccgcccccccgggatgga

SEQ ID NO: 31956 - DNA, 678 bp, Zea mays
  misc_feature: Ceres CLONE 1408527-F
  misc_feature: Translation starting site: 396
  misc_feature: Pfam Name: Peptidase_S8 Pfam Description: Subtilase family
tggagctccccgcggtggcggccgctctagaactagtggatcccccgggctgcaggaattcgcacgagaccattacctagaacatcctaatcgaaaaattccgcgccgcatctgggaaggtctcgtcttgctcgcctcccgtccgtcgccgcaccctgcgtcgtcgccatggccacgacgcagggtgcggcggcggccggagtgttcgtctcttgctccgccgggaactccggcccatccggatccaccgtctcaaacttccgctccgtgggtcgccaccgtcggcgccgggacactggaccgcgacttcccggcatacgtgatgctccccacgggtgctgcgcctggccggcgtgtccctctacgcggtgccttctccctccccacgccccgccatgctcccgctcctctacggaagcgggcgtgacaacgccagcaagctctgcctctccgggacgctcgacccggccgccgtgcgcgacaaaatagttgtgtgcgaccgcgtcgacaacgcgcgcgtggagaaggacgccgtcggtgaacgaggccgtcgccgccgagatgatactgacgaacacgctagccagcgaagagaagctcgagatgaacagccacctgctcctcccggtgtcgatgtcgaaactgcgacgaccacaagatacaggagtactgctccgg

SEQ ID NO: 31957 - DNA, 690 bp, Zea mays
  misc_feature: Ceres CLONE 1408530-F
  misc_feature: Encodes the peptide sequence at SEQ ID NO. 31958
  misc_feature (358)..(358): n is a, c, t, g, unknown, or other
  misc_feature (370)..(370): n is a, c, t, g, unknown, or other
  misc_feature (377)..(377): n is a, c, t, g, unknown, or other
  misc_feature (379)..(379): n is a, c, t, g, unknown, or other
  misc_feature (386)..(386): n is a, c, t, g, unknown, or other
  misc_feature (422)..(422): n is a, c, t, g, unknown, or other
  misc_feature (425)..(425): n is a, c, t, g, unknown, or other
  misc_feature (426)..(426): n is a, c, t, g, unknown, or other
  misc_feature (474)..(474): n is a, c, t, g, unknown, or other
tggagctccccgcggtggcggccgctctagaactagtggatcccccgggctgcaggaattcgcacgagaccatacctagaacatcctaatcaaaaagccgtaccaatccccatcgccccagaccacagcgcgacagtgagtacagcagcagcagctgagagcgtgagagcgtgcgaagcaggagggaggacaagaagaagccgatggcggttgtgagcggcagcggcgggaggctgaacccctgggcggagcccttcgtgccttccgggcgcggtacgcggcctgcggaccgtgagcgacgcggagcaggaggtggagacttctccccgagtgtggcgcctggtgtccgcctccccgnctttcgcgacgntggtgcncnagtacgngcgctcgcctactcgacggcgagacgactggacganacnntcacggttcctccccgagattcttttcccttcgccccgggttaaaaanaaggggaggacccccgggaaaggaggcggcccagggtttttgggggccccggggcaccccagggggggggggggccccggggggccccaaacccccggatcctgggaaagggccccccgggggggggcccccccccccggggaccccctcccccttctgggggggggtggggggagccccctccctttcccccccggggggttttcaagggggact

SEQ ID NO: 31958 - protein, 88 aa, Zea mays
  misc_feature: Ceres CLONE 1408530-F
  misc_feature (52)..(52): Xaa is any aa, unknown, or other
  misc_feature (56)..(56): Xaa is any aa, unknown, or other
  misc_feature (59)..(59): Xaa is any aa, unknown, or other
  misc_feature (73)..(73): Xaa is any aa, unknown, or other
  misc_feature (75)..(75): Xaa is any aa, unknown, or other
MAVVSGSGGRLNPWAEPFVPSGRGTRPADRERRGAGGGDFSPSVAPGVRLPXFRDXGAXVRALAYSTARRLDXTXTVPPRDSFPFAPG

SEQ ID NO: 31959 - DNA, 648 bp, Zea mays
  misc_feature: Ceres CLONE 1408532-F
  misc_feature: Translation starting site: 200
  misc_feature: SWISSPROT Homolog: EC 2.3.1.97 Glycylpeptide N-tetradecanoyltransferase
  misc_feature (337)..(337): n is a, c, t, g, unknown, or other
  misc_feature (413)..(413): n is a, c, t, g, unknown, or other
  misc_feature (444)..(444): n is a, c, t, g, unknown, or other
  misc_feature (457)..(457): n is a, c, t, g, unknown, or other
tggagctccccgcggtggcggccgctctagaactagtggatcccccgggctgcaggaattcgcacgagaccattacctagaacatcctaatcgaaaaacaagacgagatctacccgctgccccctcgcattcccctcccccgcgtcgtcatctccccaaatccccccaaaccctaccgccgatccggccccagatcgccatggccgcgcccaacagcaatgacgccgccagcgccagcggcaccggcccggctggcgaggaggacatctccatcgaggcgttggcgcggcgcgtgcaagagcacatgaccctcaactcgaaccccgccgctcgccgncacaagttctgggagacacagcccgtcggccagttccgcgacgccgccgacgcatcgctaccgaacggccccatcngagccgcccacgcacttctccgaggtgcgcngcgacccctaccnactggccgccgccttcgagtgggtcaactggcgactcgatggacgacggggtcctcggcgacctctactcgttgctcgcccacactacctcgaggatgacgagaaactggttcgtttaaatactccccggctttccttcggtgggggttaaaccggcgtccttttttcggggctgaaaaattggggttcgg

SEQ ID NO: 31960 - DNA, 661 bp, Zea mays
  misc_feature: Ceres CLONE 1408533-F
  misc_feature: Encodes the peptide sequence at SEQ ID NO. 31961
  misc_feature (386)..(386): n is a, c, t, g, unknown, or other
  misc_feature (402)..(402): n is a, c, t, g, unknown, or other
aagctggagctccccgcggtggcggccgctctagaactagtggatcccccgggctgcaggaattcgcacgagaccattacctagaacatcctaatcgaaaaagagcagagctgcctccagacgagacgaggaggacgcggcgccgctcgggcttggcagcaaccagcgtcgagcgcagtgcccttctgtctcctatctccccgctgcccagccgggtctcactttccagtctccgagactctgagtctcgctcgcaccccgtcccccgcagcctgtgctctgggttggagggaggtgagctgcgagggagcgcggagggggcgaggagatggaggcagattcggcgaggaagagacttgcattgctggccctgcttctcctggcgncgcccgtccgcccggnctcggcggctccggtggaggatgggctgctcagcatggtgactttgaacagcaccaagtggtgggtttgtaaatctgcgtctggtgctgagggtgcatcgtcaatccctggggtgaacgatcaacgggaacggttgaacttcatttcagcagggcaccaccagggggggcatgatccctgattgttcccacaggggggaccatgcgataagggctaagggaatgatgctctaccgttgggcaagggggggacactttta

SEQ ID NO: 31961 - protein, 84 aa, Zea mays
  misc_feature: Ceres CLONE 1408533-F
  misc_feature (20)..(20): Xaa is any aa, unknown, or other
  misc_feature (25)..(25): Xaa is any aa, unknown, or other
MEADSARKRLALLALLLLAXPVRPXSAAPVEDGLLSMVTLNSTKWWVCKSASGAEGASSIPGVNDQRERLNFISAGHHQGGHDP

SEQ ID NO: 31962 - DNA, 674 bp, Zea mays
  misc_feature: Ceres CLONE 1408539-F
  misc_feature (283)..(283): n is a, c, t, g, unknown, or other
  misc_feature (352)..(352): n is a, c, t, g, unknown, or other
  misc_feature (410)..(410): n is a, c, t, g, unknown, or other
tggagctccccgcggtggcggccgctctagaactagtggatcccccgggctgcaggaattcgcacgagaccattacctagaacatctaatcaaaaaattgaaattcccacgcgcccgtcgtttgccaccttccccaccagcaccaagcggcgagagcgggacggggcagagcaagagctagggataaccctcgcccaccatggcgacgcccggcgagcagcaggcaccggctgcggcggagtaggtcgtgtccgtcgagatggctggcaccgacgggtggacnagaaagttactccccagagagggggaagatccgaggatggtttttggttcgcaactgggcgaggaattnagaaccagagggcactaagcccatacctaaaggggacaccctgggaggccctggtgcntcacaattttgattgggggaactggtgatacccccaagcggttctggtcgcattaacgagaaaggcaagggtttttgaatgcccagaggggggaaaaatcccgaaaacgcacagggaatcccgtggtagaaagggtaagccgggaaaaaaaggaaaccccgggaactggaaaaagccaagaaggttgaaccggggcaggaccgcccagggggaaatggaccaaaggaaactggaccgggaaattaacccggtgaaaagaggaag

SEQ ID NO: 31963 - DNA, 714 bp, Zea mays
  misc_feature: Ceres CLONE 1408540-F
  misc_feature: Encodes the peptide sequence at SEQ ID NO. 31964
  misc_feature (433)..(433): n is a, c, t, g, unknown, or other
  misc_feature (608)..(608): n is a, c, t, g, unknown, or other
  misc_feature (623)..(623): n is a, c, t, g, unknown, or other
  misc_feature (634)..(634): n is a, c, t, g, unknown, or other
  misc_feature (658)..(658): n is a, c, t, g, unknown, or other
  misc_feature (659)..(659): n is a, c, t, g, unknown, or other
  misc_feature (669)..(669): n is a, c, t, g, unknown, or other
  misc_feature (671)..(671): n is a, c, t, g, unknown, or other
tgaagctccccgcggtggcggccgctctagaactagtggattccccgggctgcaggaattcgcacgagaccatttacctagaacatcctaatcgaaaaattatccccagcttttttctccaagcgtccgttcaggaagttgtccggcaacgagccgctcggcactgggcggtggccgtgcaagagcgatcgggaccgcatcgctcgtctgctcctccaggcctccgcctccctcatcatcactgcagcggcgagaagaacaagggacggtccggcggtggtctccactgacatcgcctaccatggctaccatgctgcgccggtgcatgcgggatctgcgcccgctgcggtctctcgcgagggtccccagaccgatcttcttcgagagtccaacatttcttaaatgtagaagcaactcaacaaaggcatctccnaagagttctacacagaatgctgccccaggtcctcaaggacaaccttctcagtcgggaagtaatgtttcagagcttgctcttggaaactcttgtggtcggtgcagcagctataggtgcacatcaacttggttatatagatcttttcatttaggacaagacattgccttttagcttnaagaaaggagatgtncggaaggtggntatatgaagatctgaagatccttnnctgacagaangntgacccagacacaaacatgtcaggaccaaacactgagattgtt

SEQ ID NO: 31964 - protein, 97 aa, Zea mays
  misc_feature: Ceres CLONE 1408540-F
MLRRCMRDLRPLRSLARVPRPIFFESPTFLKCRSNSTKASPKSSTQNAAPGPQGQPSQSGSNVSELALGNSCGRCSSYRCTSTWLYRSFHLGQDIAF

SEQ ID NO: 31965 - DNA, 544 bp, Zea mays
  misc_feature: Ceres CLONE 1408548-F
  misc_feature: Encodes the peptide sequence at SEQ ID NO. 31966
  misc_feature (311)..(311): n is a, c, t, g, unknown, or other
  misc_feature (319)..(319): n is a, c, t, g, unknown, or other
  misc_feature (341)..(341): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
aagctggagctccccgcggtggcggccgctctagaactagtggatcccccgggctgcaggaattcgcacgagaccattacctagaacatcctaatcgaagaatctagccagcccaatccacatcaccagcccacctcgtcgaactcgtcgtcttccgtccatcctcgtcgtcggcggcggcggagagagagcagatgacgtcctcggggacggtcgcgcagcagctgccgcggacggaggcgcggtcgctgtcgggtcacgagggagcggtgttggtcgtgcggttcaaccgggacggcaatactgcctgnagtgcggnaggacgcactctccgctctggnatctccacgggcgtcaggtcaagacctaccagttccacgcccggcggggcccggaattgtgccttctttcctcggataaaaggcccaaaattggggtggttttgggggggggggccacaaattggggggnnnnnnnnnnnnnnnnnnnnnnnnnnnnnnnnnnnnnnnnnnnnnnnnnnnnnnnnnnnnnnnnnnnnnnnnnn

SEQ ID NO: 31966 - protein, 92 aa, Zea mays
  misc_feature: Ceres CLONE 1408548-F
  misc_feature (39)..(39): Xaa is any aa, unknown, or other
  misc_feature (42)..(42): Xaa is any aa, unknown, or other
MTSSGTVAQQLPRTEARSLSGHEGAVLVVRFNRDGNTAXSAXGRTLRSGISTGVRSRPTSSTPGGARNCAFFPRIKGPKLGWFWGGGPQIGG

SEQ ID NO: 31967 - DNA, 687 bp, Zea mays
  misc_feature: Ceres CLONE 1408551-F
  misc_feature: Encodes the peptide sequence at SEQ ID NO. 31968
  misc_feature (430)..(430): n is a, c, t, g, unknown, or other
  misc_feature (431)..(431): n is a, c, t, g, unknown, or other
  misc_feature (561)..(561): n is a, c, t, g, unknown, or other
tccccgcggtggcggccgctctagaactagtggatcccccggctgcaggaattcgcacgagaccattacctagaacatcctaatcgaaaactctcattccagaggactccgcgtcgtcaggcccgcttcgcgtgcgacgccggcatatagggtttcgccggcgccggcgatggacccaccccccgtgagccccgatcgctgggggcccagtcagggctctggcgtcgggccctccggcctccgccgatatggcctcaatttctccgcctccagcctcctccaggcccccatcgcggccctccttgagtactccggcgtagtccagtccggccctgccctggcggcgcaccacccgtccgcggggccctcgtcgccgttgtcggcgtcggaggtcgatggtcttctctccgctgccgccgctggggacggnngaggtttcgatccggattcagggcggcccaggcgacacggaggccacgggcgggccggatggcgggactcgtccgagggattgatcgaggcgaccgccggctctgagggtgaccaggcctcgctgcgggnaggggtgcaggcgctacggatgcgagggcaacggtggcggggcggcacgtcggggaacggggggcgggaccgcgcgtacagggctacgagtgacaagtttgggggttggtcgacaagatattgccg

SEQ ID NO: 31968 - protein, 172 aa, Zea mays
  misc_feature: Ceres CLONE 1408551-F
  misc_feature (88)..(88): Xaa is any aa, unknown, or other
  misc_feature (131)..(131): Xaa is any aa, unknown, or other
MDPPPVSPDRWGPSQGSGVGPSGLRRYGLNFSASSLLQAPIAALLEYSGVVQSGPALAAHHPSAGPSSPLSASEVDGLLSAAAAGDGXGFDPDSGRPRRHGGHGRAGWRDSSEGLIEATAGSEGDQASLRXGVQALRMRGQRWRGGTSGNGGRDRAYRATSDKFGGWSTRYC

SEQ ID NO: 31969 - DNA, 786 bp, Zea mays
  misc_feature: Ceres CLONE 1408553-F
ggagctccccgcggtggcggccgctctataactagtggatcccccgggctgcaggaattcgcacgagaccattacctagaacatcctaatcgaaaactcccggtccttctggacgcgacagcacaccacctctacgaagcatctcgaactctcggtgccgctcaatttgtacccccaatccccttccacacaccgcctcggcacatcgcagagccagagcaagggaagacgacgcacatctcgccacgcgaacacagttagatcgagggagtaagtgtgagtgagaaccatgacggaactgttcgacacggccgagaacagccctccctccacctgccggaggggcttgggaaccggctctcccccccccaacggggaccggagggtcggtcggacaacaccgggggggaagggcccccggccacgccccacgggcccgggaacttgaacactgcgttcccggggggagacaaaacagcctcgggggcacaatgtgggaaaagcccccccccgggaacaggctttttttggctcaaaggggcccgcgcccacccccaagcccaaacattctattgtaacacccttaaagcaaacaaccccctgccccgtgaatttaaagaggcggcccacggcggaaaacgtaacaaaccccctcaaagccccggtacaaatttaaacccagcggagaggtgttccaaaaaaacctcccccccatgcaacctcacgaaaacgcgctataaaccgcaggaccctataggcgcacaaaaataaaaggcattgtcaggg

SEQ ID NO: 31970 - DNA, 688 bp, Zea mays
  misc_feature: Ceres CLONE 1408555-F
  misc_feature: Encodes the peptide sequence at SEQ ID NO. 31971
aaagctggagctccccgcggtggcggccgctctagaactagtggatcccccgggctgcaggaattcgcacgagaccattacctagaacatcctaatcgaaaaaccggtctcttctccctaatcctggtaatcagcagcagccactagcgctgctgccgttctcttcccctacccgacacaagctccaccacctctatctaccacacgccaccactgtaggagctcctccacgatcatcccgccctagagccataataattcgttgaagaggagggggttcttagaaccagagggcggctacctgtgaaggatacccgcgctgctggctgctgctgctcctcgagctacagacgtgtgtggcctgtgcagattgcagagcgcagcttccagactcagcattgctctcaatggggaggcactcctgctgttacaagcagaagctgaggaaggtgctctgctctcctgaggcagatgagaagctcatgactcacataaccaagcactggcatgactgctggagcactgctcccaagcttgcaggacttcagaggtgtggcatgagctgcaggctgaggtgaatcaaatacctgacgcctgacgtcagaagagtgcattctctgaggaggaggaagactcatcgtccaactcatgctgtactggggaacagtcgtctcagattgcaccaggt

SEQ ID NO: 31971 - protein, 56 aa, Zea mays
  misc_feature: Ceres CLONE 1408555-F
  misc_feature: The sequence is a functional homolog of SEQ ID NO 1863 in the 10/374,780 US patent application
MGRHSCCYKQKLRKVLCSPEADEKLMTHITKHWHDCWSTAPKLAGLQRCGMSCRLR

SEQ ID NO: 31972 - DNA, 696 bp, Zea mays
  misc_feature: Ceres CLONE 1408560-F
  misc_feature: Encodes the peptide sequence at SEQ ID NO. 31973
  misc_feature (333)..(333): n is a, c, t, g, unknown, or other
  misc_feature (407)..(407): n is a, c, t, g, unknown, or other
  misc_feature (493)..(493): n is a, c, t, g, unknown, or other
  misc_feature (494)..(494): n is a, c, t, g, unknown, or other
  misc_feature (513)..(513): n is a, c, t, g, unknown, or other
  misc_feature (531)..(531): n is a, c, t, g, unknown, or other
  misc_feature (653)..(653): n is a, c, t, g, unknown, or other
  misc_feature (664)..(664): n is a, c, t, g, unknown, or other
  misc_feature (665)..(665): n is a, c, t, g, unknown, or other
  misc_feature (673)..(673): n is a, c, t, g, unknown, or other
  misc_feature (678)..(678): n is a, c, t, g, unknown, or other
  misc_feature (683)..(683): n is a, c, t, g, unknown, or other
aaagctggagctccccgcggtggcggccgctctagaactagtggatcccccgggctgcaggaattcgcacgagaccattacctagaacatcctaatccaaaagaaggggaggaatcccttcctccgcgagtcgcgagccgtggagatccgtcccactccacccctccgctccgccccagacctcgctacaaacctgccgcgaaaatagcagccgcccgtttgctctctcccgtctccgcactcctcccgcgatgagcgacccgcggggccgcgccgccggtcccgaccgctacggggacgaaccgcacgacctcccgctcgccgaggacgcanacggcgaggaagcgtggcagacgcccgagaaagaggcggttgccgtgtcggaaggggccgctgcgcggagtggngatacgaccccggacgctgaacaggagagcgatgacggagaggaaggagtgtgctccccggatcaggcggaaccccatgcgagcgnngagggcgtaccgcccgtgnccgcgactgtggagccgnatgggatttgtagcggcgcaaaggtggagacgaacagcgaggacgcatcacatggaccccccgacgagggaggaggaggacgacgacgatgactccccccaggatgcgtctccgatagccgnagtgaatgtgnnagggcganagtgnccccnttcaccgctggga

SEQ ID NO: 31973 - protein, 123 aa, Zea mays
  misc_feature: Ceres CLONE 1408560-F
  misc_feature (28)..(28): Xaa is any aa, unknown, or other
  misc_feature (81)..(81): Xaa is any aa, unknown, or other
  misc_feature (88)..(88): Xaa is any aa, unknown, or other
  misc_feature (94)..(94): Xaa is any aa, unknown, or other
MSDPRGRAAGPDRYGDEPHDLPLAEDAXGEEAWQTPEKEAVAVSEGAAARSGDTTPDAEQESDDGEEGVCSPDQAEPHASXEGVPPVXATVEPXGICSGAKVETNSEDASHGPPDEGGGGRRR

SEQ ID NO: 31974 - DNA, 692 bp, Zea mays
  misc_feature: Ceres CLONE 1408562-F
  misc_feature: Encodes the peptide sequence at SEQ ID NO. 31975
  misc_feature (334)..(334): n is a, c, t, g, unknown, or other
  misc_feature (439)..(439): n is a, c, t, g, unknown, or other
  misc_feature (459)..(459): n is a, c, t, g, unknown, or other
  misc_feature (529)..(529): n is a, c, t, g, unknown, or other
  misc_feature (536)..(536): n is a, c, t, g, unknown, or other
  misc_feature (554)..(554): n is a, c, t, g, unknown, or other
  misc_feature (665)..(665): n is a, c, t, g, unknown, or other
ggagctccccgcggtggcggccgctctagaactagtggatcccccgggctgcaggaattcgcacgagaccattacctagaacatcctaatcgaaaaaaaacccggtttcacactagttctgtattcgtgtcctctggtctctcgcaggccaaacaaaagcgccgctgccgccggcaatgttccgccgcctcctcccccaccgtcgctacatctccacctcgcccgcctccaactccaacccgaccctctactctgacggaaccatcccattctctatcctctcgtggggccgtggcgcttccggacagctcggcggtggcaaggaggagcgccngctctacccatcccccgtcgcccacctacttctccccgaatcagacccacgccttgctcccacccccggacgccttccctctgcagaggagacgtctggagtggnaggtgggatctcttgtgggntcttccactccctcgctctcgtcgaaggaggcgcctgggtgtggggcaaagggcgacgaggccgcctcgnccctcgngacgagtcttcccgcttncgtgcccgctctaaccccaaatctcgcgatctccgcctccctgcgcttgcagcatccactcgccgcgctgacactttccgtgacgtcttcactgggggtatggtggatttngagctctggtcacatgtatacatagga

SEQ ID NO: 31975 - protein, 172 aa, Zea mays
  misc_feature: Ceres CLONE 1408562-F
  misc_feature: SWISSPROT Homolog: EC 2.7.11.1 Non-specific serine/threonine protein kinase
  misc_feature (53)..(53): Xaa is any aa, unknown, or other
  misc_feature (88)..(88): Xaa is any aa, unknown, or other
  misc_feature (95)..(95): Xaa is any aa, unknown, or other
  misc_feature (118)..(118): Xaa is any aa, unknown, or other
  misc_feature (126)..(126): Xaa is any aa, unknown, or other
  misc_feature (163)..(163): Xaa is any aa, unknown, or other
MFRRLLPHRRYISTSPASNSNPTLYSDGTIPFSILSWGRGASGQLGGGKEERXLYPSPVAHLLLPESDPRLAPTPGRLPSAEETSGVXGGISCGXFHSLALVEGGAWVWGKGRRGRLXPRDESSRXRARSNPKSRDLRLPALAASTRRADTFRDVFTGGMVDXELWSHVYIG

SEQ ID NO: 31976 - DNA, 662 bp, Zea mays
  misc_feature: Ceres CLONE 1408565-F
  misc_feature: Translation starting site: 311
  misc_feature: SWISSPROT Homolog: EC 2.7.11.1 Non-specific serine/threonine protein kinase
  misc_feature (488)..(488): n is a, c, t, g, unknown, or other
  misc_feature (569)..(569): n is a, c, t, g, unknown, or other
aagctggagctccccgcggtggcggccgctctagaactagtggatcccccgggctgcaggaattcgcacgagaccattacctagaacatcctaatcgaaaactcactatatactcactcctgctgttttccgtccatccgcccaccggttcgcagcccgcgcctcaaaaccctagccccgggcggatcgcggggcgcctccgcggtgccagcgacgcggctcgtttgatccgattgttggtcgagccccgccctcgctgccgcgcttcgctccggctgtgcagcggcgtgagcaccgagcacactcgcgaatggggaactgctggggtgcgcggatcaaggatgggagccctcaccctggcgcctcaggaatgttctcaaagagtagtggcaaggatgggagtaggcttagcggctgtagtagtcgagcctcttcagcttctatgccaccaagtgcgaagactgaatgtgaaatcctgcaatccgccnatgttaagatcttcacctatcataatctcaagcagccacaaagaatttccgtcctgatagtgtctagggtgaaggaagggntttggatctgtctataaaggatggatagatgagaacacattatcaccttgcagacctggcactggaatcgctgttgctgtgaaagactcaacc

SEQ ID NO: 31977 - DNA, 739 bp, Zea mays
  misc_feature: Ceres CLONE 1408566-F
  misc_feature: Encodes the peptide sequence at SEQ ID NO. 31978
  misc_feature (362)..(362): n is a, c, t, g, unknown, or other
  misc_feature (394)..(394): n is a, c, t, g, unknown, or other
  misc_feature (398)..(398): n is a, c, t, g, unknown, or other
  misc_feature (399)..(399): n is a, c, t, g, unknown, or other
  misc_feature (448)..(448): n is a, c, t, g, unknown, or other
aagctggagctccccgcggtggcggccgctctagaactagtggatcccccgggctgcaggaattcgcacgagaccattacctagaacatcctaatcgaaaaaaccggccggcttccctcgcccccggcgaggagtgaagacaagccgacaaggcaaaaccattcgcctgtacggtatccaaccgccgtcccgccgcacaaccaaggatagggcgggagagggggatctcgctttcgctccgctgccgcatgcgcaccgcccctcctcatgacaccaactagggcaccaccagcccccttctcgtcgacctccgcgcggtgactctgctgagcatcatacccttatagggcccgacccatggnatgtacttcgacccgctgcgcctcccgctcangcgnnggtaggtggtacacgggcatgtccgcggataacaatcagggcctggtgntcgggctcttcctccagcttctcatcggggccgggttcataatcaggaagagggactcaagaggcccgaatcctcgggggaaaagggggggttgggggttatcttaatttattgaacctttttgggggggttggctgaaaaaaaggttgtgtgaaaaatttaaatttcccccttttggttttgccccggaaattttgcacccccttccggggcttaaaattaataaacccttttgtttcacaattaaaggtgtggaaaaaccccccaattttggaatttgggggggccggt

SEQ ID NO: 31978 - protein, 65 aa, Zea mays
  misc_feature: Ceres CLONE 1408566-F
  misc_feature (2)..(2): Xaa is any aa, unknown, or other
  misc_feature (13)..(13): Xaa is any aa, unknown, or other
  misc_feature (14)..(14): Xaa is any aa, unknown, or other
  misc_feature (31)..(31): Xaa is any aa, unknown, or other
MXCTSTRCASRSXXGRWYTGMSADNNQGLVXGLFLQLLIGAGFIIRKRDSRGPNPRGKRGGWGLS

SEQ ID NO: 31979 - DNA, 699 bp, Zea mays
  misc_feature: Ceres CLONE 1408569-F
  misc_feature: Encodes the peptide sequence at SEQ ID NO. 31980
  misc_feature (373)..(373): n is a, c, t, g, unknown, or other
  misc_feature (534)..(534): n is a, c, t, g, unknown, or other
  misc_feature (601)..(601): n is a, c, t, g, unknown, or other
  misc_feature (638)..(638): n is a, c, t, g, unknown, or other
  misc_feature (672)..(672): n is a, c, t, g, unknown, or other
  misc_feature (677)..(677): n is a, c, t, g, unknown, or other
aaactggagctccccgcggtggcggccgctctagaactagtggatcccccgggctgcaggaattcgcacgagaccattacctagaacatcctaatcgaaaagatcgactaaaaaaaccagcagctagctagcgatggctggagcctgggcactgctcatcgtcctcgcggctgccgtcgcggtcctggccgcgcggccggcgtctgcaggcggaggagccgcggcggtggcggagatctgcatgaagactccgtcccccgacctgtgcaccatgacggcggcgaagcacgccaacaagtacaaggtggtgcacgcgatgacggtgctagagatgcaggtggacgcgttcaagaatcgcgtgaacgcgtcgcgnaggctcgccaaggaggaggtcaagacggtcgcgacgcccgaggcgcgtagggcgctgaacctctgcaagactactagctggacgccgacgaacacctcggcgcctgcaagcgcgcccatcgcttccgcgacgccgtcaccatccgcgccacgatgagcatngctggcgcacgacacgcagaactgcgacgaggagctcagggaggccgtctcaagaagcccatggagnatcacaacaggtcgctcatcgagatgtccgagatctngcgcacgctctccaaatgatccatacgaactggncaatngaatttgtttgttccttttccc

SEQ ID NO: 31980 - protein, 131 aa, Zea mays
  misc_feature: Ceres CLONE 1408569-F
MAGAWALLIVLAAAVAVLAARPASAGGGAAAVAEICMKTPSPDLCTMTAAKHANKYKVVHAMTVLEMQVDAFKNRVNASRRLAKEEVKTVATPEARRALNLCKTTSWTPTNTSAPASAPIASATPSPSAPR

SEQ ID NO: 31981 - DNA, 681 bp, Zea mays
  misc_feature: Ceres CLONE 1408570-F
  misc_feature: Encodes the peptide sequence at SEQ ID NO. 31982
  misc_feature (374)..(374): n is a, c, t, g, unknown, or other
  misc_feature (377)..(377): n is a, c, t, g, unknown, or other
  misc_feature (386)..(386): n is a, c, t, g, unknown, or other
  misc_feature (387)..(387): n is a, c, t, g, unknown, or other
  misc_feature (460)..(460): n is a, c, t, g, unknown, or other
  misc_feature (461)..(461): n is a, c, t, g, unknown, or other
  misc_feature (466)..(466): n is a, c, t, g, unknown, or other
  misc_feature (468)..(468): n is a, c, t, g, unknown, or other
  misc_feature (495)..(495): n is a, c, t, g, unknown, or other
  misc_feature (500)..(500): n is a, c, t, g, unknown, or other
  misc_feature (501)..(501): n is a, c, t, g, unknown, or other
  misc_feature (567)..(567): n is a, c, t, g, unknown, or other
  misc_feature (668)..(668): n is a, c, t, g, unknown, or other
tggagctccccgcggtggcggccgctctagaactagtggatcccccgggctgcaggaattcgcacgagaccattacctagaacatcctaatcgaaaaatcccaagaagagccgccctacctattccttctcccagccgtcgagctgcccaacccagagcaccagcagccctcaccttcttcctctcggccggtccttcaaacgagcccgctcgtcttggagccgccgccggtctcgttctggacgaacgttcaaggagattgcatttgtggatgctctaatggagtcgaaaggtggcaagaagtctagtagtagtagtagtaatttcatgtacgaagctccccttggctacaagatcgagggacgtcgcccagncgnaggaatcanngaagtccagactgctgcttattccaactgcgtcccgcagccatcctgatatcgcctcacatgcaattcgcggnnagagnangattttaattcagttttccctctgggnggcgnnagtttccccgtggctctggctgccttcctctgcttctgagaatccaactttgcctggcccatctcntctttttcctctctcatccccctttttctggcaaaacgtcatcaagggggcgatgtcttcagaagattcttggggcccctcccccggcccccccaattggntttgagggctaaa

SEQ ID NO: 31982 - protein, 51 aa, Zea mays
  misc_feature: Ceres CLONE 1408570-F
  misc_feature (1)..(51): Pfam Name: AdoMetDC_leader Pfam Description: S-adenosyl-l-methionine decarboxylase leader peptide
  misc_feature (32)..(32): Xaa is any aa, unknown, or other
  misc_feature (33)..(33): Xaa is any aa, unknown, or other
  misc_feature (36)..(36): Xaa is any aa, unknown, or other
MESKGGKKSSSSSSNFMYEAPLGYKIEGRRPXXGIXEVQTAAYSNCVPQPS

SEQ ID NO: 31983 - DNA, 688 bp, Zea mays
  misc_feature: Ceres CLONE 1408571-F
  misc_feature: Encodes the peptide sequence at SEQ ID NO. 31984
  misc_feature (493)..(493): n is a, c, t, g, unknown, or other
  misc_feature (494)..(494): n is a, c, t, g, unknown, or other
  misc_feature (610)..(610): n is a, c, t, g, unknown, or other
  misc_feature (688)..(688): n is a, c, t, g, unknown, or other
cagagctggagctccccgcggtggcggccgctctagaactagtggatcccccgggctgcaggaattcgcacgagaccattacctagaacatcctaatcgaaaagtacgcaaagccccataccccaataccggtgccgccttcgcctcgcactacacctctccctccctccgcctccatctccttcgccaccagaacccaagcgctgccccacacgccgccgcagcccgcacgggagccgcgcgccgcaccaaaaccctaggtctcctccgtcccccgatccatcgccttcatggccgcgccgcaacctgtcgcccaggcccccgaggcaccgccgtctgcgcaagtggtgggcaacgcgttcgtgcagcagtactacctcgtgctgcaccagtcaccggatctggtgtaccgcttctatcaggaggctagtcgcctcggccgccccgcatccgccgccggagccgccggcatggactccgtcaccactatggnnagcatcggcgagaagatatggagatggacgtgtcaaaagcggagatcagggacgtggactcgcaggagtcgcttgggcgcggcgtcactgtgctcgtcacagcccacctcaccggncgtgacggatgcgccgcgaagtctcgcagtctttcttctgggcgcgaggagagggctactttcgtgctcacgactgtn

SEQ ID NO: 31984 - protein, 132 aa, Zea mays
  misc_feature: Ceres CLONE 1408571-F
  misc_feature (68)..(68): Xaa is any aa, unknown, or other
  misc_feature (107)..(107): Xaa is any aa, unknown, or other
MAAPQPVAQAPEAPPSAQVVGNAFVQQYYLVLHQSPDLVYRFYQEASRLGRPASAAGAAGMDSVTTMXSIGEKIWRWTCQKRRSGTWTRRSRLGAASLCSSQPTSPXVTDAPRSLAVFLLGARRGLLSCSRL

SEQ ID NO: 31985 - DNA, 690 bp, Zea mays
  misc_feature: Ceres CLONE 1408572-F
  misc_feature (617)..(617): n is a, c, t, g, unknown, or other
  misc_feature (631)..(631): n is a, c, t, g, unknown, or other
tacccgcggtggcggccgctctagaactagtggatcccccgggctgcaggaattcgcacgagaccattacctagaacatcctaatcgaaaaaaaatagcaatttttccccctgggagcccgagacgcagcgcgaggtgcggccccgtcccctcgccaccggaggagcaggacgacgaggtggcgtcggcgcgaggtagtcgcgcgcctggaagagcggcggcatcggagtcgcaggcggaggcgaggaagtgaggggagagccctatagccaccgccgcggggcgtcgtgctcgctgcacgcactcccaccattttgtcccaactcgaagctcagactcgtgctgtcgtgctgtgcacgacccctcccctagcatcccaagctcctaactgagaaaacaggagatgggaagagacggggaacagactaggcgccggagccgcaagagatcccgcgacgcctccccctcctcgtcggattccgattccttcgactccccatcctctccgagcagtagccctgagcgacggagccgcagcagtaagcggaatagatcatcctcatcgcaccgccacagccgcaagaaaagcgaccggtcgcggagatcccgcgacgagnaccgcccggcgcgnaaaagacggggcccagagagaagcgcaccggtggggatggttgcaggtctccgactccc

SEQ ID NO: 31986 - DNA, 707 bp, Zea mays
  misc_feature: Ceres CLONE 1408573-F
  misc_feature: Translation starting site: 198
  misc_feature: SWISSPROT Homolog: EC 2.7.11.1 Non-specific serine/threonine protein kinase
  misc_feature (453)..(453): n is a, c, t, g, unknown, or other
  misc_feature (515)..(515): n is a, c, t, g, unknown, or other
  misc_feature (547)..(547): n is a, c, t, g, unknown, or other
  misc_feature (548)..(548): n is a, c, t, g, unknown, or other
  misc_feature (562)..(562): n is a, c, t, g, unknown, or other
  misc_feature (587)..(587): n is a, c, t, g, unknown, or other
  misc_feature (701)..(701): n is a, c, t, g, unknown, or other
ggcggccgctctagaactagtggatcccccgggctgcaggaattcgcacgagaccattacctagaacatcctaatcgaaaaaataagcgcaaacgcacacaagcggaggacaaacaaacagcaagagagcggaacgccgaaaggcaaaggcaaaggcaacggcaacgcaagccagaggcagagcgcgccccgccacgatgaagaaggaggaggtggcctcgccggcggcggcgacggtggtcctgctgctcctgtcgtcgtcgttggcggccgtctccggccagccacagccgcagccgcagcccgggggcagcaagcagactgcggcgaacaacccacggctgcagaaggcgtacgtggcgctgcaggctttgaagcgcgcggtgacggaggaccccaagaaccttacgcggagctggtgcgggccggacgtgtgcggctacttcggcgtgntactgcgcgggcggcgccggacgagccgcggtcgcagacggtggccgggggtggacctgaanccacgcgacctggcggggacgctccccggagnnagctggcctgctgncggacctagcgctgctgcacctcanctcgaaccggttcgcggggacgctcccggagtccctccccaggatgcggctcctgcacgagctggacgtgagcaacacccgcctctcgggcggcttcccgcagcacatcctgtngctgcc

SEQ ID NO: 31987 - DNA, 679 bp, Zea mays
  misc_feature: Ceres CLONE 1408574-F
  misc_feature (206)..(206): n is a, c, t, g, unknown, or other
  misc_feature (274)..(274): n is a, c, t, g, unknown, or other
  misc_feature (326)..(326): n is a, c, t, g, unknown, or other
  misc_feature (343)..(343): n is a, c, t, g, unknown, or other
  misc_feature (389)..(389): n is a, c, t, g, unknown, or other
  misc_feature (417)..(417): n is a, c, t, g, unknown, or other
  misc_feature (476)..(476): n is a, c, t, g, unknown, or other
  misc_feature (645)..(645): n is a, c, t, g, unknown, or other
gctcaaaactagtggatcccccgggctgcaggaattcgcacgagaccattacctagaacatcctaatcgaaaaaatgttacagcgactcggcctgccgcgatttttataatgcgccgcggtggccgtcgctagtggtacatatcagcacccgccctgcctcgaggttgcgtgttttgttctctgtgagcgccgtgggtgttgatgncgtcaacggcgtactcgcggccatccaagccgccagggccggcggccggagacaggagcggaccgcgnctggccagggagctcgcaggatcgagcccaagaaagctggcatcgggctggntgccggctgctgcttcncgctgctcacctacctctccttggcccggctgttgccatctactcngcggtttcgacagctcgtcgtccatggntgtgaagacatgccgccagcaacgacaacggtgccgggacagctacggggccgctgcgntgaagcaaaagccccagtggaggacaaaaagagttcgtgaccctgaggcggacccgacattgcaaactaccgggagtcacaaaaaagatcagcagggagggagccacgcgcacaaacccgcccggggtgccattattacaaagcccaaatccctgcgaagaagacgggntccaaaagggctcccgtaccacggcccgccgttt

SEQ ID NO: 31988 - DNA, 731 bp, Zea mays
  misc_feature: Ceres CLONE 1408575-F
  misc_feature: Encodes the peptide sequence at SEQ ID NO. 31989
  misc_feature (460)..(460): n is a, c, t, g, unknown, or other
tcaccgcggtggcggccgctctagaactagtggatcccccgggctgcaggaattcgcacgagaccattacctagaacatcctaatcgaaaaaggtaacacagcaatcagcagaaaaacatctccttggccttccatccatatgatccatccctccaggctccagctaactccaaactaccctctggttcgactcgcgttcgcatcgcaagcagcagcgtaccatcgaggcaatggcggtgatggccgaagtagtgtcgaccaccggcgcggcgctccggagcccggccacgcagcagccggcggcggcgggcgcgccgaggggcaccgacgctgagaagctccagttcatcgaggacatgaccctcaacgtggacgccgtgcaggagcgcgtgctggggaaaatcctcgcccgcaacgcgaaccccgagtacctctccagcagggtgcggcctcgccggnagctacggaacgcggccacttccgcgccaaggtgcccaatgcaaagtacaagaacctgcagcccgaaaatccggggcattggccgaggggaaccggtcccccatcctgtgggggcaccccggtttccgaagttcctcacaatctccggaacgtccgggggggaaacggaaacttcctgcccccccattgagggaaaaactcccccccccccgcagtttgtggaaacacctccccaaaatcgccctataagaacccgtgaaacgggccgggg

SEQ ID NO: 31989 - protein, 166 aa, Zea mays
  misc_feature: Ceres CLONE 1408575-F
  misc_feature (77)..(77): Xaa is any aa, unknown, or other
MAVMAEVVSTTGAALRSPATQQPAAAGAPRGTDAEKLQFIEDMTLNVDAVQERVLGKILARNANPEYLSSRVRPRRXLRNAATSAPRCPMQSTRTCSPKIRGIGRGEPVPHPVGAPRFPKFLTISGTSGGETETSCPPIEGKTPPPPQFVETPPQNRPIRTRETGR

SEQ ID NO: 31990 - DNA, 713 bp, Zea mays
  misc_feature: Ceres CLONE 1408577-F
  misc_feature: Encodes the peptide sequence at SEQ ID NO. 31991
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
aagctcaccgcggtggcggccgctctagaatagtggatcccccgggctgcaggaattcgcacgagaccattacctagaacatcctaatcaaaaaatactaccagctgctccctccctccttcccttcactcctacctctctctctctcttcctccgttcgtctcttgactcttctcttctcccatcagccagcagtctctctctctctcaacacacaagcagcgacttgctcacagtagtgctccccgaacagaatgaccaaagacgaggagttcaggctgttcaagatccagaaccatgcgctgaatgtgaacatacactgcgacgggtgcaagcacaaggtcaaagaagcttcttcagaagatcgaaggggtgtactcggtggccattgatggggacaaccacaaggtcctcggtgacggggggatgtggactccaagacccttataaggaaattcaccaggggggaaaagaacgcgaagtttgggcaccaccccaaggccggggcaaacagggccccaagggaattaatggccaaaaaaaaaaaaagaggaggcggaaaaacaaaaccaaaacccccnnnaaaaccaaaaggaggggggcaatctccgaaggggtgggaacaaaaaaaacagaaggggtgtcaaaaaggcccatgggaaaacaggggggaggggggggggtttggggcccctccttggggggccctaagg

SEQ ID NO: 31991 - protein, 45 aa, Zea mays
  misc_feature: Ceres CLONE 1408577-F
MTKDEEFRLFKIQNHALNVNIHCDGCKHKVKEASSEDRRGVLGGH

SEQ ID NO: 31992 - DNA, 698 bp, Zea mays
  misc_feature: Ceres CLONE 1408581-F
  misc_feature: Translation starting site: 179
  misc_feature (382)..(382): n is a, c, t, g, unknown, or other
  misc_feature (462)..(462): n is a, c, t, g, unknown, or other
  misc_feature (469)..(469): n is a, c, t, g, unknown, or other
  misc_feature (580)..(580): n is a, c, t, g, unknown, or other
  misc_feature (690)..(690): n is a, c, t, g, unknown, or other
aaagctggagctccccgcggtggcggccgctctagaactagtggatcccccgggctgcaggaattcgcacgagaccattacctagaacatcctaatcgaaaaaacaacagcgaacacatctgcttcgcatttcttcccatcccccttcgcaacccaaaccccaactcgctccgcatcgatggcccccaaggccgagaagaagcccgcggcgaagaagccggcggaggaggagcccgcggctgagaaggcgcccgccgggaagaagccgaaggcggagaagcggctccccgctggcaagtccgctgccaaggagggcggcgagggcaagaggggcaggaagaagggcaagaagagcgtggagacctacaagatctacatcttncaggtgctgaagcaggtgcacccggacattggcatctcctccaaggcagtgagattgtctctggaccccagagagaaggncatttantatatacatttgaaattacagaggcagaggatcatgaaaaaaaaatggtcagattgttctagatatcgagaatgcaaaatgcagcatatgcctgaatttggggcatgatgntgttactgttgctccatgcctgcacaacttctgcatggatggttctcagagtggtaagggagtcttcatctattcacgtgataaagcagagcgctgcatgcccacatgtnagacacag

SEQ ID NO: 31993 - DNA, 634 bp, Zea mays
  misc_feature: Ceres CLONE 1408584-F
  misc_feature: Encodes the peptide sequence at SEQ ID NO. 31994
  misc_feature (308)..(308): n is a, c, t, g, unknown, or other
  misc_feature (356)..(356): n is a, c, t, g, unknown, or other
  misc_feature (357)..(357): n is a, c, t, g, unknown, or other
  misc_feature (396)..(396): n is a, c, t, g, unknown, or other
tggagctccccgcggtggcggccgctctagaactagtggatcccccgggctgcaggaattcgcacgagaccattacctagtacatcctaatcgaaaaacctgccacatctggccatctctcagtctcacacgcgctgccatggacggatccatgtggtgcgctgccaactacgtgcctctgacgccgctcagcttcctggagcgcgccgcggtcgtgtacggcgacgcgcggcgtcgtttgcggcgatagcggttctcgtgcgcgaacgaaggagcgtgcctcgccgagcagcgctctcgtcgtctcngcgtggccgccgcgacgtggtcgcggtcatcgcctcgaacgtacccgnngatgtacgagcctcattttcagcgtggcgatgaacgggngccggtcctgtggacggttcaaaacccgccacgaggggggccaatgggggccggccttgctggaaaccctcggaaagccaaggtctttccctcggggagggccaaaatcccacgcccggggcccccgggaagggtttaggtttcccccccgacgcccaagaaaggggttccccctcggaataaggggtttttggcaccaaaaaaaaaaaaaaccgggggggggggtgggaaacaaaaa

SEQ ID NO: 31994 - protein, 36 aa, Zea mays
  misc_feature: Ceres CLONE 1408584-F
MDGSMWCAANYVPLTPLSFLERAAVVYGDARRRLRR

SEQ ID NO: 31995 - DNA, 707 bp, Zea mays
  misc_feature: Ceres CLONE 1408586-F
  misc_feature: Encodes the peptide sequence at SEQ ID NO. 31996
  misc_feature (524)..(524): n is a, c, t, g, unknown, or other
aaagctggagctccccgcggtggcggccgctctagaactagtggatcccccgggctgcaggaattcgcacgagaccattacctagaacatcctaatcgaaaaaacgcaaacccaactgtcttggttgcgcaagcaccaagcaggtggaagatgatggaggtggcgggggctcaggcccgcgcggttcccctcctgctccgcaacaccgcctccctgcggacctccgtctccgtctcctgcacgggctcccgccggagctgggtggcggcggccacggcggagggggacgagacccgcggcttcgacaaggtgcccatggacacccccggcgcgtaccgcctggtagaccgggacaccggccgcagcgtcatcgtgtggggcggcaccgacgacagcgacgaggcctccatgccgtccccggcggtgctctcccggaccacgaccccgcgcacagccaagggtgttgggggagtacaggtatcgggaatttcggcaggttcaaggcacagaaaataaatcctggntcacgaggtcagctcaccgcaagaggagagttctaatcgctcaagcactggctgggctgatgaatcttctttcaatggctctgatgatagagaggaaagctattttgagaggaggaagcatgtctcagactctgaacgccacccgaagatgagcagtgcctccagagatggaaaactccgagg

SEQ ID NO: 31996 - protein, 120 aa, Zea mays
  misc_feature: Ceres CLONE 1408586-F
MEVAGAQARAVPLLLRNTASLRTSVSVSCTGSRRSWVAAATAEGDETRGFDKVPMDTPGAYRLVDRDTGRSVIVWGGTDDSDEASMPSPAVLSRTTTPRTAKGVGGVQVSGISAGSRHRK

SEQ ID NO: 31997 - DNA, 677 bp, Zea mays
  misc_feature: Ceres CLONE 1408591-F
  misc_feature: Encodes the peptide sequence at SEQ ID NO. 31998
aaagctggagctccccgcggtggcggccgctctagaactagtggatcccccgggctgcaggaattcgcacgagaccattacctagaacatcctaatcaaaagtcgcatcgcacgccatcagcagctagcgcgctcctcgagcccagcagagaaaggccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgcagaaggaggccggcggcggcaaggcggcgctggcgcccgaggaggtggtggcgcggatgcccgcggcgcccagcgaccccgccgccgccgcggccatggtggaccgcatgctccgcctgctcgcctcctacgacgtcgtccggtgccagatggaggaccgggacggccggtacgagcgccgctactccgccgcgcccgtctgcaagtggctcaccctcaacgaggacggcgtgtccatggccgccctcgcgctcatgaaccaggacaaggtcctcatggagagctggtactatctcaaggacgcggtgctggacggcggcatcccgttcaaacaggcgtacgggatgacggcgttcgagta

SEQ ID NO: 31998 - protein, 165 aa, Zea mays
  misc_feature: Ceres CLONE 1408591-F
  misc_feature (31)..(87): Pfam Name: Dimerisation Pfam Description: Dimerisation domain
  misc_feature: SWISSPROT Homolog: EC 2.1.1.68 Caffeate O-methyltransferase
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTLNEDGVSMAALALMNQDKVLMESWYYLKDAVLDGGIPFKQAYGMTAFE

SEQ ID NO: 31999 - DNA, 637 bp, Zea mays
  misc_feature: Ceres CLONE 1408592-F
  misc_feature: Translation starting site: 144
  misc_feature: SWISSPROT Homolog: EC 3.2.1.23 Beta-galactosidase
agagctggagctccccgcggtggcggccgctctagaactagtggatcccccgggctgcaggaattcgcacgagaccattacctagaacatcctaatcgaaaaagttcgccaccatcgtgctccgtacacgctccgctccggccatggccgccgccgcggcctccttttcggccctgccgttccttctacttttgctgctggtgccgtcgctcgacggcgcctccaatgtgacgtacgaccaccgctccctcatcatctccggccgccgccgcctcgtcatctccacctccatccactacccccgcagcgtccccgagatgtggcccaagctggtggctgaagccaaggacggcggcgccgactgcatcaagacctacggtcttctggaacggccatgagatcgccccagggcagtactacttcgaggaccggtttgacctggtggggttcgtggagggccttagaagaccctgggttgcttctgatcctgggcaccggggccctatggcccccgcccagggggattattgggggcggggcccgtgggggttcccctaccgggccagaaacggtttttcgggggaaaacaacgggccctttcaggaacccttttttggggggtttcccccaattcccc

SEQ ID NO: 32000 - DNA, 870 bp, Zea mays
  misc_feature: Ceres CLONE 1408593-F
  misc_feature: Encodes the peptide sequence at SEQ ID NO. 32001
  misc_feature (12)..(12): n is a, c, t, g, unknown, or other
  misc_feature (14)..(14): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (73)..(73): n is a, c, t, g, unknown, or other
  misc_feature (141)..(141): n is a, c, t, g, unknown, or other
  misc_feature (765)..(765): n is a, c, t, g, unknown, or other
  misc_feature (766)..(766): n is a, c, t, g, unknown, or other
tgccacacgaancnccttaannnncgataaaggagcgngctaagnnnngcccacttctggtactcctcttagnggcggcccctctataaaaaccggggccccggggtgcacgattacccaccacagcgttaccgagaacancccaaccaaacagaaaaaaaaacgaggttttccactctccctccactagtctactcggcagagttcactgactctcaccggcgggttttgggcctccaccgggcggggggatggcggacctcggccgagagcgggtctacttcggcggcatgaacgacggaattggcggacgcacggagaccccctgcacgcccgactacacagacggtgtcccgggggatagatccgcctccgtccccctcaacgccgcagcgcggaccgggtctcgagcaccccaccgaagagggcctgccgcggagcgcagcggaaaagacacgagccggccaccgactgggaccgggaaccccccggcgcaccccaccccgcgccaggcggcaccgcacccccgccacgcagtccgcaaggaccaccgacttcgcgcccagcgcgctgccgcgcgacacccccgggaacgcccgccctaatagtcaccgcccactgccatcctgcgcggcgggcacacagcgtgtgcccacgccggcgcgggatcgccggatacccgcgcccgactcgctacgaagatagggggaggacacgaggaagcgagaggggtgacgggcacctgccggcccgcagcgccgctgnnacaaaggttaagcccaaaacctctgccccccccagcacccgcacggaccccgccgaacggtgcacaaccgccggacggtgccgcaccctaccgaaaacacgaga

SEQ ID NO: 32001 - protein, 117 aa, Zea mays
  misc_feature: Ceres CLONE 1408593-F
MADLGRERVYFGGMNDGIGGRTETPCTPDYTDGVPGDRSASVPLNAAARTGSRAPHRRGPAAERSGKDTSRPPTGTGNPPAHPTPRQAAPHPRHAVRKDHRLRAQRAAARHPRERPP

SEQ ID NO: 32002 - DNA, 644 bp, Zea mays
  misc_feature: Ceres CLONE 1408597-F
  misc_feature: Encodes the peptide sequence at SEQ ID NO. 32003
  misc_feature (489)..(489): n is a, c, t, g, unknown, or other
  misc_feature (501)..(501): n is a, c, t, g, unknown, or other
aaagctggagctccccgcggtggcggccgctctagaactagtggatcccccgggctgcaggaattcgcacgagaccattacctagaacatcctaatcaaaaaatccaacccacacacaggctgaccccaccaacagcaagcgaaaatctcccgatcccctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgtcacctacaccgagcacgcgcgccgcaagaccgtcacgccatggagtcgtctacgcactcagcgccagggcgcacctctacggctcggcgctagctaggncgtcgcgcctcntgtcgtcgcggcggtctattgttttgcaatcgcaagtgtgcctgggtggcaaaatgctgggtactggaccactagatcaggcatgtttgggcgtggctgaaaaaaatgccaaattggggacttggctgttttggttaaaaaaa

SEQ ID NO: 32003 - protein, 102 aa, Zea mays
  misc_feature: Ceres CLONE 1408597-F
  misc_feature (25)..(89): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKTVTPWSRLRTQRQGAPLRLGAS

SEQ ID NO: 32004 - DNA, 597 bp, Zea mays
  misc_feature: Ceres CLONE 1408611-F
  misc_feature (244)..(244): n is a, c, t, g, unknown, or other
  misc_feature (245)..(245): n is a, c, t, g, unknown, or other
  misc_feature (267)..(267): n is a, c, t, g, unknown, or other
  misc_feature (268)..(268): n is a, c, t, g, unknown, or other
  misc_feature (293)..(293): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
atagctggagctccccgcggtggcggccgctctagaactagtggatcccccgggctgcaggaattcgcacgagaccattacctagaacatcctaatcgaaaaatcttttcctttcccctcctccctcctcggctcgtctctgttcccctttccctcctgcgcacccgtcttctcctccccgcgtcaaaccccagcacaaaaagcaaccgcccgccgccctcctcgttccctctcccgaatcagnncgtcgcggtggcctaatccggnncgatccccccctccgaatcgcgggntgccccgccgaaaaggcgggggcctcccgggcccctccccccgatggtataagcacctttccaagggaaaagggggaaatcaaaaaaacacccccaaaaaaaaaaagggggcccccagaagagaaaaggggggggaaaaaaaaagaaaggggggggcccccctcccctcaaaaaaagaaaggcgccggggggtgtttttaaaaaaccccccccgtgggggagaaagaaaaccccccccccnnnnaaaaataagaggggggggggggcccccccccccgccgggttttcacgaaaaaaccccccc

SEQ ID NO: 32005 - DNA, 701 bp, Zea mays
  misc_feature: Ceres CLONE 1408613-F
  misc_feature: Encodes the peptide sequence at SEQ ID NO. 32006
  misc_feature (556)..(556): n is a, c, t, g, unknown, or other
  misc_feature (558)..(558): n is a, c, t, g, unknown, or other
  misc_feature (563)..(563): n is a, c, t, g, unknown, or other
  misc_feature (564)..(564): n is a, c, t, g, unknown, or other
  misc_feature (566)..(566): n is a, c, t, g, unknown, or other
  misc_feature (567)..(567): n is a, c, t, g, unknown, or other
aaagctggagctccccgcggtggcggccgctctagaactagtggatcccccgggctgcaggaattcgcacgagaccattacctagaacatcctaatcgaaaaatctcaccacacaccgcagccccagcaagatcgcgcggaggccatggcgaagcccaagccttcctccgccggcgccaagccgaccgcgcctgcgccgccggttacagtgcactcggcgctggtcacctacacctccatgctcgcgctcctgtccctctgcccgcccttcgtcatcctcctgtggtacacgatggtgcacgcggacggatcggtggtgcggacttacgagcacctcagggatcacggcgtgctcgaggggctaaaggccatctggcccatgcccaccctcgtcgcgtggaagatcatcttcggcttcggcctcttcgaggccgtcctacagctgctgctccctgggaagcgcttcgaagggcccatctcgccctgccggaaacgtgccgtctacaaggcaaatggcttaccagcatatgcagtgaccttgataacttaccttggntngtggnngnntcgtatatttaacccctgcatagtggatgatcacttggggggagaatactctgctcttgttttgggaagctttgaatcctggatttttctcaacaaaaggggcatgaatttccattctcatctgactctggatc

SEQ ID NO: 32006 - protein, 185 aa, Zea mays
  misc_feature: Ceres CLONE 1408613-F
  misc_feature: SWISSPROT Homolog: EC 1.3.1.21 7-dehydrocholesterol reductase
  misc_feature (138)..(138): Xaa is any aa, unknown, or other
  misc_feature (140)..(140): Xaa is any aa, unknown, or other
  misc_feature (141)..(141): Xaa is any aa, unknown, or other
MAKPKPSSAGAKPTAPAPPVTVHSALVTYTSMLALLSLCPPFVILLWYTMVHADGSVVRTYEHLRDHGVLEGLKAIWPMPTLVAWKIIFGFGLFEAVLQLLLPGKRFEGPISPCRKRAVYKANGLPAYAVTLITYLGXWXXRIFNPCIVDDHLGGEYSALVLGSFESWIFLNKRGMNFHSHLTLD

SEQ ID NO: 32007 - DNA, 900 bp, Zea mays
  misc_feature: Ceres CLONE 1408616-F
  misc_feature: SWISSPROT Homolog: EC 4.1.2.10 Mandelonitrile lyase
  misc_feature (47)..(47): n is a, c, t, g, unknown, or other
  misc_feature (48)..(48): n is a, c, t, g, unknown, or other
  misc_feature (900)..(900): n is a, c, t, g, unknown, or other
ccccactcaccccacctacccaaaattccacatcaccctcgggcggnngactcaaagctggcagctccaccccgggtggcggccgactctataactagtggatcccccgcggctgcaggatttcgcaccgagaccattacctagtaacatcctaatgcgaaaataacacacaacgttgcttttatcaaagatctgcgccgtttacaatgatctggacgatcaaagcacttcacaatgtccacccttctcgctacgagcttcttctttgtactcctatgcagttcgctacaagtacgtggcgtgaactacccgctcctgaacgacgcggccctggcgccccagcgtgtcgtactacgactacatcatcgtgggcggcggcacagcagggtgcccgctggccgccaccctgtcggagcgctaccgcgtgctgctgctggagcgcgccgcctcgtcctacgtacgaccacctgcatcagccaacatcggcccgccttcacgcacacggttgtcaggacacactccccgggcttcgccccgttacaagcggcttcttagtccctacggacgtgcgtccctacaacctcgccgcaccagcgagcaaggaagggcctgcagctacgctgacatccatatcctcctggtttcccctacaccgcccgtgcctttgaccaactatcctacctccaagtgagtttccactccctcgggatacttggggttgctcgtcaccggcctcctccgatgcttccccaccctccccaacgacccctcttttggcgcttctcctacccaccaatctgtgccccacccgtacaagggcagaatcctcccatgtctcccccttccttgctccggcttcggggttagtcgaacagggaaatcatgctctccaagattccn

SEQ ID NO: 32008 - DNA, 696 bp, Zea mays
  misc_feature: Ceres CLONE 1408639-F
  misc_feature: Encodes the peptide sequence at SEQ ID NO. 32009
aaagctggagctccccgcggtggcggccgctctagaactagtggatcccccgggctgcaggaattcgcacgagaccattacctagaacatcctaatcgaaaaagcacaagaacactcctagctagctgaagatctcgagtgcaacgcaacgttggcgcttggcggccagtagtagcagctaatttagcgtcgctccttcctagacgagagatcgagaaaccatggccaagctccaagtcactcctggcgccgcgttcaccgagtgcaatgaactcaacttccagggcctgtacctgtaccacacgcccctgggccccaaggccaaccaagctgcgatcgtagagagcaaggccaagatcggcatcggtgccaccgtggttaacaactgggcagtgtatgacgggccagggccaggcgctaagctcgtcggccgtgcgcagggcttgcacatcctagccggcaactgggtcaactcattcaccctggtgttcgaggatgaaaggttcagtgggtccacgcttgaagtgaggggcataacggttgaaactggcgagtgggctgttgttgggggcaccggccagtttgctatggcgaacggcatcatctccaagaagttccacgagcagagaagcgacgggaacgtcatagagcttagtgtccatgcattctgcccgctgctcaaagggaaaaggggcg

SEQ ID NO: 32009 - protein, 158 aa, Zea mays
  misc_feature: Ceres CLONE 1408639-F
  misc_feature (2)..(152): Pfam Name: Dirigent Pfam Description: Dirigent-like protein
MAKLQVTPGAAFTECNELNFQGLYLYHTPLGPKANQAAIVESKAKIGIGATVVNNWAVYDGPGPGAKLVGRAQGLHILAGNWVNSFTLVFEDERFSGSTLEVRGITVETGEWAVVGGTGQFAMANGIISKKFHEQRSDGNVIELSVHAFCPLLKGKRG

SEQ ID NO: 32010 - DNA, 717 bp, Zea mays
  misc_feature: Ceres CLONE 1408640-F
  misc_feature: Translation starting site: 251
agagctggagctccccgcggtggcggccgctctagaactagtggatcccccgggctgcaggaattcgcacgagaccattacctagaacatcctaatcgaaaacttttttctcctctctcctctctcccctttcctctccccaagcaggcggggcgagcgagcccagcaggcgtctctcctctcgtccatccgtttcctcctccccctgcttcccggctcgcctccctcccctccctgtgcgcctcttttcatgcgcgaggagggaccgtggggaccaccaccaccagcaccaccacctccatccgtgcgcctctcgctctcgctggtggtgctcctcctcctccacctgctcccggggcgggcggcctccttttccacctcctgctggtgccagggccgggagggcgtcgcggaggtggcgcgcatggggctcgccggggacgggtcggcggacaccgcccacctcagtaataatgaaaatgggcggttcatttatggagttgcgagttctcctggtaaaagagcatcgatggaggacttctatgaggcaagaatagacgacgttgatggagagaaaatggaaatgtcggtgtatatgatggtcataggagagtccgagcagctgagtatggtaagcagcaccttttcagcaatttaatcaacacccaaaggtcatcactgataccaaggctgctatcggcggaaactaacaactcc

SEQ ID NO: 32011 - DNA, 650 bp, Zea mays
  misc_feature: Ceres CLONE 1408643-F
  misc_feature: Encodes the peptide sequence at SEQ ID NO. 32012
agagctggagctccccgcggtggcggccgctctagaactagtggatcccccgggctgcaggaattcgcacgagaccattacctagaacatcctaatcgaaaaacttgccctgaacgcattcctcccatctcacaagacctcctctgacccgagaagcgcagctgcggacatggacgccaccgctactggagttggagggaaggtaaacaagggagcgctcgaccaaaaggtcggcctgccgaggaagaagtccgtgacgaggctccgcgaaggccgggctccagttccccgtcggccgcatggggcgctacctcaagaagggccgctacgcgcagcgcgtctgcaggggagcccccgactacctcgcgatcgtcttggagtacctcgccgctgacgtcctgcagttcgccggcaacgctgccaaggacaacaagaagacgcgcatctgcccgcgccacgtgctgatggcgatccgcaacgacgaggagttcggaaagctgctgaccggagcgaccatcgccaacggcggcgtgctgcccaacatcaaaccggtcctgctgcccaaaagacggcggacaaagcttccagcggaggtagcaaggaggccatgtctcccaagaaggccgtcaagtcccccaataatgtatagg

SEQ ID NO: 32012 - protein, 117 aa, Zea mays
  misc_feature: Ceres CLONE 1408643-F
  misc_feature (1)..(61): Pfam Name: Histone Pfam Description: Core histone H2A/H2B/H3/H4
MGRYLKKGRYAQRVCRGAPDYLAIVLEYLAADVLQFAGNAAKDNKKTRICPRHVLMAIRNDEEFGKLLTGATIANGGVLPNIKPVLLPKRRRTKLPAEVARRPCLPRRPSSPPIMYR

SEQ ID NO: 32013 - DNA, 751 bp, Zea mays
  misc_feature: Ceres CLONE 1408644-F
  misc_feature: Translation starting site: 302
  misc_feature: Pfam Name: PI-PLC-X Pfam Description: Phosphatidylinositol-specific phospholipase C, X domain
  misc_feature: SWISSPROT Homolog: EC 3.1.4.11 Phosphoinositide phospholipase C
  misc_feature (567)..(567): n is a, c, t, g, unknown, or other
  misc_feature (568)..(568): n is a, c, t, g, unknown, or other
  misc_feature (570)..(570): n is a, c, t, g, unknown, or other
  misc_feature (571)..(571): n is a, c, t, g, unknown, or other
  misc_feature (583)..(583): n is a, c, t, g, unknown, or other
  misc_feature (586)..(586): n is a, c, t, g, unknown, or other
  misc_feature (685)..(685): n is a, c, t, g, unknown, or other
aaagctggagctccccgcggtggcggccgctctagaactagtggatcccccgggctgcaggaattcgcacgagaccattacctagaacatcctaatcgaaaaataccttccctttccaggcctcggctccgtccgtccccaatctcccctttcgtcttctcttcccgctcccgtcccgaaattagcccaccgattagcttgcttgccctagcagatcgaagccgtagccctagccgaggagcgcccatggccgctgcgatcgtggcctgaggcggcggggctcttcccatggggtgaggggatggaccctagcctgaaggaggaggtgatgaaggcggtggaggaggcgaggtccgcggcggcgccgcggtgccgggtggtgcggatcatcgtgcacgacgaggacgccaccgactcgtcttccagcgacgaccagggagaggaggcgggggagcgcgccgcggagcacccgggcgcggcgccggcggtcagcgtgaagcgcagccgcgtgctgctccagtccactgggtgcggtgcggaggaggacggcgaggggccagtcacggnncnntggggggggggnttnccctttccttcttctccccgtacctcaacccacccatcgcgcacccaggtcaccaggacatgtcagcgccgttctctcactatttcgtgttcaccgggnataattcctacctcactgggaaacagctcaatagtgactccagtgacgtcccaattgtaaaggcgt

SEQ ID NO: 32014 - DNA, 689 bp, Zea mays
  misc_feature: Ceres CLONE 1408650-F
aaagctggagctccccgcggtggcggccgctctagaactagtggatcccccgggctgcaggaattcgcacgagaccattacctagaacatcctaatcgaaaaagcaatactcactcctagtcctggagtatagtcactactacccctagaagggaagcgcatccgctcgatacggggggcggcaggttggtgaggagacgaaaggcacggtgagcgtgagtccaacgaccgtccagttccagttccagcggtccgagcgagatcgatcgcccctccgcaaggacgcaacaacagacgcggcaagcgggtacaagggagttcttctggaggcgcggcagatcacgcgagtgtgttgcgcttgaacagaagaaaaaaacaggcagggaggatgtagtcccgttcccgaacccgaactacaagcccacgcaactgctgctgccgccgcccgcccacgaggagcgagggcattgcccggacccatcaccgtctcgccgtcgccgtcgccgcgctgcaggcagaggaggacggtgccgggcatcatgggcgtttacgagctcgtcaggagcgactacccaggcgtgctgccgattggagacgacttcgaagtcgcggctccacgagccacaataatctcctgggccccgcccccccctctttgatacaaatggagtaagcctacccctcatccc

SEQ ID NO: 32015 - DNA, 748 bp, Zea mays
  misc_feature: Ceres CLONE 1408653-F
  misc_feature: Translation starting site: 110
  misc_feature (670)..(670): n is a, c, t, g, unknown, or other
  misc_feature (748)..(748): n is a, c, t, g, unknown, or other
agagctggagctccccgcggtggcggccgctctagaactagtggatcccccgggctgcaggaattcgcacgagaccattacctagaacatcctaatcgaaaaagccaccatggctccaccacctctgttcccgctcccgcctctcctcatcctcctcgtcatcgtgcctctgttccccaccgccgcgccgacggccacgacgctgccgctgtaccgccacctaccgcacgtagccgagggcgtggcatcgcaccaccaccacccgatgtcccgcctggccgccgcgtcgctggcccgcgcgttgcacctcaagcgccgggaccccaaccaccacagccagaaaggatcaggcggccacccgtcagtaccagccaccgccgcgctgtaaccgcactcactacggcggctacgccttcacggcgtcgctcggcacgactccgcagccgctccccgtgctgctcgacaccgggagtcacctcacgtggatgccaagcacctcgagctacaagagcagcaactgctcctccccatgcgcctccgccagtacgatcttccacccgaagaactcctcgtcctcccgcctcgtgagatgctgcaacccctcctgtcagtgagtccactcaggcgctgacctcgccaccaagatgcgacgggccccgtgctccccggngccgcaagatgtccagccagcggcagtagcgtctgctcaccctacgctgggatatacacctctcgctccagatccgan

SEQ ID NO: 32016 - DNA, 723 bp, Zea mays
  misc_feature: Ceres CLONE 1408656-F
  misc_feature: Encodes the peptide sequence at SEQ ID NO. 32017
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (618)..(618): n is a, c, t, g, unknown, or other
  misc_feature (632)..(632): n is a, c, t, g, unknown, or other
  misc_feature (643)..(643): n is a, c, t, g, unknown, or other
  misc_feature (654)..(654): n is a, c, t, g, unknown, or other
  misc_feature (698)..(698): n is a, c, t, g, unknown, or other
aaagctggagctccccgcggtggcggccgctctagaactagtggatcccccgggctgcaggaattcgcacgagaccattacctagaacatcctaaaaaaaaaaagcgaagccaaccagcacaaaaaggagcacaaagctctctctccctcccccctctctctctctcctgttccccgcgagagtcgctcaaggccgcggcgaggagaagcagcagcgcgtcacctctccaatggcatccccgtccttcctccgtgcaacctgtgcgcttctcgagtgctgaggctccctgtccctaagacaagcttgcgcgcgcgatggagggtttttcgagggacttgctgtgcgggattggcaagggggacgcgccgccaccggagaagaggccggggcagctgcgggaggagatggaggaggtggagcttagcctcgggctgtcgcttggcggccgattcgggctcgacaggaaggggagcaagctcccccggtcgtcgtccgtggcggccatgctgacaacgccggtggaggtgccggcgccgccctccctctcgcggcgagctcgctgccggtccagcgnnnagcgtcgaaagtgagagaagcaggggctggatggatggggntctgccgtgagggncgcggtctcgncgtgcacacgncgcgaggctgccggcgagcgggaaccttcctcctgctcttcggnaagtgaaagacggattttgcaggcc

SEQ ID NO: 32017 - protein, 91 aa, Zea mays
  misc_feature: Ceres CLONE 1408656-F
  misc_feature (87)..(87): Xaa is any aa, unknown, or other
  misc_feature (88)..(88): Xaa is any aa, unknown, or other
MEGFSRDLLCGIGKGDAPPPEKRPGQLREEMEEVELSLGLSLGGRFGLDRKGSKLPRSSSVAAMLTTPVEVPAPPSLSRRARCRSSXXRRK

SEQ ID NO: 32018 - DNA, 733 bp, Zea mays
  misc_feature: Ceres CLONE 1408657-F
  misc_feature: Encodes the peptide sequence at SEQ ID NO. 32019
  misc_feature (3)..(3): n is a, c, t, g, unknown, or other
  misc_feature (7)..(7): n is a, c, t, g, unknown, or other
  misc_feature (8)..(8): n is a, c, t, g, unknown, or other
  misc_feature (24)..(24): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (37)..(37): n is a, c, t, g, unknown, or other
gtncccnncgcccccgcccccccnaccgannntnaanaggggggtggtcaaagctggagctccccgcggtggcggccgctctagaactagtggatcccccgggctgcaggaattcgcacgagaccattacctagaacatccgaatcgaaaaatcgcagaaattctccgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaaggccaaggcggagaagcggctacctgcgggcaagtccgccggcaaggagggcggcgacaagaaggggaggaagaaggcgaagaagagcgtggagacctacaagatctacatcttcaaggtctccgttctcccccaattcgccttcacctcgccgcttcctccttgaccgccaccgttgacgtcgtcttccggcgaggtagctcgccggaagacctcacctggacttttccgacgcaccctccacacactctttaaccctccggaatggccgcctgcttctagctcgtcgacgccccaatctccgcttgcttcctcgacagccccatccgcctcttctcgctctcgctacggctcctctgcctgttcgccatggcgatccgcatcaccgtctccta

SEQ ID NO: 32019 - protein, 88 aa, Zea mays; identical to SEQ ID NO: 7324
  misc_feature: Ceres CLONE 1408657-F

SEQ ID NO: 32020 - DNA, 735 bp, Zea mays
  misc_feature: Ceres CLONE 1408660-F
  misc_feature: Encodes the peptide sequence at SEQ ID NO. 32021
aaagctggagctccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaatcaatttcttcgtccgccttcgcccctgcttacgtccccgctactaaccctaggatcattctgtcttttctcgtttcttatccgactcttcttcgttttatgcctatcagttatgaggttgaacgccttcagaagcttctctactagattagtgtaaatagtagacttgttcgagtttagcttggctggaagaattagtctctggtccgtgtttatatctgctagcaataatggctgcgatgaacggagaggtattgggtgaatgtggaaggaacataaatagtctcaagagaaagcgggagagccccgctgcatatgctgctggcgtattctgcacctctgaattgcatcagcatactgtcaatgattctgctgttaggtttcatcttgataaagacgtaaggcaaagatcgtgtg

SEQ ID NO: 32021 - protein, 62 aa, Zea mays
  misc_feature: Ceres CLONE 1408660-F
MAAMNGEVLGECGRNINSLKRKRESPAAYAAGVFCTSELHQHTVNDSAVRFHLDKDVRQRSC

SEQ ID NO: 32022 - DNA, 705 bp, Zea mays
  misc_feature: Ceres CLONE 1408671-F
  misc_feature (344)..(344): n is a, c, t, g, unknown, or other
agagctggagctccccgcggtggcggccgctctagaactagtggatcccccgggctgcaggaattcgcacgagaccattacctagaacatcctaatcgaaaaacaaatcaaatgattccttgcttgcccccctttccctccaaaattctcgctgcggccctcgtcttcctcctcttcttcttctgtaaagtgccaagtgccaactgcattctggcttacttggaacaccactccttgattccttcccattccaccagtctcatcttgcatagtgctagaacttatccatttgcttgctactgctcttgcccagcatgagcaaacggccgatgatgacaacgccnggcgggcggagaagacggtgagccatccagcggcgctcgcggagccggtgcgcccgcgccgtctcagccggtcggaacccggcgctacgcaagactgcagagcgcccgcaccgggaacagtgccgcccgacggcgaccggcccagacgtcatgtgacctattatggaaggcccgttttgaagcgggcggaacaacccgccaaccaatgaacgtaacgggggcggggaaaacttgcccgccccaaaaaggggaagcaaacgccccaagggccaacctaaacgccttgggttccaaaaaaaaaaaaaaaaaccggggaatttaatagaacaacccccgggtgggaaccgaaaaataccccccg

SEQ ID NO: 32023 - DNA, 739 bp, Zea mays
  misc_feature: Ceres CLONE 1408675-F
  misc_feature (739)..(739): n is a, c, t, g, unknown, or other
aaagctggagctccccgcggtggcggccgctctatttactagtggatcccccgggctgcaggaattcgcacgagaccattacctagaacatcctaatcgaaaaaatccaacaattcaacctgcagggatctcctccatgactactaaagtcaactacttcccgctcgtggaaataatgaggaggcgcatcatggcataatcggtcgcgctcttggtgatagccctcgcgttagggggggccaccgccccacaggtagcggaggcaaagaagacgagagcggctaagtacggggatgctgcggagcataagaagatccagaaggactctctgctcgaccctcagctaggtgaagaagggaacgcacctgtccgaatgcaaggagtgctgcgcgatctcgcactacatcaacctgatgctggaccgcccccatccagtgcaggggcaagtcgaccgatcacaagggcatcacgtggcctggaatgaaggtctgcaaagaggagtgggacaaggcgtacctggagaaggcggcctaagtcaccaacgcctgcagcatcacctgcaccaaggagaagaacccgcgtctcatcgataactgcatcaggtgctggagcccctccttcgttcttgaacccccttgaaatggatgaaccatgcacgccctgcacctagcctatacctacgtagacacccagttggcccacgcctgcggatgccataaagccgataaccatctccttn

SEQ ID NO: 32024 - DNA, 731 bp, Zea mays
  misc_feature: Ceres CLONE 1408677-F
  misc_feature: Encodes the peptide sequence at SEQ ID NO. 32025
caaagctggagctccccgcggtggcggccgctctagaactagtggatcccccgggctgcaggaattcgcacgagaccattacctagaacatcctaatcgaaaaaccgactcgatacagcaagagcgacagagagagagagagagagaccgacgcgccggcagatcccaagttcaccggagagggggaagagggcgaccgaaggcggcgatgggtttcatcatggacttcgcggagaatctgatcctccgtctgatggaggacccggacaagcgcgaccaggttcggcgggagcatgtctacaagatgaaggagcggtgcgagcgcactaaggcggcgtggagcctccctctgcgcccctacggcttctggaccttcgaccgcttcaactcgcagctctcctgggatccccagatcagccagggcgccggccgtcgggacccctacgacgacctcatcgcccgccactctgggtcgccgccgtcttcctgaacacccgttccgatctttgcccagaaggtctacttgggcatcaataagaaactctttcccctcaaactgattgtggatccatcctcttctgtctggaaaatgttgtcaccaaactaccctatttcctgttccagtttggcatggaagtataagttgtgtacttctattctcaagctgttgtctttgcattatgaaatgttctcaataatcagcagtttttgatgtatggtcgtggatccaa

SEQ ID NO: 32025 - protein, 93 aa, Zea mays
  misc_feature: Ceres CLONE 1408677-F
MGFIMDFAENLILRLMEDPDKRDQVRREHVYKMKERCERTKAAWSLPLRPYGFWTFDRFNSQLSWDPQISQGAGRRDPYDDLIARHSGSPPSS

SEQ ID NO: 32026 - DNA, 689 bp, Zea mays
  misc_feature: Ceres CLONE 1408681-F
  misc_feature: Encodes the peptide sequence at SEQ ID NO. 32027
  misc_feature (541)..(541): n is a, c, t, g, unknown, or other
  misc_feature (580)..(580): n is a, c, t, g, unknown, or other
  misc_feature (658)..(658): n is a, c, t, g, unknown, or other
aaagctggagctccccgcggtggcggccgctctagaactagtggatcccccgggctgcaggaattcgcacgagaccattacctagaacatcctaatcgaaaaatcaccaaccatccagtcataactcacgcaggcagagacgcgcaccaccagaccagcagcagaacgaaagggatctccggtccccgggccccggctcctcccctcccgattccaatctggtctcaccgggcctggcggcgagggagagatggggaagaaccaggcgtacaaggcgatgcagcgggcgcggctggggtcctcgtccggcgcgccgggcgccgccgacgcccccgaagacggcatggtcggtccccttcctctcccctaggagatctctgtttcccatctgcacttccgagttccaggctcgcaatccatcctgatccgattatttccgcagccatattactatgctaattatatacaatagagtaggcttccagccgctgaggaattttggctaccatcccactttcgctttgggtgaaagataaagaanaagaactttggctaacgagggccgtcgcagacggacggntcattccattctccagagtggcatgcggcgcgcctgggcagccttaacaagacgcacaccctcacctggggagagttncagaagaagcagaaggaagaggaactgaaaa

SEQ ID NO: 32027 - protein, 39 aa, Zea mays; identical to SEQ ID NO: 24388
  misc_feature: Ceres CLONE 1408681-F

SEQ ID NO: 32028 - DNA, 792 bp, Zea mays
  misc_feature: Ceres CLONE 1408684-F
  misc_feature (12)..(12): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (236)..(236): n is a, c, t, g, unknown, or other
  misc_feature (262)..(262): n is a, c, t, g, unknown, or other
  misc_feature (266)..(266): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (294)..(294): n is a, c, t, g, unknown, or other
  misc_feature (301)..(301): n is a, c, t, g, unknown, or other
  misc_feature (316)..(316): n is a, c, t, g, unknown, or other
  misc_feature (380)..(380): n is a, c, t, g, unknown, or other
  misc_feature (395)..(395): n is a, c, t, g, unknown, or other
ggcccccccccnccccccnnnnnggaccgcgggcnnnaggttcttttttccaagctggcgctccccgcggtggcggccgctctatactagtggatcccccgggctgcaggaattcgcacgagaccattacctaaaactcctattcaaaaacaacccttgaatcctcactcgatctgtagattgagactacgatgactcgtgtcaccgctcgagtcttcctccccgccggccgcggntgcgggtggtggtagggaggtgtggntcgncgcgtggttcggcttgnnnnccaccggngaggggntcggctcgtattacntatgatgaggaggacacggaccacgccctctcccttaaggccatcggtgaagatgttgctatancgaatcaagcactgncagctcccctccctctcccgaattagaagggggtactgtgaatgatactttgttcgcccgggactgccctttgggttgtgatgatgtggagccaacgagccgctgcccatcacagaatgattgagcttttgtatctagctccgtggtggctcactgcacagaaacaccgtgtttgctccatcaaagcccaacgacggccgcccccacgcgagtggatttccattcgcgtacttctgttgctggatagacgggtgatagcgacgcctcccaactctgggaactagaactgatgccctctctcccaacgggtcaacgctttggtcccaagaaggaccaccctttcctgggaaccttttccaccgtggaaccggcgccccataattcacctaagagggga

SEQ ID NO: 32029 - DNA, 867 bp, Zea mays
  misc_feature: Ceres CLONE 1408686-F
  misc_feature: Encodes the peptide sequence at SEQ ID NO. 32030
  misc_feature (34)..(34): n is a, c, t, g, unknown, or other
  misc_feature (45)..(45): n is a, c, t, g, unknown, or other
  misc_feature (48)..(48): n is a, c, t, g, unknown, or other
  misc_feature (49)..(49): n is a, c, t, g, unknown, or other
ttttccccccccccccccccaaaaaaacaataanagggggcgctnccnncccacagctggagctcaccgcggtggcggccgctctataactagtggatcccccgggctgcaggaattcgcacgagaccattacctagaacatcctaatcgaaaagctgaactgctgacgcttcgcgcgggtccgaggtcaggcggcagcagcacggagtagcaccagggcgaccgcccaggttatcgtcggccgccggcgacctgtaccccggcgagaagatgcatctgagcgcgaacgaggggatcgagggtctgcgattcgcggtgacgggcgggcagggcttcgtcggagctgccctcagcctcgagctgctccgccgctgtgcccgcgaggtccggcccctcgatctccgggcctcctcctcctggtcccaggaggctcgtcgacgccggcgttccgaatccttcccaggggggaacataaaaaatagaagggatgatggtgcgggaaaggcttttcccgggggaggggggaacctggtgtttttcccaccccttggccttcctttaatgggcagggcccagggcaaggggagaatgggtgccaaacacctggggcagcaaccctggatggagggttaaaataatcacattgggcaacctggggcaggggtgaccggggaccgcctttggcccatgggagcgcaaggagggcgcaggaagaggggtctggtgggcatggcagacagccccatcagcgagggggggcgcactctccggagagcaacaggccccaattggtccacccgcgcaaaatgggagggcgggctccccctctttttttttcccggaatttggaagaaacccattggtttg

SEQ ID NO: 32030 - protein, 120 aa, Zea mays
  misc_feature: Ceres CLONE 1408686-F
MHLSANEGIEGLRFAVTGGQGFVGAALSLELLRRCAREVRPLDLRASSSWSQEARRRRRSESFPGGNIKNRRDDGAGKAFPGGGGNLVFFPPLGLPLMGRAQGKGRMGAKHLGQQPWMEG

SEQ ID NO: 32031 - DNA, 745 bp, Zea mays
  misc_feature: Ceres CLONE 1408687-F
  misc_feature: Encodes the peptide sequence at SEQ ID NO. 32032
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (16)..(16): n is a, c, t, g, unknown, or other
  misc_feature (19)..(19): n is a, c, t, g, unknown, or other
  misc_feature (27)..(27): n is a, c, t, g, unknown, or other
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
nnnnnnncccctttcnttntccccccnagggggnntnttggcgggggggcagagctggggctccccgcggtggcggccgctctagaactagtggatcccccgggctgcaggaattcgcacgagaccattacctagaacatcctaatcgaaaaatctcgtccacgaaacgtacggacttcgggcatcggccccaacgccagcggcaccgcaccaccacgcccgtcggcgacatgaatccgcccgcagcagccgcgtccaccggcgcaggaggccacgccgcggcgcctgcggcagcccgggagtacgtgcactacccgaggctctcgccagaggaggtggccccgcccccgcccccgccttatcacgccgccaccgccgcgccgtccgcctacggaggcaacccctacatctactcccccggcgggggggccgccacctccccgaagaatacgatggactccgtgaaggacgtgctcggcaagatggggaagaggtttggcgaggcggcccgcaagaccgagaccatcaccggcaatttctggcagcactgtgagcttttcgatttcgttgccgtattttcacgaaatcgggttccgaagttggcttccggggtggttttcatcaaattggctaagcggtggtgggcatttttccagggacattttggttattggaatatggaaatttacggttggccctgtaaagctgggtacttaaggccccaaagccccagatgaaggttggg

SEQ ID NO: 32032 - protein, 168 aa, Zea mays
  misc_feature: Ceres CLONE 1408687-F
MNPPAAAASTGAGGHAAAPAAAREYVHYPRLSPEEVAPPPPPPYHAATAAPSAYGGNPYIYSPGGGAATSPKNTMDSVKDVLGKMGKRFGEAARKTETITGNFWQHCELFDFVAVFSRNRVPKLASGVVFIKLAKRWWAFFQGHFGYWNMEIYGWPCKAGYLRPQSPR

SEQ ID NO: 32033 - DNA, 811 bp, Zea mays
  misc_feature: Ceres CLONE 1408688-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (35)..(35): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
nnnnnnnnnccccnnnnnnnccccccgcccggtcnccccggggnnngnccaaagctggggctccccgcggtggcggccgctctagaactagtggatcccccgggctgcaggaattcgcacgagaccattacctagaacatcctaatcgaaaaacggcccaccccgatctcataatcgtcgtcttctcccacttcgacgcggctagggccggcgctaccatctcctcttctcttccggcggcttctccgtcccgtcgatcaaccgcgccgccttcgccagtataccccgcattgagccgtcatcggtacctgcgccgaccggcacctctggagcctcttctccagggggttgcacgaggaggagggaggttcgggcttcgccatgtcgaagtcaaacctagatgatctgcttctgcaggcaggccgggcggagggggaaaaacccaactcccgggcgagcaaacccgcgggtgggaactcttgggggaaaggggctccggaggggcttgcgacaacgacgaactcgggacggccgcgcccgaccttactccgaggaaggaagccctttcctgcggaaggttcccggcttcaaagaagcgggcaccacgcccataagcaggggcggcccggggggtggccagcggggcggggggggaaagggacggagggacggacgagggaacggaagaggggggcgttcccaagtgggggggggaaaggatttcggggcaggggggccctctttggggggggggaaggggaccctaataacagggggtggagggcactcaccaggggggccctcttgggga

SEQ ID NO: 32034 - DNA, 730 bp, Zea mays
  misc_feature: Ceres CLONE 1408691-F
  misc_feature: Encodes the peptide sequence at SEQ ID NO. 32035
  misc_feature (15)..(15): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (24)..(24): n is a, c, t, g, unknown, or other
  misc_feature (29)..(29): n is a, c, t, g, unknown, or other
  misc_feature (35)..(35): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ggccccccccccccncccnnnannacgcncccccnnggggggnnnnncagagctggagctccccgcggtggcggccgctctataactagtggatcccccgggctgcaggaattcgcacgagaccattacctagaacatcctaattcaaaaataccaccgtgacagttctattaacttgacgagacaaaaggggggaaagttctgctcctacgatcctacctccagtgatgtcagcaccaccgctggccggcggcggcgccatcatcaatgaggtcctcaccgatgacgagctacgcgcagtgctcaggcggctggggcccgaggcggagcgggacgcgttcgggctcgtgtgccgccgctggctccggatccagagctccgagcggcggcgcctgcgcgcgcgcgccggcccggacatgctgcgccgcctcgctgcacgcttccctggagtcctggatctcgacctctctcagtcgccctcccgctctttctaccccggggtcatcgacgacgacctcaacgttatcgccagcagcttccgcaacctgcgtgtcctcgcgctgcagaactgcaaaggtatctctgatgtcggagttgccaaattgggagatggactggcatctctgcagtcccttgatggttctcgctgcataaagctgagcgacaaaggtttgaagggcgggtgcactagggtgcaaaaatttgagccagctggcaatcatgggatgct

SEQ ID NO: 32035 - protein, 167 aa, Zea mays
  misc_feature: Ceres CLONE 1408691-F
MSAPPLAGGGAIINEVLTDDELRAVLRRLGPEAERDAFGLVCRRWLRIQSSERRRLRARAGPDMLRRLAARFPGVLDLDLSQSPSRSFYPGVIDDDLNVIASSFRNLRVLALQNCKGISDVGVAKLGDGLASLQSLDGSRCIKLSDKGLKGGCTRVQKFEPAGNHGM

SEQ ID NO: 32036 - DNA, 650 bp, Zea mays
  misc_feature: Ceres CLONE 1408705-F
  misc_feature: Encodes the peptide sequence at SEQ ID NO. 32037
gctctagaactagtggatcccccgggctgcaggaattcgcacgagaccattacctagaacatcctaatcgaaaaacggtccaccgacgactcttcttcctcacctcctcccgctccagctccagctcgtctctctcctcgcctcgcgtagggtttcgcttcccgtctcgccgccgtcagcatgggggacaactacgatgacgaaggcgagccgatcgtgaacctcgacgaacgggaaccctcccctgagcatcagccgtacgaagacctcgatgacgacctcgacggcggcggcgattggacccgcgaccgctctccgacccccgtccacggcgacgacggcggggcaggggcctcctccaagccccgaaagcgccttctcaagaagggcggcggtggaggcatgcccggcgatgacgggctggatgactttgggttggaggacgaggacgcggacccttcgggctgaggcgaggaagaggaagggctcgtcgtcgctgagggacctcgcgagggggggggcgggcagggagaagaaagctaaaaatgcgaggggagaggaccacggaaggggaaggaacactgggatggggagggataggcggggaacaggaggaagggactcaggcgggaggatgaccaggatggtgg

SEQ ID NO: 32037 - protein, 95 aa, Zea mays
  misc_feature: Ceres CLONE 1408705-F
MGDNYDDEGEPIVNLDEREPSPEHQPYEDLDDDLDGGGDWTRDRSPTPVHGDDGGAGASSKPRKRLLKKGGGGGMPGDDGLDDFGLEDEDADPSG

SEQ ID NO: 32038 - DNA, 677 bp, Zea mays
  misc_feature: Ceres CLONE 1408716-F
  misc_feature: Encodes the peptide sequence at SEQ ID NO. 32039
  misc_feature (665)..(665): n is a, c, t, g, unknown, or other
aaagctggagctccccgcggtggcggccgctctagaactagtggatcccccgggctgcaggaattcgcacgaaacattacctaaaacatcctaatccaaaaaatcagtgctcgctagcccaccacgccctgaacctagcccggacaccagccagaacaggccatgtccatgggctccccggtgcagctcaggcggctgaagcctctgtaccagttcgtggtgaacaacatcctgctcatcgtgaccgtgccgctcgccaccgcggtcctgctcaaggcgtcttcgctcggacccgaggagatcctggcgctccggccggcgcacctgttcctggccgcgttcctgcctgccgcgtgcacggtgctgtacctgatgctccgggcgcgcacggtgtacctggtggactacgcgtgcttccgaaccagccccaactgtcgtgtcccgttcgcgacgttcctggagcactcccgcgtgtggccgggcttcgacgagcgcagcgtccggttcatgacgcgcctgctggatcgatcggggctcgccgaggagacgtgcctgccgtacgcgcagcactacatcactgcgtcgcgcgacctgtagtcctcccgagccgagtgcgaggtcttcatcttctcggacatcgacgacctgctcgccaagagcggggntctccccgcgag

SEQ ID NO: 32039 - protein, 144 aa, Zea mays
  misc_feature: Ceres CLONE 1408716-F
  misc_feature: SWISSPROT Homolog: EC 2.3.1.119 Icosanoyl-CoA synthase
MSMGSPVQLRRLKPLYQFVVNNILLIVTVPLATAVLLKASSLGPEEILALRPAHLFLAAFLPAACTVLYLMLRARTVYLVDYACFRTSPNCRVPFATFLEHSRVWPGFDERSVRFMTRLLDRSGLAEETCLPYAQHYITASRDL

SEQ ID NO: 32040 - DNA, 674 bp, Zea mays
  misc_feature: Ceres CLONE 1408717-F
  misc_feature: Encodes the peptide sequence at SEQ ID NO. 32041
  misc_feature (322)..(322): n is a, c, t, g, unknown, or other
  misc_feature (628)..(628): n is a, c, t, g, unknown, or other
aaagctggagctccccgcggtggcggccgctctagaatagtggatcccccgggctgcaggaattcgcacgagaccattacctagaacatcctaatcgaaaaatcttcgccgccgctaaacgttccccccacgccccaacctatccacgcgaaaccttctttcccccgggagacgattcgtcagggagaggaaagaggcaagaggggccatggacgctgccaagttggtgacgccggtcgctgtgtctcacattctggcgcacccgtcggcgggctccgacggcgcagtgaccgatctcgtcgttcaggtcctcgacctgaangtccgtcgcacgggcagccggttcagtttcacagcaactgaccgccaaggataggagcagggggatgctccccaccaaacttcggggcggagggtccgctctgggcaacctggaaaaacctccggcctcatcccggatcatcggaatacacttgggaaagggtcgtcaaaggaaaagatggacaaagtcttgggttggcatcaaaagggggaagtttggggggccaaggggtttggacccccaaaatccaacgggggggggggcaaaaaaagggggggccccccaattgggggttaaaaccctaanggaacaaaggggagtggggctggagaatcccccccctctgcgtttg

SEQ ID NO: 32041 - protein, 55 aa, Zea mays
  misc_feature: Ceres CLONE 1408717-F
  misc_feature (38)..(38): Xaa is any aa, unknown, or other
MDAAKLVTPVAVSHILAHPSAGSDGAVTDLVVQVLDLXVRRTGSRFSFTATDRQG

SEQ ID NO: 32042 - DNA, 619 bp, Zea mays
  misc_feature: Ceres CLONE 1408749-F
  misc_feature: Encodes the peptide sequence at SEQ ID NO. 32043
  misc_feature (612)..(612): n is a, c, t, g, unknown, or other
tggagctccccgcggtggcggccgctctagaactagtggatcccccgggctgcaggaattcgcacgagaccattacctagaacatcctaatcgaaaaagtagtaaaaccaggtaggtgtggctggctcgtgcagcggcggcagtgagagcgatgagcgcggcggcggcggcgagctcggtcaccaagttcatcaaatgcgtcacggtcggcgatggggccgtcgggaagacctgcatgctcatctgctacacctgcaacaagttccccacggattatatccccaccgtattcgacaacttcagcgccaatgtctccgtgggtgggagcatcgtgaacttgggcctctgggacacggcaggccaggaggattacagcaggttgaggcctctcagctacaggggtgccgatgtgttcatcctctccttctccctggtcagcagggcgagctatgagaacgtcctcaagaagtggatgccagagcttcgccgattttcacctactgttcctgtagttcttgttggaaccaaactagatctccgtgaagacagatcttaccttgctgaccattctgctgcttccatcatctctactgaacagggagaagagctcangaagcag

SEQ ID NO: 32043 - protein, 156 aa, Zea mays
  misc_feature: Ceres CLONE 1408749-F
  misc_feature (15)..(156): Pfam Name: Ras Pfam Description: Ras family
  misc_feature (15)..(128): Pfam Name: Miro Pfam Description: Miro-like protein
  misc_feature (154)..(154): Xaa is any aa, unknown, or other
MSAAAAASSVTKFIKCVTVGDGAVGKTCMLICYTCNKFPTDYIPTVFDNFSANVSVGGSIVNLGLWDTAGQEDYSRLRPLSYRGADVFILSFSLVSRASYENVLKKWMPELRRFSPTVPVVLVGTKLDLREDRSYLADHSAASIISTEQGEELXKQ

SEQ ID NO: 32044 - DNA, 658 bp, Zea mays
  misc_feature: Ceres CLONE 1408765-F
  misc_feature: Encodes the peptide sequence at SEQ ID NO. 32045
tcctatctgtactcctccgtaggtggcggccgctctattctaaagaatcccccgggctgcaggaattcgcacgagaccattacctagaacatcctaatcgaaaaatgtaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcactctcccggggcctccggcaagggcttcttcgagtgcacccacgacgtgacgtcgctgacgtgcgccgacttcctgcgcgcgcccggggtgcggacgcccgtgatcgtgcgcttctcgacggtgatccacgagggggggtccccggagacgatccgcgacccgccggggtttcgccggggagttccaccccccgcgagggcaactggggacctgctggggaaacaacttcccccgggctttcttattcggggaacgggattaaggttccccggaggtggatcccccggg

SEQ ID NO: 32045 - protein, 161 aa, Zea mays
  misc_feature: Ceres CLONE 1408765-F
  misc_feature (18)..(161): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHSPGASGKGFFECTHDVTSLTCADFLRAPGVRTPVIVRFSTVIHEGGSPETIRDPPGFRRGVPPPARATGDLLGKQLPPGFLIRGTGLRFPGGGSPG

SEQ ID NO: 32046 - DNA, 634 bp, Zea mays
  misc_feature: Ceres CLONE 1408778-F
  misc_feature: Encodes the peptide sequence at SEQ ID NO. 32047
aaagctggagctccccgcggtggcggccgctctagaactagtggatcccccgggctgcaggaattcgcacgagaccattacctagaacatcctaatcgaaaaatctcgtccacgaaacgtacggacttcgggcatcggccccaacgccagcggcaccgcaccaccacgcccgtcggcgacatgaatccgcccgcagcagccgcgtccaccggcgcaggaggccacgccgcggcgcctgcggcagcccgggagtacgtgcactacccgaggctctcgccagaggaggtggccccgcccccgcccccgccttatcacgccgccaccgccgcgccgtccgcctacggaggcaacccctacatctactcccccgccggcggcgccgccacctccccgaagaatacgatggactccgtgaaggacgtgctcggcaagatggggaagaggtttggcgaggcggcccgcaagaccgagaccatcaccggcaatttctggcagcactgtgagcttttcgatttcgttgccgtattttcacgaaatcgggttccgaagttgtttctgtgtgtttttcatcaaattgctaatcgtgttgtgcatttttcatgtacattttgttattgtaatatgaaattaggtt

SEQ ID NO: 32047 - protein, 151 aa, Zea mays
  misc_feature: Ceres CLONE 1408778-F
MNPPAAAASTGAGGHAAAPAAAREYVHYPRLSPEEVAPPPPPPYHAATAAPSAYGGNPYIYSPAGGAATSPKNTMDSVKDVLGKMGKRFGEAARKTETITGNFWQHCELFDFVAVFSRNRVPKLFLCVFHQIANRVVHFSCTFCYCNMKLG

SEQ ID NO: 32048 - DNA, 619 bp, Zea mays
  misc_feature: Ceres CLONE 1408781-F
  misc_feature: Encodes the peptide sequence at SEQ ID NO. 32049
  misc_feature (596)..(596): n is a, c, t, g, unknown, or other
  misc_feature (597)..(597): n is a, c, t, g, unknown, or other
aagctggagctccccgcggtggcggccgctctagaactagtgatcccccgggctgcaggaattcgcacgagaccattacctagaacatcctaatcgaaaaatattctcccaaaaaacccaacactccagtggcggcaaagacctaacatttcaaaatcaatggccaagaaccccaaggcgcccgacacccgcagtggccgttctcccaccagaaggccccgaccacgccgcgccaaggcggtgccagaagcctcctccgcagctgatatcgaagacctggctccctcagtgcctggggccgctgcccctggcgctgccgcacccacggccctgcgcgcacagctgctccggtggtatgacgcgcaccgtagggacctgccgtggcgatgcgtaagcggcagcgaggaagagagggcgtacgcggtgtgggtgtccgaggtgatgctgcagcagacgcgggtgcccgtggtcgtcgcttactacgagcggtggatggcgcggtggccgaccgtacgaagcctcgccgccgctacgcaggagggagtgaacgagatgtgggcgggtcttggctactaccgtagggctcgatttctgcnntggaggagcaagcagatcatcg

SEQ ID NO: 32049 - protein, 153 aa, Zea mays
  misc_feature: Ceres CLONE 1408781-F
  misc_feature (146)..(146): Xaa is any aa, unknown, or other
MAKNPKAPDTRSGRSPTRRPRPRRAKAVPEASSAADIEDLAPSVPGAAAPGAAAPTALRAQLLRWYDAHRRDLPWRCVSGSEEERAYAVWVSEVMLQQTRVPVVVAYYERWMARWPTVRSLAAATQEGVNEMWAGLGYYRRARFLXWRSKQII

SEQ ID NO: 32050 - DNA, 628 bp, Zea mays
  misc_feature: Ceres CLONE 1408801-F
  misc_feature: Encodes the peptide sequence at SEQ ID NO. 32051
aagctggagctccccgcggtggcggccgctctagaactagtggatcccccgggctgcaggaattcgcacgagaccattacctagaacatcctaatcgaaaaaagcacaagcacaaccaaaagcaaagaagagacgaagtcgatcgatcgatctcagcaactaagcaggtaggtaggcatggcggccgagaaggagggcgcggtggtgaccaagggccacgacgaggggatgaaggcggcggcggcgctgctggaggagttcgggctcccgccggggctgctgccgctggaggacgtgacgtaggtggggttcgtgcgggccaccggctacttctggctcgcgcagtgcaagaaggtggagcaccggttccgcaagatcggcaagcaggggagctacgacgtcgagatcgccggctacgtccggcccaggggcatcaggaggctcaagggggtcaaggccaaggagctcgtgctctggccgcccgtccacgagatggccgtcgacgacgacccgcccaccggcaagatccacttcaagagcctcgccggccagtagccacccacgcgtaccatcttatattatcactataataatacatcatacaccattatatatggcgcatatatat

SEQ ID NO: 32051 - protein, 41 aa, Zea mays
  misc_feature: Ceres CLONE 1408801-F
MAAEKEGAVVTKGHDEGMKAAAALLEEFGLPPGLLPLEDVT

SEQ ID NO: 32052 - DNA, 645 bp, Zea mays
  misc_feature: Ceres CLONE 1408815-F
  misc_feature (412)..(412): n is a, c, t, g, unknown, or other
  misc_feature (645)..(645): n is a, c, t, g, unknown, or other
tggagctccccgcggtggcggccgctctagaactagtggatcccccgggctgcaggaattcgcacgagaccattacctagaacatcctaatcaaaaaaaatcctccgaaccccgccgccgacgagcgagctatggcgctggcgcggcggctgctccgccttactccctacctcggcacgctctcgctcccaccccccaactcgcatctcctccggaatcgcacctatatctctgacatgcgccgctctgccttcgtcgaccgcttgctccgttccgtacgctccgagatctccttcctcgataactccgccccgccaccgccaccaccgcctcctaagccattcaccattgaggaccgcccgggcgagcagtgggcccgcctgcgccgcgtgtcttgcggggcccgaggtgnaggaatagtaggtcaggaaggacgccacgctgctcgaaggagcgctccctccctcccgctcgggcgcggacacggccggaccgcccagaatgcctatcagtgctaaggttgaggtctccaacggcgcgcgatctggagtggcgctcaccttcgagagctccgcgagtgctgactagatgcaggtgcgtagttccattcccgaccggcgcggcgttgcagctccaggtaatatn

SEQ ID NO: 32053 - DNA, 641 bp, Zea mays
  misc_feature: Ceres CLONE 1408817-F
  misc_feature: Encodes the peptide sequence at SEQ ID NO. 32054
tggagctccccgcggtggcggccgctctatcaatagtggatcccccgggctgcaggaattcgcacgagaccattacctagaacatcctaatcgaaaaaaatcctcttaacctcgccgcttactacttgactatgaccgtggagggccgcttgctccgacttacttcctagctcgacatgatctggattccacccaccaactctcatctccttcggaaaccctcctataatgtctgactggttccactttgcctacgcccaaagctcggttcgtttcgtacactgcgacatccgcttcttctagatctcggtaccgctactgtgactagcgcctatgaagacattcatcattgacgcctactcgggctacgagtggcacaacctgcgcggggcgttcgctgagcgctactcctccgcctccgcctcgggcagccgcctcctccatgacggcgcctggcgccccttctgcatcttcacctccaaccgccagcccgagcagcaccgcggcatcggcagcgaccgtcatgacggaggcgactacaaccacccgaagccccaggccatcgccggcggagctcactcggtgctgctcacgcgtgcgtgcttatcgtccaagtcgccgccgtcgtctcttgccgtgag

SEQ ID NO: 32054 - protein, 102 aa, Zea mays
  misc_feature: Ceres CLONE 1408817-F
MKTFIIDAYSGYEWHNLRGAFAERYSSASASGSRLLHDGAWRPFCIFTSNRQPEQHRGIGSDRHDGGDYNHPKPQAIAGGAHSVLLTRACLSSKSPPSSLAV

SEQ ID NO: 32055 - DNA, 640 bp, Zea mays
  misc_feature: Ceres CLONE 1408830-F
  misc_feature: Encodes the peptide sequence at SEQ ID NO. 32056
aagctggagctccccgcggtggcggccgctctagaactagtggatcccccgggctgcaggaattcgcacgagaccattacctagaacatcctaatcgaaaactcatttttctctctcctgcgccgcgacggccctcgccttcgccgccgaatccgagactccgatctcgggttcaccgcagcgcacagaggagccccgactcccggtccgatccgagctctcctctccgtcgcttcagggatggcaggaatggcacctgagggttctcagttcgatgctaagcactatgattctaagatgcaggagctgctgagcaccggtgagactgaggagttcttcacttcatatgatgaagtttttgagagttttgatgatatggggctccaagagaatcttctgagaggcatttatgcttatggatttgagaagccatctgcaattcagcagagaggaattgttcccttctgcaagggtcttgatgtcattcaggaagcgcaatctgtgacaggaaagacagcaactttctgttctgggatcttgcggcagctggactatggactggctgaatgccaggtcctggtccttgctcccacccgtgagcttgcacagcaaatcgagaaagcatgcgcgcggttggtga

SEQ ID NO: 32056 - protein, 133 aa, Zea mays
  misc_feature: Ceres CLONE 1408830-F
MAGMAPEGSQFDAKHYDSKMQELLSTGETEEFFTSYDEVFESFDDMGLQENLLRGIYAYGFEKPSAIQQRGIVPFCKGLDVIQEAQSVTGKTATFCSGILRQLDYGLAECQVLVLAPTRELAQQIEKACARLV

SEQ ID NO: 32057 - DNA, 638 bp, Zea mays
  misc_feature: Ceres CLONE 1408840-F
  misc_feature: Encodes the peptide sequence at SEQ ID NO. 32058
aaagctggagctccccgcggtggcggccgctctagaactagtggatcccccgggctgcaggaattcgcacgagaccattacctagaacatcctaatcgaaaaaaaccgttcgtctagcttggctgttggttcgtccctgtccggtacccttctctcaactctcaagccgcgcagttgtcgaagtcgaaactatccgctgctgtagtagagatgctctcgatgcggccacccagcaccaccttgtcccgccggccgagacggggtcgcctcgggggagccgccgcgccgcaatatgttagcgctgcggcaccggcgcccgctctggagccagctgcgcctccggagagcgtctcctttccgattctggtgaatggctgcactggtaacatggggttatctgtcgctgaggctgctgctctgaggggccttcacctagtccctgtttcattcagcagtagagagaaggttgaaaaaacaatgcaagttggacaaacagacattcaaatatatggtccttctaaaagagaagatgttctttcatctattgctgatgaattcccagatgtcattgttgtggactacacaggacccggttctgtgaactctaatgctgagctctattgcaagcttggattgcc

SEQ ID NO: 32058 - protein, 83 aa, Zea mays
  misc_feature: Ceres CLONE 1408840-F
  misc_feature: SWISSPROT Homolog: EC 1.3.1.26 Dihydrodipicolinate reductase
MGLSVAEAAALRGLHLVPVSFSSREKVEKTMQVGQTDIQIYGPSKREDVLSSIADEFPDVIVVDYTGPGSVNSNAELYCKLGL

SEQ ID NO: 32059 - DNA, 634 bp, Zea mays
  misc_feature: Ceres CLONE 1408854-F
  misc_feature: Translation starting site: 263
  misc_feature (311)..(311): n is a, c, t, g, unknown, or other
  misc_feature (323)..(323): n is a, c, t, g, unknown, or other
  misc_feature (325)..(325): n is a, c, t, g, unknown, or other
  misc_feature (331)..(331): n is a, c, t, g, unknown, or other
aagctggagctccccgcggtggcggccgctctagaactagtggatcccccgggctgcaggaattcgcacgagaccattacctagaacatcctaatcgaaaatcattcaatccggccgggccgcgcgcacgcgcaccaccggcacgcacatcaaatctcagccttcacccctctcacactgtcttcactcggttcgagcaaggggggcagcgagcgaagcggtaggtagcagcagtgtacgtgctgccgccaagctagtgccaatggcgagggcggtggcgatgctcgtggccctggcgctggtcggtgggntgggcggtggcnancgcggncggggcggcggcgcagcagtgcagcgcggcgcagctggcggcgtgcgccccggcgatcatcagcgggtcgccgcccacggcgtcgtgctgctccaacctgcgcgcgcaggagccgtgcttctgccagtacgcgcgcaacccggcgtacagcagctacatcaacagccccaacgcccgccgcacgctcgcctcctgcgagatcgccgtcccgagctgctaggcgctatagctccgcggggtgtgggtgaataaaagatgcatgcatgtccatctgtgcctactgttatcgtgtttgtgcctcga

SEQ ID NO: 32060 - DNA, 425 bp, Zea mays
  misc_feature: Ceres CLONE 1408858-F
  misc_feature (232)..(232): n is a, c, t, g, unknown, or other
  misc_feature (294)..(294): n is a, c, t, g, unknown, or other
aagctggagctccccgcggtggcggccgctctataactagtggatcccccgggctgcaggaattcgcacgagaccattacctagaacatcctaatcgaaaaaaaatcacaaagccagcccatcacctcagtcctcacactgacatttcactctcggctgctggagtgtcggccgctgccatctgcctgccgctcactcccacgcgccgcaatgtgccactccccactcgggngccgccacccaccacgcggggggcgttaagggctcctcatccctcctgccggtaaaccctcngcccccccccccccggggggggggaaaccccccgggaaaaaggggaaaccccccaaaaaaataaagggggggggtttttttttgtcccaaaagggggggggggggggcaaaaaagggggttttccccccca

SEQ ID NO: 32061 - DNA, 602 bp, Zea mays
  misc_feature: Ceres CLONE 1408869-F
aagctggagctccccgcggtggcggccgctctagaactagtggatcccccgggctgcaggaattcgcacgagaccattacctagaacatcctaatcgaaaagtggactgtgtggtcccgcagggcgcaccattcacccgtcttccgccgagacaccctgcacggctcgccagacttcagtttactggagcacgcaccgcagcgtctcccccttctgctcatcctccgtccctccgtcggaagggctggcgctaagggacgatccctccgtccgcccgtccgttcgacgggacctcggttggtttcgtcggtcgctgggaggacaggtgacggaacggtgatatgaggccggtggttatgttgtaactgccactatgacgtcgaggaagatgaccacgccaaggaacaggccaaagctcagagcaataagaccgactccaagcagaagtcttcaaagccctcctggtagtcaaccttgagccagagttctcccctccttacaattgatggtccctgaattgtcttttgggatgatttgaaactaaggactgatggattttggatcaagtgctctgaattgggtgaaaggttctttagggacga

SEQ ID NO: 32062 - DNA, 675 bp, Zea mays
  misc_feature: Ceres CLONE 1408871-F
  misc_feature: Encodes the peptide sequence at SEQ ID NO. 32063
  misc_feature (605)..(605): n is a, c, t, g, unknown, or other
aaagctggagctcaccgcggtggcggccgctctacactagtggatcccccgggctgcaggaattcgcacgagaccattacctagaacatcctaatcgaaaaacccatctctactcgagtctctgcgaatccgttgccggtagcctctctgcggtgagagttctgctgccgcctgctggagatgatggacgacggaggaggaggggtgcagtcgcagggcgtcaacccggactgccccaacgccgccaaccccttccaccgctgcgccgcgtattgccccgtccccgccccggcccccatcaaagccggccgccgccgccgagcggcagcaagcccgtctccgcctttacccgaggacgaaattcgttggccccccccgaacgggggggggggaacaccgggatctggcccttgccgcgttgccccctccccgcctctctattccgccgccccccataccaacccccgtatggctgggccctaggtaatcatgcggctcgcccagtccgcgccctctcccatatatctcccccccccctacgcgttcccgcggcgagtcttccctcaaccccacaaacagagacccccccccctctcccccgtatnccgggagtgggaatggccgcctatcccgcgtccctcctacaactccccccaccgctccgtaacaacaacc

SEQ ID NO: 32063 - protein, 100 aa, Zea mays
  misc_feature: Ceres CLONE 1408871-F
MMDDGGGGVQSQGVNPDCPNAANPFHRCAAYCPVPAPAPIKAGRRRRAAASPSPPLPEDEIRWPPPNGGGGTPGSGPCRVAPSPPLYSAAPHTNPRMAGP

SEQ ID NO: 32064 - DNA, 630 bp, Zea mays
  misc_feature: Ceres CLONE 1408889-F
aagctggagctccccgcggtggcggccgctcaagtacaatggatcccccgggctgcaggatttctcacgagaccattacctagaacatcctaatcgaaaaaaatagcaatttttctccctgggagcccgagacgcagcgcgaggtgcggccccgtcccctcgccaccggaggagcaggacgacgaggtggcgtcggcgcgaggtagtcgcgcgcctggaagagcggcggcatcggagtcgcaggcggaggcgaggaagtgaggggagagccctatagccaccgccgcggggcgtcgtgctcgctgcacgcactcccaccattttgtcccaactcgaagctcagactcgtgctgtcgtgttgtgcacgacccctcgcctaggggcccaagctcctaactgagaaaacaggagatgggaagagacggggaacagactaggcggcggagccgaaagagatccccgggacgcctccccctcctcgtcggattccgattcctttcgactcccccatcctctcccgagtaggaggccctgagccgaccggacccccacgcagaaagggggaaatagatcatccttccatcggcacccgcccccggcctgcaagaaaaagccgaccgggcccgggga

SEQ ID NO: 32065 - DNA, 687 bp, Zea mays
  misc_feature: Ceres CLONE 1408891-F
  misc_feature (576)..(576): n is a, c, t, g, unknown, or other
  misc_feature (608)..(608): n is a, c, t, g, unknown, or other
  misc_feature (614)..(614): n is a, c, t, g, unknown, or other
aagctggagctccccgcggtggcggccgctctagtaatagtggatcccccgggctgcaggaattcgcacgagaccattacctagaacatcctaatcgaaaacttggatagtccgtagccgcttgccctgttcgcatcttcgcgcgtggcgcacaccgctccagctctccttcgacgggcacggccgagccgccttcgtcttggccgcagcggtgcgcgctctccatggcgtcctaattagcctagccgcaacgccgcgcccgtgcctgcgaagtagggtgtaaagttttgtatatgatgccaggcatggatgaaccccttcttggcaatggtcttaagaccagcggcaaaagagagagcctgcttagtgccccagggcaggaaaaaggatgtaccttggtggggccactcatcgcctggcatggatccctacagaacatttgtccagaggataatcaatcatggtttgtccggtaaacgtggccgaagcttggccctctcccagggccccccatccgccaccttcctttggcaggaggtaacagggctttcacgctaaattgaccgggaaatggcnaagaaacccttggaaaaatattggggtggggnaaattngtttcgggcccaaaagcagacacttatccttctctggggaatccaccaaagcagaaggcgccacatccctcgt

SEQ ID NO: 32066 - DNA, 714 bp, Zea mays
  misc_feature: Ceres CLONE 1408896-F
  misc_feature: Encodes the peptide sequence at SEQ ID NO. 32067
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (16)..(16): n is a, c, t, g, unknown, or other
  misc_feature (19)..(19): n is a, c, t, g, unknown, or other
  misc_feature (44)..(44): n is a, c, t, g, unknown, or other
  misc_feature (45)..(45): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (68)..(68): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (108)..(108): n is a, c, t, g, unknown, or other
nggggggggnnngggnacnccaccccccccccccccccaggggnntttnnnnnnnttgaggggnnntnggnnnnnnttcatattgtactccccgtaggggcggccgcnctagatacacgacacccccgggctgcaggaattttcacgagaccattaccgagaacatcctaatcgaaaacttccaccacgcagtcactcccgggccgccgccgccgccgcctccgcgaaaaaccctagcaggcttcgccgctatcactccaaggggcgcgaccatggtggccacaaagaagacgaagaaatccacggacaacatcaataacaagctgcagcttgttatgaatagtggcaagtacactctcggctacaagaccgtcctcaggactctcaggaactctaagtcgaagctagtgatcatcgctaacaactgcccgccccttcgtaagtctgaaattgagtactatgcgatgctggccaaggtcactgtccaccacttccatggaaacaatgtcgaccttggaactgcctgtggtaaatactttcgggtctgctgcctcagcattattgatcctggggattctgatatcatcaagactacaccggggtgagcagtaaagaagccctgcaggagggggatcttactgcattgggtcctctgtcttgtaaacagcatttacctgctagtaaactggagttatcggaacattgtcttgaatt

SEQ ID NO: 32067 - protein, 110 aa, Zea mays
  misc_feature: Ceres CLONE 1408896-F
  misc_feature (12)..(106): Pfam Name: Ribosomal_L7Ae Pfam Description: Ribosomal protein L7Ae/L30e/S12e/Gadd45 family
MVATKKTKKSTDNINNKLQLVMNSGKYTLGYKTVLRTLRNSKSKLVIIANNCPPLRKSEIEYYAMLAKVTVHHFHGNNVDLGTACGKYFRVCCLSIIDPGDSDIIKTTPG

SEQ ID NO: 32068 - DNA, 2407 bp, Zea mays
  misc_feature: Ceres CLONE 1408899
  misc_feature: Encodes the peptide sequence at SEQ ID NO. 32069
atttggcataacctcgcgcaactatcacagcacaggcacccctgaggcccagacctgatctcgccggcggcgagcttgtgtccatggctgacggggccgagatggacgaagaggctatgcgggccttcttcccgctctccttcggaaaggcggctccgcggcccagctctgctacctcctccgcccactccaacacccttcgcaagcctcaaaaccctagtaaccccaagccttccgcctctaccgccgcggacgacgatggggccgctatgattggtcctcctcgcccgccgccggcgcccgcgggggaggaagacgatgaggacggcggcggtatcatgatcgggccgcctcggccaccgccgccctccgctcgcggcgagggggacgacggcgacggcatgattgggccgcctaggccgccgccagcggatgatgaagacgtcgatgatgatgaggacgacgacgaggaggagatggaggatgatggggagggtggattcaatcggatccctcttagcaacgaaattgttctgcgggggcacaataaggttgtctctgcccttgctgttgaccatacaggatcaagagtgctctctggtagctatgattatacagtgcgtatgtacgacttccagggtatgaattcaaagcttcaatcattcagacaattggaaccatttgagggccatcaagttcgtaacctaagttggagtccaacgtctgatcgattcttatgtgttactggttcagctcaggccaagatttacgacagggatggacttacactaggcgagtttgttaagggtgatatgtatattcgtgatctgaagaatacaaaaggtcacatctctgggcttacaggtggtgagtggaatccaaagtcaaaagaaaccattttgacatcatctgaagatggctccatgcgtctctgggatgtgtctgattttacaagtcagaagcaggtcatcaaacctaagctggtacgaccaatgcggattcctgttacatcatgtgcatgggaccatgaagggaaacgaattgtgggtggcataggggatggttctatacaggtttggaccataaaagctggatggggtagcagaccagatatccacgttgagaaaacacacacagaggatattactggggttaagttctcaacagatggacagagtcttctgtcaagaagtatggatagtactcttaagatatgggatttgagaagaatgaaaactcctttgaaagtatttgaagatctgccaaatcactacgctgagacaaatgcagcatttagctcagatgagcagcttatttttacaggaacatctattgaaaaagatggtgacaatgggggattactttgtttctttgatagaaagaaacttgagcttgtatcaagggtgggaatttcagcacattacagtgtgataaggtgcctctggcatccaagaatcaaccaggtgtttgcaacagttggagacaagaaagaaggtgggactcatatcctgtacgatccttctattagtcaaaggggagctcttgtatgtgttggacgagcaccaaggaaaaagtctgttgatgattttgaggtgcaacctgtcatacacaatccacatgcattgccacttttcagagatcaaccaagtcgtaagcgtcaaagagagaagatactgaaagacccactcaaatcccacaaaccagaagcacctgttaatggtccaggttatggtggaagagttggtactacaaaaggcagtttgctgacacagtatctcttgaaggaaggtggtttaattaaggagacctggatggatgaagatccaagagaagccattttgaagtatgctgatgctgcggagaaagacccaaagtttattgcgccagcttattcccaaacccagccgaaacctgtttttgcggagtctgattcagacaatgaagagaaataaccatgcgcctggttatctaagctagcatgcacctgcattctgttttctgacagatgtctcttgatgagcttgttgcacatgccctgtaacctgcttttcaacagtggagaaacaaaagagcatcttcaagggtcttgatgataggagctctgccccttcattacagatggataggattagtaatcacgacacttcagcactagagcctctatgatttgttggatgttgtacccactgtatgtacttagttctgaaacagtggccaatctatattatactctctcggttctttcttttttatttgtcgcggtctagttcaaaaataaactagcgggcgacaaatattcaagaacagaggtagtatatggcttagacgtaactttagtgcaccgaatgtagtcaacctttgtttgctttggagaatgaggatttgttgttcaaaaaaaaaaaaaaaa

SEQ ID NO: 32069 - protein, 622 aa, Zea mays
  misc_feature: Ceres CLONE 1408899
  misc_feature (145)..(183): Pfam Name: WD40 Pfam Description: WD domain, G-beta repeat
  misc_feature (341)..(379): Pfam Name: WD40 Pfam Description: WD domain, G-beta repeat
  misc_feature: SWISSPROT Homolog: EC 2.3.1.48 Histone acetyltransferase
MADGAEMDEEAMRAFFPLSFGKAAPRPSSATSSAHSNTLRKPQNPSNPKPSASTAADDDGAAMIGPPRPPPAPAGEEDDEDGGGIMIGPPRPPPPSARGEGDDGDGMIGPPRPPPADDEDVDDDEDDDEEEMEDDGEGGFNRIPLSNEIVLRGHNKVVSALAVDHTGSRVLSGSYDYTVRMYDFQGMNSKLQSFRQLEPFEGHQVRNLSWSPTSDRFLCVTGSAQAKIYDRDGLTLGEFVKGDMYIRDLKNTKGHISGLTGGEWNPKSKETILTSSEDGSMRLWDVSDFTSQKQVIKPKLVRPMRIPVTSCAWDHEGKRIVGGIGDGSIQVWTIKAGWGSRPDIHVEKTHTEDITGVKFSTDGQSLLSRSMDSTLKIWDLRRMKTPLKVFEDLPNHYAETNAAFSSDEQLIFTGTSIEKDGDNGGLLCFFDRKKLELVSRVGISAHYSVIRCLWHPRINQVFATVGDKKEGGTHILYDPSISQRGALVCVGRAPRKKSVDDFEVQPVIHNPHALPLFRDQPSRKRQREKILKDPLKSHKPEAPVNGPGYGGRVGTTKGSLLTQYLLKEGGLIKETWMDEDPREAILKYADAAEKDPKFIAPAYSQTQPKPVFAESDSDNEEK

SEQ ID NO: 32070 - DNA, 648 bp, Zea mays
  misc_feature: Ceres CLONE 1408904-F
  misc_feature: Encodes the peptide sequence at SEQ ID NO. 32071
aagctggagctccccgcggtggcggccgctctagaactagtggatcccccgggctgcaggaattcgcacgagaccattacctagaacatcctaatcgaaaaaaaagaaagaaaaaataggcggctctgctggaaacgacgttcacatgcgcggctgcttctctctcgacgtcttcttcctcaatgccttctatatctcccatttggttcacgtcctcgagattctgagtaacagcgtcgaacgcaagcaaccttacatccgtcaagaagaacaggtcacgacatcatggctctgacatgaatgcacccacagaaatcaactccactgaacaacctcgtatagacgcttgattccttacgagaagttgcaatgccagaatgatacatgatgtacgctatacccaaggccaggaagattacgaagcctatggcctcccgggtggaaagggcattgtttcctaaaaaccgggagggggggatacaaaaacggcggaaaaaaaaaaaagcggggcaaaatccccaaaacggggggggggcccctacaagggggtttccttttccccccgaaaaattcagtaaaaaatggggggggggggggagcctctttaaaaaagatggggaacaacgggatgcgacccccccctggtgt

SEQ ID NO: 32071 - protein, 49 aa, Zea mays
  misc_feature: Ceres CLONE 1408904-F
MRGCFSLDVFFLNAFYISHLVHVLEILSNSVERKQPYIRQEEQVTTSWL

SEQ ID NO: 32072 - DNA, 675 bp, Zea mays
  misc_feature: Ceres CLONE 1408913-F
  misc_feature: Encodes the peptide sequence at SEQ ID NO. 32073
  misc_feature (366)..(366): n is a, c, t, g, unknown, or other
  misc_feature (384)..(384): n is a, c, t, g, unknown, or other
  misc_feature (391)..(391): n is a, c, t, g, unknown, or other
  misc_feature (415)..(415): n is a, c, t, g, unknown, or other
  misc_feature (416)..(416): n is a, c, t, g, unknown, or other
  misc_feature (424)..(424): n is a, c, t, g, unknown, or other
  misc_feature (425)..(425): n is a, c, t, g, unknown, or other
tggagctccccgcggtggcggccgctctagaactagtggatcccccgggctgcaggaattcgcacgaggccattacctagaacatcctaatcgaaagtccttggcgtggtgtcctcgtcctcgtgcccatctctgtcccaatcaaactgattgatccgtcgcccgcagggccacagcagccgcggcgaggtcgtccgtcggattcggaggctcagttattactgaaaagataatacagtacctatggcttctctggacgccgtgcgaggagacctcgccctgctgattctgtacctgaacaaggccgaggcgcgggacaagatctgccgagcgatccagtacgggtccaagttcatcagcaacggngagccagggcctgcgcanaacgtcnacaagtccaccagcctggcccggnnaagtgtcnngctctgtaaagtcgtcaacgacctgcacgctttgatcagccctcctgccagggggactccgctcccgctgatcctacctcggaagtccaagaacgggatgcttgcgacttttctcctcctggacccaaatcggtgtggccggggggggccgggaatatcacagaaaaaggggggggccggagttcccccggaaggaaagggttataatgggtccctgggttccaaaccggggaggggccttttttgaaga

SEQ ID NO: 32073 - protein, 142 aa, Zea mays
  misc_feature: Ceres CLONE 1408913-F
  misc_feature (47)..(47): Xaa is any aa, unknown, or other
  misc_feature (50)..(50): Xaa is any aa, unknown, or other
  misc_feature (58)..(58): Xaa is any aa, unknown, or other
  misc_feature (61)..(61): Xaa is any aa, unknown, or other
MASLDAVRGDLALLILYLNKAEARDKICRAIQYGSKFISNGEPGPAXNVXKSTSLARXSVXLCKVVNDLHALISPPARGTPLPLILPRKSKNGMLATFLLLDPNRCGRGGPGISQKKGGAGVPPEGKGYNGSLGSKPGRGLF

SEQ ID NO: 32074 - DNA, 682 bp, Zea mays
  misc_feature: Ceres CLONE 1408915-F
  misc_feature: Encodes the peptide sequence at SEQ ID NO. 32075
  misc_feature (583)..(583): n is a, c, t, g, unknown, or other
tggagctccccgcggtggcggccgctctagaactagtggatcccccgggctgcaggaattcgcacgagaccattacctagaacatcctaatcgaaaactcccgtccgtatctctctcttgctcgcactcgcggagatcgaagagaagcgcaggaggccccagcactagcgccgccccgccgccgcatcagacatggcgctggccgctcgcctcgtctcgcgctcccgtcagctatattcggttcaagccactttggggaatggaggtgtcactcaagttcgctcctttgccaaggatgcagctccagctgaccgtcctcctgtcagtggggatgatctcctgaagggcatattctttgacgccccgaagagggggagacggctcttggtgctcttaaaaaggaaaagatcactattgatccagatgacccaggggcagtttctcgttatgcccaagtcatgaagactgtaagggaaaaggcggatcttctctctgattctcaaaggattaaatataccattgagaccttcaccaagggcatcccctgatgcacggacttacttgaatactctccaccgctcanaaaaaaagagtggccttatagaccatcccgggaattgagcccttggaggagggaagctcttgagaagaatggggaaggacttcagaaacccctcttgga

SEQ ID NO: 32075 - protein, 89 aa, Zea mays
  misc_feature: Ceres CLONE 1408915-F
MALAARLVSRSRQLYSVQATLGNGGVTQVRSFAKDAAPADRPPVSGDDLLKGIFFDAPKRGRRLLVLLKRKRSLLIQMTQGQFLVMPKS

SEQ ID NO: 32076 - DNA, 709 bp, Zea mays
  misc_feature: Ceres CLONE 1408922-F
  misc_feature: Encodes the peptide sequence at SEQ ID NO. 32077
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (12)..(12): n is a, c, t, g, unknown, or other
  misc_feature (14)..(14): n is a, c, t, g, unknown, or other
  misc_feature (16)..(16): n is a, c, t, g, unknown, or other
  misc_feature (23)..(23): n is a, c, t, g, unknown, or other
  misc_feature (34)..(34): n is a, c, t, g, unknown, or other
  misc_feature (39)..(39): n is a, c, t, g, unknown, or other
  misc_feature (46)..(46): n is a, c, t, g, unknown, or other
  misc_feature (47)..(47): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (451)..(451): n is a, c, t, g, unknown, or other
  misc_feature (472)..(472): n is a, c, t, g, unknown, or other
nnnnccggggcncncnccccccngcggggggggnggggncgggggnntttannnnnnnnnnnnnnnnnnngggggnnnncccaaagctggactccccgcggtggcggccgctctagttcaaaggatcccccgggctgcaggaatttgcacgagaccattacctagaacatcctaatcaaaaaaacaaccgatcgcccacgcaaacctctcctcaactcgatcaaaccggggacggaaaaggcccaccaaaatcccccaaaatttcgtacctcctcagccccagcaatctcgaatcccgatgctcacagcctccaccgaatccctggcggtcgtcatcagcgcatgagctttcttcgctcgctagcggactccttctcatcgctgctcttctcgtcgggaggcggggcggtgtccatggacgcggcgggggcggccccgtcgccggcggcgntggtgggggagcgcgtggcgntgaagctcagggggtacttcgacctcgccaaagaggagatcgacaagggcgtgcgcgctgaggagtgggggctccccgacgaggccaccgcgcactaccgcaacgcgatgcgggtcatgctcgagggccagggccgcgcgggtccccgatgccggctcctcccaggagaggggggcaggtcagggtggaccaggaagaagaccgccaaggggcaggcccagggcgaggaagcgtttc

SEQ ID NO: 32077 - protein, 122 aa, Zea mays
  misc_feature: Ceres CLONE 1408922-F
  misc_feature (37)..(37): Xaa is any aa, unknown, or other
  misc_feature (44)..(44): Xaa is any aa, unknown, or other
MSFLRSLADSFSSLLFSSGGGAVSMDAAGAAPSPAAXVGERVAXKLRGYFDLAKEEIDKGVRAEEWGLPDEATAHYRNAMRVMLEGQGRAGPRCRLLPGEGGRSGWTRKKTAKGQAQGEEAF

SEQ ID NO: 32078 - DNA, 670 bp, Zea mays
  misc_feature: Ceres CLONE 1408924-F
  misc_feature: Encodes the peptide sequence at SEQ ID NO. 32079
  misc_feature (651)..(651): n is a, c, t, g, unknown, or other
tggagctccccgcggtggcggccgctctagaactagtggatcccccgggctgcaggaattcgcacgagaccattacctagaacatcctaatcgaaaaatttcagtttggaactgaactgggaatgacgaggccgaggacaaaagcaaattgacaccttctccgttcccgacgactcccgtgagcgtggagcggcgactaggcgaggccatggcctccggcatcggctccggccagcagcaacccccagcgccggcggcagatgctgacccgggagccgtcggcgacaagctcgtcttcgaagcgccgcctcagcccgtgaaggaggactacgtccagaacgccgtcaagtttctctcccaccccaaggtcaggggctcccccgtcgtctacaggcgatccttcctcgagaagaagggccttagcaccgaggagatcgacgaggccttccgaagggttcctgatcctcaacccagtactacggctaccacttctccgcagcagcaggtcaacagccagatcaatcccgtcggggtgcaagcttatgcgccagcacaacctgtgcacccagcaacgctgggccctgtcgtcttccacgcagcccagggtttagctggtacaagcattcctggctgcgggctcttggcttgggnttttggtgctagcgctgct

SEQ ID NO: 32079 - protein, 154 aa, Zea mays
  misc_feature: Ceres CLONE 1408924-F
  misc_feature (37)..(142): Pfam Name: Pex14_N Pfam Description: Peroxisomal membrane anchor protein (Pex14p) conserved region
  misc_feature (148)..(148): Xaa is any aa, unknown, or other
MASGIGSGQQQPPAPAADADPGAVGDKLVFEAPPQPVKEDYVQNAVKFLSHPKVRGSPVVYRRSFLEKKGLSTEEIDEAFRRVPDPQPSTTATTSPQQQVNSQINPVGVQAYAPAQPVHPATLGPVVFHAAQGLAGTSIPGCGLLAWXFGASAA

SEQ ID NO: 32080 - DNA, 612 bp, Zea mays
  misc_feature: Ceres CLONE 1408925-F
  misc_feature: Encodes the peptide sequence at SEQ ID NO. 32081
  misc_feature (555)..(555): n is a, c, t, g, unknown, or other
tggagctccccgcggtggcggccgctctataactagtggatcccccgggctgcaggaattcgcacgagaccattacctagaacatcctaatcgaaaaaccaccgctctgcctcgcctcgcctcacctcacctcacctcacctcgccgactagggttttgtaccgccgtggatctcgccgtccccgccatggacgtctcgcacgcgggatcctccgtcgccggcgaggctccgaccaccggggagcaccggatggggactaccatcgtcggggtctgctacgagggcggcgtcgtcctgggcgccgattccaggaccagcactggaatgtatgtagccaaccgtgcttcagacaagattactcaactgacagacaatgtgtatgtctgtcgctctggatctgctgctgatacacaagtcatttcggattatgtacgctatttcctccaccaacacacaatccagcttggacaaccagctaccgttaaagttgcagccaacttgattaggttgctagcttatcagaacaagaacatgttgcaagctggcatgattgnttggaggatggggacaagtacccaggggagggccaaatttttttccccacccccccc

SEQ ID NO: 32081 - protein, 141 aa, Zea mays
  misc_feature: Ceres CLONE 1408925-F
  misc_feature (20)..(138): Pfam Name: Proteasome Pfam Description: Proteasome A-type and B-type
  misc_feature: SWISSPROT Homolog: EC 3.4.25.1 Proteasome endopeptidase complex
  misc_feature (123)..(123): Xaa is any aa, unknown, or other
MDVSHAGSSVAGEAPTTGEHRMGTTIVGVCYEGGVVLGADSRTSTGMYVANRASDKITQLTDNVYVCRSGSAADTQVISDYVRYFLHQHTIQLGQPATVKVAANLIRLLAYQNKNMLQAGMIXWRMGTSTQGRAKFFSPPP

SEQ ID NO: 32082 - DNA, 655 bp, Zea mays
  misc_feature: Ceres CLONE 1408930-F
aagctggagctccccgcggtggcggccgctctataatagtggatcccccgggctgcaggaattcgcacgagaccattacctagaacatcctaatcgaaaaaacagaaccttcgttccctgccgtctcttgtcggtctggccggccgaggtgggtgatctgtagagcgaaacgccgagccggcagaggagggaggccgcaccggcgattgtagaagcagaaccggtggaggagtagaggagggctccgaatcgatgcgcggctccgcggacgccgtcgtggttgctcggaacgtggcgacctcgtctagcccgtccaaggacgcgtcgacgttggacatgaccgagtacccgaaaccaccaccaatcccgttcgcctgccgctggagctgcacttgaacggttgtgttcatcggtgttctttcctgaaaccaaacccccgaatttgcgctctctttccccaagtagggggtgttgcgggctcctcgggcgcttgattcaacaaatttatcccttttcccgccgtggtcggggccccttccctggtggtcctcttccaaaggttttccgaggcaaccgcttgcatttggcggggcaggccaagcaggttttcgcgggcttcggcggcccggggacttccaccccccccccttgtgtg

SEQ ID NO: 32083 - DNA, 658 bp, Zea mays
  misc_feature: Ceres CLONE 1408931-F
  misc_feature: Translation starting site: 346
  misc_feature (524)..(524): n is a, c, t, g, unknown, or other
  misc_feature (539)..(539): n is a, c, t, g, unknown, or other
  misc_feature (546)..(546): n is a, c, t, g, unknown, or other
  misc_feature (658)..(658): n is a, c, t, g, unknown, or other
agctggagctccccgcggtggcggccgctctagaactagtggatcccccgggctgcaggaattcgcacgagaccattacctagaacatcctaatcgaaaaatcgatcgtgaatgcacgtatgaccattctcattgacctgaatactgaaaatactaccgtgagtgccactgtgccgcagctgcctgctctccattactggaagctgtgttcaatcaaagcttacttacgctccctctacatctgatccatgctaagtacctagccaggactactcaagggccgtggcaagaatcaggcagagagatagcaggctggcctatctagctgatctcgcgcgaccaagaatgctcgcaattgccaggaacatgctggcgccgctcctggtgctcaacctcatcatgtacatcatcgtcatcggcttcgcgagctggaacctgaaccacttcatcaacgggcagaccaactaccccggcgtgggcggcaacggcgcgacgttctaccttcctggtgttcccatcctggnccgggcgtggtggancgcgatnttccaagctggcggccgagcaccacgtgcgcgcctggcgccacgacagcctggccaccaacgccgcgtcgtcgctcatcgcctgggccatcacggcgctcgcccttcgggtn

SEQ ID NO: 32084 - DNA, 649 bp, Zea mays
  misc_feature: Ceres CLONE 1408932-F
  misc_feature: Encodes the peptide sequence at SEQ ID NO. 32085
  misc_feature (649)..(649): n is a, c, t, g, unknown, or other
aagctggagctccccgcggtggcggccgctctataactagtggatcccccgggctgcaggaattcgcacgagaccattacctagaacatcctaatcgaaaaatcacgaagagtcatcacgccatacgacacggaggacaccgagccggaggcgaagccggtgcgcagcgcgagagtagcggcgagtcggcgaccatcaagcaactgcatggccgcgttacccgccagcacccccgcccccgcccccgccccctccgaggcggcggagctcgtgccgacgctctcctcgctggagccggtctacggcgcgggcgcgcagctcgacgaggcgcgcctccgcttcgcccgcctcggggaccgcttccacgccgtctacggagcccgccccgcgttctttccccgctccccagggagggtcaatctgatcggggagcacatcgactacgagggctactcggtggtgccgatggccatccgccaggaaatgatcgtcttcttccgaagggctcaacggcgtccaggtgagggtcgccaaacgtcaacaacaagaacccccctctggggtctaccccggccgctccaagacaaggaaatttgaccgtaaaaaaatcaccaaatgtggcgcccctaatttcatggtgggggccaan

SEQ ID NO: 32085 - protein, 129 aa, Zea mays
  misc_feature: Ceres CLONE 1408932-F
  misc_feature: SWISSPROT Homolog: EC 2.7.1.6 Galactokinase
MAALPASTPAPAPAPSEAAELVPTLSSLEPVYGAGAQLDEARLRFARLGDRFHAVYGARPAFFPRSPGRVNLIGEHIDYEGYSVVPMAIRQEMIVFFRRAQRRPGEGRQTSTTRTPLWGLPRPLQDKEI

SEQ ID NO: 32086 - DNA, 675 bp, Zea mays
  misc_feature: Ceres CLONE 1408935-F
  misc_feature: SWISSPROT Homolog: EC 1.11.1.7 Peroxidase
  misc_feature (338)..(338): n is a, c, t, g, unknown, or other
gctctagaactagtggatcccccgggctgcaggaattcgcacgagaccattacctagaacatcctaatcgaaaaagcggcaactacacgccagagagagggaaggggaggttggccagagagccgagagcagccctgcagtcgagagcatccgactgctagctactagcaatagcataggcagataagctcgggccgggccggggcacgcgcacaatgaggtcgcggcggtggcacagcgtggtcgccgtagcgctggcagcggcggcgtggtggtggtgcgcggcggcgcaggcgcaggcgcaggcgcagctgagccagagctactacgcgtcgacntgccccgacgtggagacgctggtcccgcggcgccgtcacccagaagctgcaggagaccttcagcgcgccgccgggcacgctccgcctcttcttccacgactgcttcgtcaggggctgccacgcggccgtgctgctgtcggtccccgacgaagagcacggagcgggggacgaaccccacgctgtcccccgagatcggctcggacctgttcccctgcctcctggcccgcccccggaacgccaagcaccgcctgggccacctcgggagggtctcggggcagtcaggctttaccctttcccggtcaggggactggtcgttccgaaaatgtgtcggttgggg

SEQ ID NO: 32087 - DNA, 647 bp, Zea mays
  misc_feature: Ceres CLONE 1408936-F
  misc_feature: Translation starting site: 196
  misc_feature (391)..(391): n is a, c, t, g, unknown, or other
  misc_feature (528)..(528): n is a, c, t, g, unknown, or other
  misc_feature (599)..(599): n is a, c, t, g, unknown, or other
aagctggagctccccgcggtggcggccgctctagaactagtggatcccccgggctgcaggaattcgcacgagaccattacctagaacatcctaatcgaaaagcacaacacaacgcttatattacttacaacaaaagataagcccacgaatcagtagatcgaggtcccgcccagtccagcagaagcgcacacggagatgtcccagctgagccctgctggccacatggctgcgacgctcctcctcatcctcctggcctccgcagcagcagcagcggtgtcagctgaccaacaggtctctgcctgccagaatgacatagacgcactgtggcgcagctgcaagcagttcgtccagaaggaggggcccaagatgcctccgtccgaggactgctgcnaaacatcaaggccttagacgcgcacgcgtcctgcatctgcgactacgtcggctccccggacgccaggaataagctagacctggacaaggtggtcttcgttacaaacagtgcggcgtcaccgtccccaagggctgcgnatcaaagcaggactggagagcggctgaatctgaatgggagcagttggctacatacgcacggcagctacaantacttataggaataataaaagtggtcaactggtggtttcatggggtgg

SEQ ID NO: 32088 - DNA, 638 bp, Zea mays
  misc_feature: Ceres CLONE 1408937-F
  misc_feature (344)..(344): n is a, c, t, g, unknown, or other
  misc_feature (409)..(409): n is a, c, t, g, unknown, or other
  misc_feature (443)..(443): n is a, c, t, g, unknown, or other
  misc_feature (474)..(474): n is a, c, t, g, unknown, or other
  misc_feature (521)..(521): n is a, c, t, g, unknown, or other
  misc_feature (526)..(526): n is a, c, t, g, unknown, or other
  misc_feature (534)..(534): n is a, c, t, g, unknown, or other
  misc_feature (535)..(535): n is a, c, t, g, unknown, or other
aaagctggagctccccgcggtggcggccgctctagaactagtggatcccccgggctgcaggaattcgcacgagaccattacctagaacatcctaatcgaaaaaacgcgcctacgcttcgtcaacaccggaaccgcccccaccccgccccgagcgccaattgcaccgccgctcccggccaaaccggccaagtcaacggcgcatccacttctccttaccatcccggaggtaatcttgcgccgattcggtgccgatttgcgccatccgcgaccggaggctccgccgggtcttgtgttcttgcggggcgggggctcaggacaacctggcctctgcttgattggattcngggcgttcggcgcctccagctcgcgatctttccctgccggttcgtcgaccgctggtcaacctggncggtcggtcccgggggctcttcacctccgtgctngctgccaccgtcgctttagtcaagtcttggncaagattttagctatctccggtcaaaggctttacccgatcttggatnggtgncttcttgnnggcgagaaggccggtcctgtttcgtctcttgtgctccagcatggtctgtagcacaccggttccccatctccagtgaaggtggtcgtgtgctcttgggttttgg

SEQ ID NO: 32089 - DNA, 648 bp, Zea mays
  misc_feature: Ceres CLONE 1408940-F
  misc_feature: Translation starting site: 251
  misc_feature: SWISSPROT Homolog: EC 1.2.1.3 Aldehyde dehydrogenase (NAD(+))
  misc_feature (483)..(483): n is a, c, t, g, unknown, or other
  misc_feature (519)..(519): n is a, c, t, g, unknown, or other
  misc_feature (559)..(559): n is a, c, t, g, unknown, or other
agagctggagctccccgcggtggcggccgctctagaactagtggatcccccgggctgcaggaattcgcacgagaccattacctagaacatcctaatcaaaaacctcctctgcctgccgcttctcctgctgcgggcggtcacggctgcaagtactagaggaggacatccgcttccattactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgctgcgcaggacagtgcctgcagatgggatgcacaggctgttgccaggtgtccttcagaggttcagcactgcagcagcagtagaggagcccatcacgccgtcagtccatgtgaactacacaaagctcctcattaatggcaacctttngtgattccgcatccggcaagaacctccccactctgnaccctcgtacaggggaggtgattgctcatgtgggtgaggntgacgcagaggacataaccgtgcagtagctgcggctcgcaaggcttttgatgaaaggccatggccgaagatgactgcctatgagaggtc

SEQ ID NO: 32090 - DNA, 631 bp, Zea mays
  misc_feature: Ceres CLONE 1408943-F
  misc_feature: Encodes the peptide sequence at SEQ ID NO. 32091
aaagctggagctccccgcggtggcggccgctctagaactagtggatcccccgggctgcaggaattcgcacgagaccattacctagaacatcctaatcaaaaaatccgctccccgccttccgcttccctaccccccgcatcacctaccaacgccgacaccatgggggccttcgcgaatgaggagcaccagttcctcgccgagctcggcctcgcgcagcgcaacccgggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttcgacgccgctaagacatggatggcgattcctgctccaaagcgaggagagatcgttagggcaatccggtgatgcactgagagcaaagctccatcaccttgccaggcttgtgtcacttgagatggggaaaattcttcctggagggatcggtggaggtcaggaaatcattgacatgggtggatatgctgggggaatagtccccaactaaatggaccattatacccatctgacgaccaaccatatgatgatggaggtgtggaaccccttggagttg

SEQ ID NO: 32091 - protein, 89 aa, Zea mays
  misc_feature: Ceres CLONE 1408943-F
  misc_feature: SWISSPROT Homolog: EC 1.2.1.3 Aldehyde dehydrogenase (NAD(+))
MGAFANEEHQFLAELGLAQRNPGAFACGAWGGSGPTVTSTSPTNNQVIAEVVEASVHDYEEGMRACFDAAKTWMAIPAPKRGEIVRAIR

SEQ ID NO: 32092 - DNA, 674 bp, Zea mays
  misc_feature: Ceres CLONE 1408945-F
  misc_feature: Encodes the peptide sequence at SEQ ID NO. 32093
aaagctggagctccccgcggtggcggccgctctagaactagtggatcccccgggctgcaggaattcgcacgagaccattacctagaacatcctaatcgaaaaacaacaacgagttaacgaaagccttttatccaagctcaggaaagctcacagtttcgttggatccaatcttagttttatccaagctcagcaatggcttctcgtcagcagcatcctactagctaccacgccggcgagacaaaggcccgtgccgaggagaagacgggtcaagtgatgggggcggcgcaggaaaaagggaggaggccaaggacaaggggtcggaagccgccgaccgggccatgggaatgcccccgaagccggaaggccaccaggagaagggggggggcgcccgcgaacaaaacatggggggggggtaaaatgtgggtataaacccctgcgatgggggtatcgccccccggctccttccctccaagggcttggccgcctcgcgttacctttttcttaattggcgagaatataatactcctccccacccccccaacaccgcccccgcccccccgccacccctctcccccagattcgtcagcaggtgtataatctaatattggccgccccggacggtcattacggctaacacagagtgtgctatctcactccccaaccgacgcttccag

SEQ ID NO: 32093 - protein, 78 aa, Zea mays
  misc_feature: Ceres CLONE 1408945-F
MASRQQHPTSYHAGETKARAEEKTGQVMGAAQEKGRRPRTRGRKPPTGPWECPRSRKATRRRGGAPANKTWGGGKMWV

SEQ ID NO: 32094 - DNA, 616 bp, Zea mays
  misc_feature: Ceres CLONE 1408953-F
  misc_feature: Encodes the peptide sequence at SEQ ID NO. 32095
  misc_feature (362)..(362): n is a, c, t, g, unknown, or other
  misc_feature (365)..(365): n is a, c, t, g, unknown, or other
  misc_feature (434)..(434): n is a, c, t, g, unknown, or other
  misc_feature (459)..(459): n is a, c, t, g, unknown, or other
  misc_feature (460)..(460): n is a, c, t, g, unknown, or other
aaactggagctccccgcggtggcggccgctctagaactagtggatcccccgggctgcaggaattcgcacgagaccattacctagaacatcctaatcgaaaaaggggcgcagcaaaaccctagccgccttcccgtccttttcctttcataaaccccaagccgcgccgcaatagctcgccccctcgttcgccgcctctcctgctcctaccgcagctctccctcaggtttagtgttcgcaatggcggccttcaacaagcttggtggccttctaaggcacagtgctctggtgagcggtatcactggtggctcttctcctgcagtgttcaatgctgcacggctcatgtctaccaaagctattattgntgntcttgactggggtgttgatgacgtgaaactaagagagcattagcagctttggagaggtactgaagcgangtgatcacagacaggagactggganngtcagagctttggctttgtgaactactccgacgtgatgctgccaaggaaactatttctgcaatggatggcaaggaaaatgagggccggaaggaacggggcaacatggcctaatgaaaaacctgctggaacccggggtgtgggcgggttatgggggc

SEQ ID NO: 32095 - protein, 56 aa, Zea mays
  misc_feature: Ceres CLONE 1408953-F
  misc_feature (42)..(42): Xaa is any aa, unknown, or other
  misc_feature (43)..(43): Xaa is any aa, unknown, or other
MAAFNKLGGLLRHSALVSGITGGSSPAVFNAARLMSTKAIIXXLDWGVDDVKLREH

SEQ ID NO: 32096 - DNA, 662 bp, Zea mays
  misc_feature: Ceres CLONE 1408958-F
  misc_feature: Translation starting site: 250
  misc_feature (369)..(369): n is a, c, t, g, unknown, or other
  misc_feature (560)..(560): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (656)..(656): n is a, c, t, g, unknown, or other
tggagctccccgcggtggcggccgctctagaactagtggatcccccgggctgcaggaattcgcacgagaccattacctagaacatcctaatcgaaaagcgccgtccttccccttctccttgcgcaggttcaggcctgaccgcctgagaaactggaaggtggcggcgacctcgggggttgatcggcgacttgggtcggattagtttccggaagagcactggaggagaaggcctgtttggagcaaatttcgatggcaaccggcgagaccgccgtggatcgtcgcaaggaccctctcggcccccgcgacatggatttgtcaggggaggagcacgtccccaaggcgcggaagccgtacacgatcacgaagcancggaagaagtggacggaggacgagcaccggcggttcctgggaggccctgcagctgcacggtcgcgcctggcgccacatacaagagcacatcggcaccaagactgccgtgcaaatccggagccacgcgcagaagtcttccacacaagggttgtccgagagtcatccgtcaggatgtaccggccttctgcggncgccggcgccccggcgatccaggtccccgccgccgcggccccaaagagggaagccggcgcacctaccggnnnaaagggggggggggcggggggggncccaag

SEQ ID NO: 32097 - DNA, 648 bp, Zea mays
  misc_feature: Ceres CLONE 1408961-F
  misc_feature (253)..(253): n is a, c, t, g, unknown, or other
  misc_feature (319)..(319): n is a, c, t, g, unknown, or other
  misc_feature (329)..(329): n is a, c, t, g, unknown, or other
  misc_feature (330)..(330): n is a, c, t, g, unknown, or other
  misc_feature (350)..(350): n is a, c, t, g, unknown, or other
  misc_feature (351)..(351): n is a, c, t, g, unknown, or other
  misc_feature (405)..(405): n is a, c, t, g, unknown, or other
  misc_feature (408)..(408): n is a, c, t, g, unknown, or other
  misc_feature (413)..(413): n is a, c, t, g, unknown, or other
  misc_feature (434)..(434): n is a, c, t, g, unknown, or other
  misc_feature (451)..(451): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
aaagctggagctccccgcggtggcggccgctctagaactagtggatcccccgggctgcaggaattcgcacgagaccattacctagaacattctaatcgaaaactctcgtctcgtctcgtctgcagtagcagtctccgcatccgctgcctccgcctcctccgtcgatttggattcgcagcggcggcggcggccaatcaaagcaatcatcacccagtcgcccagcccaaagaacgctccagtccccagccctccnacccgcctcgatcgatgcgaggcacaatgccggccaccgactcctcctcctcctctcctcctctgncggggggggnnggccgctgtcctccatcggnncgctcatccgctcggttcggcgtggacagaaccagaatcacttctttcccgcgncgncaganggcacagaacgctttcagggncgcgccgcccaattccntgggcgacctccggagnnncgaaaaaaggtctctttctcgggctgaaaggggcggcctcttcgaatcttcctcctgggcgcccggggaggttcggggcctggtctctgggttcgggggaattcccccggtggtcgggcccccgctgaacgcctcggttgccgaatttccgaaacgggcccgtaaaggggctcgacct

SEQ ID NO: 32098 - DNA, 662 bp, Zea mays
  misc_feature: Ceres CLONE 1408962-F
  misc_feature: Encodes the peptide sequence at SEQ ID NO. 32099
  misc_feature (328)..(328): n is a, c, t, g, unknown, or other
  misc_feature (452)..(452): n is a, c, t, g, unknown, or other
  misc_feature (499)..(499): n is a, c, t, g, unknown, or other
ggagctccccgcggtggcggccgctctagaactagtggatcccccgggctgcaggaattcgcacgagaccattacctagaacatcctaatcgaaaaactgcattccctctgagcgccgccactccctgacatcgagaccggctgcccgaccccggtccggcgatccctctgcacccctttctttgcgctgccagccccaatctctcgcatccctgtcaaccatggcggcgtcagcaggcggaggcgcggtgcgcgcgctgtcccagaaggagcaggacatacagatgatgctcgcggccgacgtccacctcggcaccaagaactgcgnattccagatggagcggtatgtctttaagcgtcgcaccgacggcatctacatcatcaacctgggcaagacatggggataagctccagctcgcggcgagggttatgggtgcattggagacccacangacatcatcgtccagtcggcccgcccctaacggcagggggctgcccntcagttccggcagaaactggcggcccatgcatccctggaaggaaaccccttggaccttcacaaatcaagtccagacctttttaagggagcctggctggtctccttagtggcccggggttggccattcccaatcaggggtctggctctgggaacctccgccact

SEQ ID NO: 32099 - protein, 61 aa, Zea mays
  misc_feature: Ceres CLONE 1408962-F
  misc_feature (36)..(36): Xaa is any aa, unknown, or other
MAASAGGGAVRALSQKEQDIQMMLAADVHLGTKNCXFQMERYVFKRRTDGIYIINLGKTWG

SEQ ID NO: 32100 - DNA, 676 bp, Zea mays
  misc_feature: Ceres CLONE 1408963-F
  misc_feature: Encodes the peptide sequence at SEQ ID NO. 32101
  misc_feature (429)..(429): n is a, c, t, g, unknown, or other
tggagctccccgcggtggcggccgctctagaactagtggatcccccgggctgcaggaattcgcacgagaccattacctagaacatcctaatcgaaaaagacttcgcagtcctcctccccactaccagagcatgcgcgttgccgcgacccgagccgccgccgccgctcaccctccgagcgccttcctgctcctcctgttactcctcggttgcgcgtccctcgcgatcggaggagcagccatggccggccacgtcctcggcggcgtgaaggagaacccagccgcggccaacagcgccgagtccgacgggctcggccgcttcgccgtcgatgagcacaacaggcgcgagaacgcgctgctggagttcgtgcgcgtggtggaggccaaggagcaggtggtggccggcacgctgcaccacctcacgctcgaggncgtcgaggccgggaggaaagagctctacgaggccagggtctgggtcaagccatggctcgacttcagggagctcccagaattcagccaccaggggggacgccaccgccttcaccaacgcggacctcgggggcaaagaaaggtggacatgaacccgggttgccggtgagggtacaggtaaaggatcctgggggtcaaagatgctgccacaccaggctgggaaatccaacccaaaagagggccaactccc

SEQ ID NO: 32101 - protein, 154 aa, Zea mays
  misc_feature: Ceres CLONE 1408963-F
  misc_feature (43)..(131): Pfam Name: Cystatin Pfam Description: Cystatin domain
  misc_feature (100)..(100): Xaa is any aa, unknown, or other
MRVAATRAAAAAHPPSAFLLLLLLLGCASLAIGGAAMAGHVLGGVKENPAAANSAESDGLGRFAVDEHNRRENALLEFVRVVEAKEQVVAGTLHHLTLEXVEAGRKELYEARVWVKPWLDFRELPEFSHQGGRHRLHQRGPRGQRKVDMNPGCR

SEQ ID NO: 32102 - DNA, 638 bp, Zea mays
  misc_feature: Ceres CLONE 1408967-F
  misc_feature: Encodes the peptide sequence at SEQ ID NO. 32103
  misc_feature (525)..(525): n is a, c, t, g, unknown, or other
  misc_feature (626)..(626): n is a, c, t, g, unknown, or other
aaagctggagctccccgcggtggcggccgctctagaactagtggatcccccgggctgcaggaattcgcacgagaccattacctagaacatcctaatcaaaaagcacaccgctgtcgtcctcgctcacctcgtccgtcctcgtgagctccgcctgccttccctctggacagctccagcctccagccatcttcccccacctgtacacagttcgcactcgcatgctcttcgccccctcgcgcttaccgctgccgcgcctcccgactcgccgcctccgcctagctccgggctctccaatggcctccatgctcgccatcctcaggccctcggcgccggccccgctcgcgggacgccgggccagggctgccgcgccggcgaccgcgagggtggcgctatctaccagatctaggtattcgtcagccagggtgtcgctcggctccgaggttgcagtgggcgccgacgcgctcttcgccgactataagcccaccaccgctttcctcttccccggccagggtgcccaaaccgttnggatgggggcagaagctcagagtgttccagcagctaccaaattgttcaaccaggcaaatgaaatccttggatatgacttgctggatctttgcaccaatggnacaaagaaaagt

SEQ ID NO: 32103 - protein, 115 aa, Zea mays
  misc_feature: Ceres CLONE 1408967-F
  misc_feature: SWISSPROT Homolog: EC 2.3.1.39 [Acyl-carrier-protein] S-malonyltransferase
  misc_feature (78)..(78): Xaa is any aa, unknown, or other
MASMLAILRPSAPAPLAGRRARAAAPATARVALSTRSRYSSARVSLGSEVAVGADALFADYKPTTAFLFPGQGAQTVXMGAEAQSVPAATKLFNQANEILGYDLLDLCTNGTKKS

SEQ ID NO: 32104 - DNA, 646 bp, Zea mays
  misc_feature: Ceres CLONE 1408969-F
  misc_feature: Translation starting site: 473
  misc_feature (324)..(324): n is a, c, t, g, unknown, or other
  misc_feature (349)..(349): n is a, c, t, g, unknown, or other
  misc_feature (396)..(396): n is a, c, t, g, unknown, or other
  misc_feature (495)..(495): n is a, c, t, g, unknown, or other
aagctggagctccccgcggtggcggccgctctagaactagtggatcccccgggctgcaggaattcgcacgagaccattacctagaacatcctaatcgaaaaattccccttccacctcgctctctctctctctcctcccactgctcgccctctctctcttacgcgcgcgtgacaacctccctccctccactgcgcgcggcgcgggagcagcagcggcagcacccaccgactgatcgccggtgggcggggcgggggcgatctgatgcgggcgcggcggtgatggcagcgccatccggcggtgggggcggcgggtgccggggaaggnctcctcctcggccgccgcagctggnacgatcggggtcccacggggtggaccaagttggcagaggcgatgtgncagatgaatttggaagaagccatggaactggggccatacccagagccgtgttggtgagccagactgtagctattacatgaggactggcatggtgcaggntttgggattacctgtaaatttaatcacccagcagacgaaaagctggctgttgctgctgcaagaaagaagggagatatcctcagaaattgggcagcctgaatgcaatactatctgaagatggcacgtggcagtttggaccaacttgaagttt

SEQ ID NO: 32105 - DNA, 710 bp, Zea mays
  misc_feature: Ceres CLONE 1408977-F
  misc_feature: Translation starting site: 526
  misc_feature (18)..(18): n is a, c, t, g, unknown, or other
ttttgggccccccccccngcgcccctcccccgggggccgggggcccccccccaagctggagctccccgcggtggcggccgctctacactagtggatcccccgggctgcaggaattcgcacgagaccattacctagaacatactaatcgaaaagaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccagtccacctgccaccgccggtccatgtgccgccgccggttcatctgccgccgccaccatgccactaccctactcaaccgccccggcctcagcctcatccccagccacacccatgcccgtgccaacaggcgcacccaagcccgtgccagctgcagggaacctgcggcgttggcagcaccccgatcctgggccagagcgtcgagttcctgaggcatcagtgcagcccgacggagacaccctactgctcccctcaggggcagtcgttgccggaaccagagttgccagcagctccacgca

SEQ ID NO: 32106 - DNA, 659 bp, Zea mays
  misc_feature: Ceres CLONE 1408978-F
  misc_feature: Encodes the peptide sequence at SEQ ID NO. 32107
aagctggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcaggcgtgaccagagcgcgagagctagctagagggccgtgaaaatgccgatcaataagatcgccctggggagccaccaggaggtgtaccacccgggcgccctcaaggcggcgttcgctgagttcatctccaccctcatcttcgtcttcgccggccagggctccggcatggccttcagcaagctgaccggcggcggtccgacgaccccggggggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttccggaggctcctgtactgggtggcgcacctgctgggggccaccgtggcgtgcttcctgctccgcttctcgacgggcggccaggccacggtcaccttcaagctgacgggcgtgcccgtgtggaaagcgctgccgctgaacatcgtgatgaccttctggc

SEQ ID NO: 32107 - protein, 153 aa, Zea mays
  misc_feature: Ceres CLONE 1408978-F
  misc_feature (13)..(153): Pfam Name: MIP Pfam Description: Major intrinsic protein
MPINKIALGSHQEVYHPGALKAAFAEFISTLIFVFAGQGSGMAFSKLTGGGPTTPGGLIAAAVAHAFALFVAVSVGANISGGHVNPAVTFGAFVGGNITLFRRLLYWVAHLLGATVACFLLRFSTGGQATVTFKLTGVPVWKALPLNIVMTFW

SEQ ID NO: 32108 - DNA, 620 bp, Zea mays
  misc_feature: Ceres CLONE 1408979-F
  misc_feature (336)..(336): n is a, c, t, g, unknown, or other
  misc_feature (398)..(398): n is a, c, t, g, unknown, or other
  misc_feature (422)..(422): n is a, c, t, g, unknown, or other
  misc_feature (448)..(448): n is a, c, t, g, unknown, or other
  misc_feature (542)..(542): n is a, c, t, g, unknown, or other
aaagctggagctccccgcggtggcggccgctctagaactagtggatcccccgggctgcaggaattcgcacgagaccattacctagaacatcctaatcgaaaaataattctagtattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggataggggagagatgaagcaatcaantttcttcgtccgccttcgccccctgcttacgtccccgctactaaccctagggatcattctgnctttttctcgtttcttatccgacntcttcttcgtttaattgctataaagnttatgaagggtgaacgccttcagaaagctctctacttagattagtgtaaatagtagactttgttcgaagtttagcttgggctggaaaatttaanccccccggccccgggtttaattctgctaacaatatggctgcatgaacggaaaaggatttgggggaaaaaggggaaaaa

SEQ ID NO: 32109 - DNA, 632 bp, Zea mays
  misc_feature: Ceres CLONE 1408982-F
  misc_feature: Translation starting site: 208
  misc_feature: SWISSPROT Homolog: EC 2.6.1.1 Aspartate transaminase
aagctggagctccccgcggtggcggccgctctagaactagtggatcccccgggctgcaggaattcgcacgagaccattacctagaacatcctaatccaaaaatatcccatcctgatctctcctcccttcttcagtgcagcagcaggccagcagcacgccacccgccccactcctgcctccgatccgctgcttactcgccacccggagatggccaccgccgccgccttctccgtctcctcgccggcggcctccgccgtcgccgcgcgatccaaggtgtttggaggaggagttaaccaggcgagaactagaactggctgccgcgtcggcatcacgcggaagaactttggccgtgtcatgatggcccttgcagtggatgtttctcgttttgaaggagtgccaatggctcctccagacccaattcttggggtttctgaggcctttaaagcagataagagcgagctggaagctcatcttgggtgtttgtgcctataggacagaagagctgcagccatacgtgctcaatgtagtcaagaaggctgaaaatcttatgtgggagaaaggagaaaaacaagagtatcttcccattggagggtttagccgcgtttaacaaagcaacagcagagctattgctt

SEQ ID NO: 32110 - DNA, 652 bp, Zea mays
  misc_feature: Ceres CLONE 1408993-F
  misc_feature: Pfam Name: ABC_membrane Pfam Description: ABC transporter transmembrane region
  misc_feature (340)..(340): n is a, c, t, g, unknown, or other
  misc_feature (411)..(411): n is a, c, t, g, unknown, or other
  misc_feature (418)..(418): n is a, c, t, g, unknown, or other
  misc_feature (434)..(434): n is a, c, t, g, unknown, or other
  misc_feature (471)..(471): n is a, c, t, g, unknown, or other
  misc_feature (504)..(504): n is a, c, t, g, unknown, or other
  misc_feature (540)..(540): n is a, c, t, g, unknown, or other
  misc_feature (547)..(547): n is a, c, t, g, unknown, or other
  misc_feature (605)..(605): n is a, c, t, g, unknown, or other
  misc_feature (606)..(606): n is a, c, t, g, unknown, or other
aagctggagctccccgcggtggcggccgctctagaactagtggatcccccgggctgcaggaattcgcacgagaccattacctagaacatcctaatcgaaaaaggacgctgcagatgcagtcgtcgagctaacaagcagccggacaaggtaaaatgttcccgttaacatcccttgaggcctaccctaggcagcacaccaaatggggcaaccgccctgccgccggggagcattcaatcgtcggcggcacaccgtcccccattcttcccgttccccaacgtgaagtggcaccatggtcgccactcgccacgcgctcgccgcaggagcaggagcagcgactgcnggccagccagcctccggttgggtagctgttctgcgcaacagcccgagggcgcggatggagggaccaaacangagccgnagggaaaaggcagcgntacaactgatgagcgggtacctgttctacgatagcgntcgcttcagacacgaaagaatgtcttgcgaggnacatgctgatcatcgccttcgagtaagatgctccanccatgangagcataggcacaactagcagggagagcaggccgacctccccacagcacgcgaaggcnnacatgatagcaactaagaacggtgagaagtttgacatgaagtgacc

SEQ ID NO: 32111 - DNA, 646 bp, Zea mays
  misc_feature: Ceres CLONE 1408996-F
  misc_feature: Encodes the peptide sequence at SEQ ID NO. 32112
aagctggagctccccgcggtggcggccgctctacaactagtggatcccccgggctgcaggaattcgcacgagaccattacctagaacatcctaatcgaaaaatccatcatcgctcgctcttctcttggtcttgcaactccagtgctgctcactgccactgccagcagatcgagctgctccgcctcactagccctcttgctttgctgctgcacctgcaagtctgcaaccgcgcacagagagatgtcgacggtgagccgtgcgtccctcgaccagaagctcgccctcgccaagcgctgctcccgagaggcgaccctcgccggagccaaggcggcagcggtggcgactatcgcctccgcgatccccaccctggccagcgtgcggatgctgccatgggccaaggccaacatcaaccccaccggccaggcgctcatcgtctccacggtggctgggatggcatacttcatcgccgccgacaagaagatcctgtcgctggcgaggcgccactcgttcgagcaagcccctgagcacctcaagaacacctccttccagggcaccggccgtccccacccggctttcttcaggccgtgagacgtggcctccgtcgagctagctacctacctctttcagttcgatcgtcagtgcaaag

SEQ ID NO: 32112 - protein, 115 aa, Zea mays
  misc_feature: Ceres CLONE 1408996-F
  misc_feature (11)..(89): Pfam Name: ENOD93 Pfam Description: Early nodulin 93 ENOD93 protein
MSTVSRASLDQKLALAKRCSREATLAGAKAAAVATIASAIPTLASVRMLPWAKANINPTGQALIVSTVAGMAYFIAADKKILSLARRHSFEQAPEHLKNTSFQGTGRPHPAFFRP

SEQ ID NO: 32113 - DNA, 661 bp, Zea mays
  misc_feature: Ceres CLONE 1409011-F
  misc_feature: Encodes the peptide sequence at SEQ ID NO. 32114
  misc_feature (661)..(661): n is a, c, t, g, unknown, or other
aaagctggagctccccgcggtggcggccgctctacaactagtggatcccccgggctgcaggaattcgcacgagaccattacctagaacatcctaatcgaaaattttctcgcgctcctaccgccgccgcttcgttctctaaccttggctcccgctccctccgcaggagcatctcaacaccgccttgagaaccccccaactcgccggctgcagccatggtaagatctccctcccccttactctctcgcctgttgcatcttcgctgccctgcagccatggatttggcgtcgcccttgcgaactcctgacgtgcaacgggccttgtttctggttccaggtgaaatattcgacggagccaaccaaccccaccaagtcaaccaaggccatgggccgtgacctacgtgttcacttcaagaacacccgtgagacagcttttgcccttaggaagttgtcactcaccaaggccaaaaggtaccttgaggatgtgattgcccacaagcaggccatcccgttccgcaggtattgtggcggtgttggacgtaccgctcaggctaagtctcgtcactcaaatgggcagggacgctggcctgtcaaatctgctagattcattctagaccttctcaagaatgctgagagcaatgctgaggtaaaaggtcttgatgtn

SEQ ID NO: 32114 - protein, 93 aa, Zea mays
  misc_feature: Ceres CLONE 1409011-F
  misc_feature (1)..(93): Pfam Name: Ribosomal_L22 Pfam Description: Ribosomal protein L22p/L17e
MGRDLRVHFKNTRETAFALRKLSLTKAKRYLEDVIAHKQAIPFRRYCGGVGRTAQAKSRHSNGQGRWPVKSARFILDLLKNAESNAEVKGLDV

SEQ ID NO: 32115 - DNA, 649 bp, Zea mays
  misc_feature: Ceres CLONE 1409012-F
  misc_feature: Encodes the peptide sequence at SEQ ID NO. 32116
aaagctggagctccccgcggtggcggccgctctagaactagtggatcccccgggctgcaggaattcgcacgagaccattacctagaacatcctaatcgaaaaacctcaggcctcgctcagatctctccgcccgggtccatcttcccaccccaaaccttctcccgcctctctcgtcaacgccgcccgacgagagggatggcggccttgcgggctccggccgcaacgctcctcgtcctcctcgccctagcggcggccggcggcgtggcggccgacggctccgatcaccggtacaagattcgcgagcccgtcccgctctacgccaacaaggtcggcccatttcacaatcccagtgaaacatatcgatatttcgacctgcctttctgctctcctgacaaagtgaaggagaagaggagcccctttgggggaggtctcagatgggggatcggttagttgatgcgccttacaagcttgattcccggtgacgaagttgagtcccaaggcagtttgctcaaagaagttactacagaggatgggtagtgaagttcccggaatgcagtggctaaggactactaacttccaggatgggactaatgatggacctccccggtgggggggggttcctcggggaaaggttaagaaaggggcggca

SEQ ID NO: 32116 - protein, 84 aa, Zea mays
  misc_feature: Ceres CLONE 1409012-F
MAALRAPAATLLVLLALAAAGGVAADGSDHRYKIREPVPLYANKVGPFHNPSETYRYFDLPFCSPDKVKEKRSPFGGGLRWGIG

SEQ ID NO: 32117 - DNA, 679 bp, Zea mays
  misc_feature: Ceres CLONE 1409013-F
  misc_feature: Encodes the peptide sequence at SEQ ID NO. 32118
aaagctggagctccccgcggtggcggccgctctagaactagtggatcccccgggctgcaggaattcgcacgagaccattacctagaacatcctaatcgaaaaacctcatcccaaatctcaacccaagaacaaaaatggccaccgccaccactgaagccgaagtccgtgagtccctcggcacgaagttcggtcgcctcaaggaacaggcgaaagacatggcctccaggcaccccgtcgctggagccgcggccgtcatcgctgtcagcgccgtgggcgcctacttccttgtggcccgtggcagccccggccgtggccatgatgaaagcgcctggatccggcggtgtgctcgtctcccgcgcggcgtttctcgcgaagaaggagctgtacttcaagctcttgcgcaccgggggcgttgcggcggcggtcgccgctttggcgtagctgcgcatgcagtagtggtacatgctgttcgtgaacgagcggggggccggacgtttcaggttgtatgttgaccaagtggttattagtactttcttttcgtttggtgttgagtctcgactctcgaggtttggattatctgtcaaaaacctatgtatgcgtgcatgattcagtttggatgaataatgggaactcttttaagaataaaagcaaagttaaggtcccagataaaaaaaaaaaa

SEQ ID NO: 32118 - protein, 41 aa, Zea mays
  misc_feature: Ceres CLONE 1409013-F
MMKAPGSGGVLVSRAAFLAKKELYFKLLRTGGVAAAVAALA

SEQ ID NO: 32119 - DNA, 685 bp, Zea mays
  misc_feature: Ceres CLONE 1409017-F
  misc_feature: Encodes the peptide sequence at SEQ ID NO. 32120
  misc_feature (285)..(285): n is a, c, t, g, unknown, or other
cacccgcggtggcggccgctctagaactagtggatcccccgggctgcaggaattcgcacgagaccattacctagaacatcctaatcgaaaaatttttaccctttcctcgcccctacccccgccaccgccgccgccgtcgccgcagccatggcgtcgcggcgctgtctcctccgcttcctctcgatccgcctcgttcctcagagatctcaacctcttgcgccgatctcgactgcgacccggaccctaacctctttgtccgaggccctcggctccccagctccccgngccctcgcctccccccggctgtactacccctcgccctgcacttcgcgacccgctcctccggcgacgaggacgacggagaagacgaagaagagcactacgacgatgaggggagcgatggggaatggggggacgatgaggaggtgctggcggcgaacaaaccgagcgggaagaccgaagagaagaaggtacggaggggcggagatcggctacaggtgttgggaccgctcggggctgacgataaacccttcagccctacgagccgttctcgccgtcgaacaatcgggtcgcccaattcaaggtgggaaatggcgaatccatcctcccggaaaagttggaatttctgggatgggaatgaacaagtggtcctaaacccgaggtctccaggcgtggggtcccaaag

SEQ ID NO: 32120 - protein, 88 aa, Zea mays
  misc_feature: Ceres CLONE 1409017-F
MRGAMGNGGTMRRCWRRTNRAGRPKRRRYGGAEIGYRCWDRSGLTINPSALRAVLAVEQSGRPIQGGKWRIHPPGKVGISGMGMNKWS

SEQ ID NO: 32121 - DNA, 637 bp, Zea mays
  misc_feature: Ceres CLONE 1409018-F
  misc_feature: Encodes the peptide sequence at SEQ ID NO. 32122
  misc_feature (491)..(491): n is a, c, t, g, unknown, or other
  misc_feature (512)..(512): n is a, c, t, g, unknown, or other
  misc_feature (521)..(521): n is a, c, t, g, unknown, or other
  misc_feature (544)..(544): n is a, c, t, g, unknown, or other
  misc_feature (595)..(595): n is a, c, t, g, unknown, or other
  misc_feature (626)..(626): n is a, c, t, g, unknown, or other
tccccgcggtggcggccgctctagaactagtggatcccccgggctgcaggaattcgcacgagaccattacctagaacatcctaatcgaaaaaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgatccgtcagtgcagagtgacatgaagctatgggcgttncaggtcatcccagggcctggntgacagccnatgattgtagtgaaactacaggncgaggagaagcagtttgctgctgaggagatctcctccatggtcctcatcangatgaaggagattgctgaagcctacttgggnttccacatcaa

SEQ ID NO: 32122 - protein, 101 aa, Zea mays
  misc_feature: Ceres CLONE 1409018-F
  misc_feature (94)..(94): Xaa is any aa, unknown, or other
MAKSEGPAIGIDLGTTYSCVGVWQHDRVEIIANDQGNRTTPSYVGFTDTERLIGDAAKNQVAMNPTNTVFDAKRLIGRRFSDPSVQSDMKLWAXQVIPGPG

SEQ ID NO: 32123 - DNA, 652 bp, Zea mays
  misc_feature: Ceres CLONE 1409020-F
  misc_feature: Encodes the peptide sequence at SEQ ID NO. 32124
ggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtacctactagcgcgagtgccactgtgccgcacctgcctgctcgccattactgcaagctgtgttcaatcaaagcttaattaggctccctctacatctgatccagctaagtagctagccagcactacagaagggcgtgccaagaatcaggagagagatagcaagggggctagctagctgagctcgtgcgacgaataatgatcggaattgccaggaacatggtggcgccgctcctggtgctcaacctcatcatgtacatcatcgtcatcggcttcgcgagctgtaacctgaaccacttcatcaacgggcagaccaactaccccggcgtggacggcaacggcgcgacggtctacttcctggtgttcgccatcctgcccggcgtgatgtacgcgacgtccaaactgacgtgcgtgcaccacgtgcgcgcctggcgccacgacagcctggccaccaacgccgcgtcgtcgctcatcgcctgtgtcatcacggtgctcgacttcggcctggcctgc

SEQ ID NO: 32124 - protein, 105 aa, Zea mays
  misc_feature: Ceres CLONE 1409020-F
  misc_feature (14)..(105): Pfam Name: AWPM-19 Pfam Description: AWPM-19-like family
MIGIARNMVAPLLVLNLIMYIIVIGFASCNLNHFINGQTNYPGVDGNGATVYFLVFAILPGVMYATSKLTCVHHVRAWRHDSLATNAASSLIACVITVLDFGLAC

SEQ ID NO: 32125 - DNA, 735 bp, Zea mays
  misc_feature: Ceres CLONE 1409022-F
  misc_feature: Encodes the peptide sequence at SEQ ID NO. 32126
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (87)..(87): n is a, c, t, g, unknown, or other
  misc_feature (547)..(547): n is a, c, t, g, unknown, or other
  misc_feature (735)..(735): n is a, c, t, g, unknown, or other
ggccccccggcctgcccccggggtttccccggcgcgcgccgccgccgggggctaaccacccccggaaggaaaannnnnngggggaangttaaaagctggagctccccgcggtggcgggcgctctattactagtggatcccccgggctgcaggaattcgcacgagaccattacctagaacatcctaatcgaaaagatccgcttcccatctgatgctcgtgctccgccgcgtctccttcctcctctcgtcgccctcccctcgcgcaccgctcgcaaaacctctcctgctcctacgcccgccccaaaccctagccccgacagcgcggcagctcgtggctatggccgcgtcagtcccgtcggcgggtggggcggggacgatgagccgcgacgcgttccgcgcggccgtgaccaacaggctggagcgccggctcttcttcgtgccctctttcaagatctacggcggcgtcgcggggctctacgactacggacccccaggttgcgctgtcaaagctaacgtcctcgcattctggcgccagcattttgtattgnaggaaagggatgcttggaggttgacctgtccatgtagagacgccagaagtttgtctttggaaagcctctgggacatgttgaaaaaattttaccggaccttaacgggtttaaaagatggaaaaaggaccgggcaaaccggcctaaccgttgccgggatcaattttggctgggaaggaactttcctggan

SEQ ID NO: 32126 - protein, 132 aa, Zea mays
  misc_feature: Ceres CLONE 1409022-F
  misc_feature: SWISSPROT Homolog: EC 6.1.1.14 Glycine--tRNA ligase
  misc_feature (71)..(71): Xaa is any aa, unknown, or other
MAASVPSAGGAGTMSRDAFRAAVTNRLERRLFFVPSFKIYGGVAGLYDYGPPGCAVKANVLAFWRQHFVLXERDAWRLTCPCRDARSLSLESLWDMLKKFYRTLTGLKDGKRTGQTGLTVAGINFGWEGTFL

SEQ ID NO: 32127 - DNA, 697 bp, Zea mays
  misc_feature: Ceres CLONE 1409023-F
  misc_feature (372)..(372): n is a, c, t, g, unknown, or other
  misc_feature (379)..(379): n is a, c, t, g, unknown, or other
  misc_feature (380)..(380): n is a, c, t, g, unknown, or other
  misc_feature (427)..(427): n is a, c, t, g, unknown, or other
  misc_feature (442)..(442): n is a, c, t, g, unknown, or other
  misc_feature (455)..(455): n is a, c, t, g, unknown, or other
  misc_feature (513)..(513): n is a, c, t, g, unknown, or other
  misc_feature (519)..(519): n is a, c, t, g, unknown, or other
  misc_feature (551)..(551): n is a, c, t, g, unknown, or other
aaactggagctccccgcggtggcggccgctctagaactagtggatcccccgggctgcaggaattcgcacgagaccattacctagaacatcctaatcgaaaaacacatattattgagaccaactagcaacatagaaagcacaatagtgtaccaacaatggcagccaaaatattttgcctccttatgctccttggtctttctgcaagtgctgctacggcgaccattttcccacaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgntcctccnnacatcatcagccctattacagcagttacctttttggtgcattattgncacaaaacatcaggncacaaacactacnacaacttgtgctagcaacccttgctgcctactctcagcaacaacagtttcttccattncacccnactagctgcattgaacctcggcttcttatttngcaacaacaacaattacaatttcagccggttatttgttgcctacccccaagaatttccttcccattcacccaaatgaaaggtttgaaccctccccggtttattttacggggggaaaaaataaaaacactttccccgcgtttgttgg

SEQ ID NO: 32128 - DNA, 687 bp, Zea mays
  misc_feature: Ceres CLONE 1409027-F
  misc_feature: Encodes the peptide sequence at SEQ ID NO. 32129
  misc_feature (459)..(459): n is a, c, t, g, unknown, or other
aaagctggagctccccgcggtggcggccgctctagaactagtggatcccccgggctgcaggaattcgcacgagaccattacctagaacatccaatcgaaaaatatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacaacagttacctttggtgcatttattggcacaaaacatcagggcacaacaactacnacaacttgtgctagcaaaccttgctgcctactctcagcaacagcagtttcttccattcaaccaactaggttcattgaactctgcttcttatttgcaacaacaacaactaccattcagccagctacctgctgcctacccccagcaatttcttccattcaaccaactagcagcattgaactctcctgcttatttacagcagcaacaactactaccattcagccagcttag

SEQ ID NO: 32129 - protein, 175 aa, Zea mays
  misc_feature: Ceres CLONE 1409027-F
  misc_feature (1)..(175): Pfam Name: Zein Pfam Description: Zein seed storage protein
  misc_feature (100)..(100): Xaa is any aa, unknown, or other
MAAKIFCLLMLLGLSASAATATIFPQCSQAPIASLLPPYLSPAVSSVCENPILQPYRIQQAIAAGILPLSPLFLQQSSALLQQLPLVHLLAQNIRAQQLXQLVLANLAAYSQQQQFLPFNQLGSLNSASYLQQQQLPFSQLPAAYPQQFLPFNQLAALNSPAYLQQQQLLPFSQL

SEQ ID NO: 32130 - DNA, 705 bp, Zea mays
  misc_feature: Ceres CLONE 1409032-F
  misc_feature: Encodes the peptide sequence at SEQ ID NO. 32131
  misc_feature (183)..(183): n is a, c, t, g, unknown, or other
  misc_feature (498)..(498): n is a, c, t, g, unknown, or other
  misc_feature (509)..(509): n is a, c, t, g, unknown, or other
  misc_feature (514)..(514): n is a, c, t, g, unknown, or other
  misc_feature (515)..(515): n is a, c, t, g, unknown, or other
  misc_feature (629)..(629): n is a, c, t, g, unknown, or other
  misc_feature (637)..(637): n is a, c, t, g, unknown, or other
  misc_feature (649)..(649): n is a, c, t, g, unknown, or other
aaagctggagctccccgcggtggcggccgctctagaactagtggatcccccgggctgcaggaattcgcacgagaccattacctagaacatcctaatcgaaaaatttttcagccgccccaccgcagcagcagagaagaggccgccgccgccgcgaccaagagccgatggatccgaagatgacangaggtgacccagatgttcgcccgcttcaaggcggcctacacccgcaacgacctcgacgcctgcgtcaccctcctctcacagctcaaggtccatctcaccaaattccccagccttccgccctcatttgagcagacacctaaagccgtggaggagctcaaacttgcaagggacatttatgagcatgctgttgttttgagtgtgaaacttgaggaccaagatgcatttgaacgtgatttctgtcagctaaagccttattacatggatacatgtggcataattcccccctcacccagagagtaccccattttgggactncatcttctgangctgnntggtcagaatagaattgctgagttccatactgagctggagcttttaccctgtcaggcacttgagcacccttgcatcaagcatgctgtaaagcttgagcaatccttcatggaggntgcctacnaccgagtgtaanccgctcggcaagctgggccacatgaaacctatggttactttcatggacttcccccc

SEQ ID NO: 32131 - protein, 150 aa, Zea mays
  misc_feature: Ceres CLONE 1409032-F
  misc_feature (105)..(105): Xaa is any aa, unknown, or other
  misc_feature (107)..(107): Xaa is any aa, unknown, or other
  misc_feature (145)..(145): Xaa is any aa, unknown, or other
  misc_feature (148)..(148): Xaa is any aa, unknown, or other
MFARFKAAYTRNDLDACVTLLSQLKVHLTKFPSLPPSFEQTPKAVEELKLARDIYEHAVVLSVKLEDQDAFERDFCQLKPYYMDTCGIIPPSPREYPILGLHLLXLXGQNRIAEFHTELELLPCQALEHPCIKHAVKLEQSFMEXAYXRV

SEQ ID NO: 32132 - DNA, 691 bp, Zea mays
  misc_feature: Ceres CLONE 1409034-F
  misc_feature: Encodes the peptide sequence at SEQ ID NO. 32133
  misc_feature (526)..(526): n is a, c, t, g, unknown, or other
  misc_feature (527)..(527): n is a, c, t, g, unknown, or other
  misc_feature (596)..(596): n is a, c, t, g, unknown, or other
  misc_feature (619)..(619): n is a, c, t, g, unknown, or other
  misc_feature (691)..(691): n is a, c, t, g, unknown, or other
tggagctccccgcggtggcggccgctctagaactagtggatcccccgggctgcaggaattcgcacgagaccattacctagaacatcctaatcgaaaaaaaactgcattacaccacgatacactccactacaccctctcgagcaacaccaggaaccataccaaatcccaagtagagaagagcaagggctgcagctggcaagaagctttgctcagaaatggagttcctgtcgcagatgtggtcgctcctgggcctgctcaccatcctgcagaacgtcctccccacgcagctgctctccttgctgcactcgctgtggcagtcgctccaagactctctcacgccctactcctacttcgacgtgcccgagttcctcggctctgcggccgtcgagcccaacgcgctctaccgccacatccagctctacctccaccgctccctcctcctctcctcgcctccgccgccacgcctcacgctctcgctgccgcgctcctccgccgggctccggcggccacgccccacggcgctggnncatccccgggcggtcgggtgtcgctctcccaaaaccacctcggtcgcggacaccttcaacgccacccgngggccgtggtggacgcaccacgnccgacacgctccaggactcgctcggaggagcgccgggtcccttctcgttgcggcttcccgaagcggaacggn

SEQ ID NO: 32133 - protein, 158 aa, Zea mays
  misc_feature: Ceres CLONE 1409034-F
  misc_feature (104)..(104): Xaa is any aa, unknown, or other
  misc_feature (135)..(135): Xaa is any aa, unknown, or other
MEFLSQMWSLLGLLTILQNVLPTQLLSLLHSLWQSLQDSLTPYSYFDVPEFLGSAAVEPNALYRHIQLYLHRSLLLSSPPPPRLTLSLPRSSAGLRRPRPTALXHPRAVGCRSPKTTSVADTFNATRGPWWTHHXRHAPGLARRSAGSLLVAASRSGT

SEQ ID NO: 32134 - DNA, 624 bp, Zea mays
  misc_feature: Ceres CLONE 1409041-F
  misc_feature: Encodes the peptide sequence at SEQ ID NO. 32135
  misc_feature (520)..(520): n is a, c, t, g, unknown, or other
  misc_feature (609)..(609): n is a, c, t, g, unknown, or other
aaagctggagctccccgcggtggcggccgctctagaactagtggatcccccgggctgcaggaattcgcacgagaccattacctagaacatcctaatcgaaaaaaacggtagctgcttgatcactcgtgtcgctcgttgcattagacagatagccagcacacccccgtcgttcatcgggctcacaactgcactcgcctcgccagttgtattggagaggatagatagctcttcgccagagaaggattgccctcttgagatgggctgttctttcatctctatcttggttccatcctaatggatccaaatctatggccgccaagcaaatcacggatgacgatgaactgtgtcttctcctgccactgtcagggcctcagccctatgaacgtcagatacttgtatgcggctatcttcctccagctggcgaacctgtctgcgtggttcgcacgagagaataccgtatcgtattacctgaagcagcgactcagcggcgcctgtcagggtgacccgggttgtctcgcgnctgaaagcgtgctcgtgctcgagccatgcattctttctctttttatgggcatggtctttctcactgtacgcaccggcaagggtgatgangtgagaaatcatggc

SEQ ID NO: 32135 - protein, 110 aa, Zea mays
  misc_feature: Ceres CLONE 1409041-F
  misc_feature (76)..(76): Xaa is any aa, unknown, or other
  misc_feature (105)..(105): Xaa is any aa, unknown, or other
MDPNLWPPSKSRMTMNCVFSCHCQGLSPMNVRYLYAAIFLQLANLSAWFARENTVSYYLKQRLSGACQGDPGCLAXESVLVLEPCILSLFMGMVFLTVRTGKGDXVRNHG

SEQ ID NO: 32136 - DNA, 621 bp, Zea mays
  misc_feature: Ceres CLONE 1409042-F
  misc_feature: Encodes the peptide sequence at SEQ ID NO. 32137
  misc_feature (621)..(621): n is a, c, t, g, unknown, or other
tggagctccccgcggtggcggccgctctagaactagtggatcccccgggctgcaggaattcgcacgagaccattacctagaacatcctaatcgaaaaaggcttcagctgtccgcccgcggcccacccctccgccgtctccaccattccgccgttcccaccacgccactcgccagttcggcactccctcctgtctcccccccttgccgagacggcgcggacgccccgtcgcccaccccgaatgggtgccactctcctccacgccgccaccgcctcgctccagagctcctcccagcccgcacgcgcgggcgccgccaccgcctttcaccccctcgcgtccaccccatccatacgcctcgcgcgctcctcgttctcgtccatcgccgcctcgagtttcactccgggcggtttcggccgtcattgtttccgcggggagggagaaccccgggccggcgcggcgtccccgccctagcaagggagcaaactggagggttcagaggtggggcgatgaacaggataaccgcaagggagagaaaaagccccaggagggttcagaaagtttggaaggaaagggttgaacaatttcaagggtggaggccccgggcgaaatgaggcccctgtan

SEQ ID NO: 32137 - protein, 76 aa, Zea mays
  misc_feature: Ceres CLONE 1409042-F
MGATLLHAATASLQSSSQPARAGAATAFHPLASTPSIRLARSSFSSIAASSFTPGGFGRHCFRGEGEPRAGAASPP

SEQ ID NO: 32138 - DNA, 635 bp, Zea mays
  misc_feature: Ceres CLONE 1409043-F
  misc_feature: Encodes the peptide sequence at SEQ ID NO. 32139
tctttcccagtggatcccccgggctgcaggaattcgcacgagaccattacctagaacatcctaatcgaaaaatactccttggctgaagcctgcaacacaaccctacgcttccgacttcaacgcgcgcccctcccattttcacctacccctactcctttgtacctaaaggaacatcccagcatatgcaactactggcatggaaatgatagcaactcgcccttccatcccgggctacagaccaaatacttggctcgacatcagcactatctgcatttggaaggtctactctgttcacagaactggctttggcatctcttctaaagccacatcatcacgaccactggtctcttcgaattggaagagggttgtagtgatgcccatgacacagagaggtgccctaggacttcccattgatctcacaggtaatataccatttatagcatggagttgctgatgataatggtcatcgcctcgaccaattgcataaagctcttagctgctgctgaagctgacattcttgaatgaacatgactgcctgagttgaacatacctctagaccagcattgtgacgtggcaaagtttgccgaatcacgaaaagtacctgatggatcatctatggagactcgctaaaccat

SEQ ID NO: 32139 - protein, 85 aa, Zea mays
  misc_feature: Ceres CLONE 1409043-F
MEMIATRPSIPGYRPNTWLDISTICIWKVYSVHRTGFGISSKATSSRPLVSSNWKRVVVMPMTQRGALGLPIDLTGNIPFIAWSC

SEQ ID NO: 32140 - DNA, 750 bp, Zea mays
  misc_feature: Ceres CLONE 1409044-F
  misc_feature: Encodes the peptide sequence at SEQ ID NO. 32141
  misc_feature (492)..(492): n is a, c, t, g, unknown, or other
  misc_feature (530)..(530): n is a, c, t, g, unknown, or other
  misc_feature (543)..(543): n is a, c, t, g, unknown, or other
  misc_feature (550)..(550): n is a, c, t, g, unknown, or other
  misc_feature (645)..(645): n is a, c, t, g, unknown, or other
  misc_feature (674)..(674): n is a, c, t, g, unknown, or other
aagctggagctccccgcggtggcggccgctctagaactagtggatcccccgggctgcaggaattcgcacgagaccattacctagaacatcctaatcgaaaaagtctgcacaccgccactcgcccacacgcgaaggcacctagcagccgccactcgccgaactgaggaacacgccgggcgacgggatacagcagcagcgcgcccctctatccccgacgcgacggcgccctgcagctgcagataaacctgttccaatggccaaacaaaaagagggtgtggacaaaagaacttctaggaagatgatccgatctacggaaggctgtgcaaagagcattactttggagaggaacaacaaatcagacgatgtgcagcttcacgatctgccgaatgacatcctaggtagcatactatcacggttgacattcagagaatcctcacagatgggccttgtttctcatacctggcggcggctgtggagaagctgttgccgganactggtcttcaccagtgccaccatgttccaacccgganataggagcatcanacatacnaggaccaactttgccatgagagtcaacagtttcttgcgtcagctacgcactcatcctactcttaataagtttgttattaaagtcgggctgcgcangaagcacactcgccatgtcaacagatggnatcgcttctgctccgtgtcgcgagcaagacacatcactattaatttcactcctggagtggaaagatttttcatggt

SEQ ID NO: 32141 - protein, 165 aa, Zea mays
  misc_feature: Ceres CLONE 1409044-F
  misc_feature (38)..(85): Pfam Name: F-box Pfam Description: F-box domain
  misc_feature (80)..(80): Xaa is any aa, unknown, or other
  misc_feature (93)..(93): Xaa is any aa, unknown, or other
  misc_feature (97)..(97): Xaa is any aa, unknown, or other
  misc_feature (131)..(131): Xaa is any aa, unknown, or other
  misc_feature (141)..(141): Xaa is any aa, unknown, or other
MAKQKEGVDKRTSRKMIRSTEGCAKSITLERNNKSDDVQLHDLPNDILGSILSRLTFRESSQMGLVSHTWRRLWRSCCRXLVFTSATMFQPGXRSIXHTRTNFAMRVNSFLRQLRTHPTLNKFVIKVGLRXKHTRHVNRWXRFCSVSRARHITINFTPGVERFFM

SEQ ID NO: 32142 - DNA, 711 bp, Zea mays
  misc_feature: Ceres CLONE 1409051-F
  misc_feature: Encodes the peptide sequence at SEQ ID NO. 32143
  misc_feature (446)..(446): n is a, c, t, g, unknown, or other
  misc_feature (461)..(461): n is a, c, t, g, unknown, or other
  misc_feature (489)..(489): n is a, c, t, g, unknown, or other
  misc_feature (538)..(538): n is a, c, t, g, unknown, or other
  misc_feature (551)..(551): n is a, c, t, g, unknown, or other
  misc_feature (562)..(562): n is a, c, t, g, unknown, or other
cgctctagaactagtggatcccccgggctgcaggaattcgcacgagaccattacctagaacatcctaatcgaaaaatgcacactcactcactccagtgcccactgcccactgcccactgcccgacgaggaagtttcacgatcccaacccgtataaatcgacgccgcgagggggagcgacgagcgatccccgtaattaacctgtcccagccgcaccgatccaccccccctcggcctcggcctccctccggccatggaggtgttctactacgtcgtgttcggcgcgctggccgccgtcgtggcggggctcgagctcggcaagagcggcaaggaccgcgtcgccaccacctccgcattcaactccttcaagaacaactacgtcctcgtctactccctcatgatgtccggggactggctgcagggcccctacgtctactacctctacagncagtatggcttcgancagggcgacatcggccggctcttcatcngcggcttcggatcctccatgctctttcggaacatcgtcggttccctcgnccgacaacagggnccgcagagggncctgcgtcacctattgcatcaggtaattcctcagctgcatcaccaggactcccccgagtacggggccctcatggtcggccgaatcctcggggggatcggcaaccttgttgtttttctcggcttcgagatcctggctcggccccaaaaaa

SEQ ID NO: 32143 - protein, 153 aa, Zea mays
  misc_feature: Ceres CLONE 1409051-F
  misc_feature (4)..(151): Pfam Name: DUF791 Pfam Description: Protein of unknown function (DUF791)
  misc_feature (65)..(65): Xaa is any aa, unknown, or other
  misc_feature (70)..(70): Xaa is any aa, unknown, or other
  misc_feature (80)..(80): Xaa is any aa, unknown, or other
  misc_feature (96)..(96): Xaa is any aa, unknown, or other
  misc_feature (104)..(104): Xaa is any aa, unknown, or other
MEVFYYVVFGALAAVVAGLELGKSGKDRVATTSAFNSFKNNYVLVYSLMMSGDWLQGPYVYYLYXQYGFXQGDIGRLFIXGFGSSMLFRNIVGSLXRQQGPQRXLRHLLHQVIPQLHHQDSPEYGALMVGRILGGIGNLVVFLGFEILARPQK

SEQ ID NO: 32144 - DNA, 607 bp, Zea mays
  misc_feature: Ceres CLONE 1409055-F
  misc_feature: Translation starting site: 342
  misc_feature: SWISSPROT Homolog: EC 1.2.1.3 Aldehyde dehydrogenase (NAD(+))
tggagctccccgcggtggcggccgctctagaactagtggatcccccgggctgcaggaattcgcacgagaccattacctagaacatcctaatcgaaaaatccgctccccgccttccgcttccctaccccccgcatcacctaccaacgccgacaccatgggggccttcgcgaaggaggagcaccagttcctcgccgagctcggcctcgcgcagcgcaacccgggcgcgttcgcatgcggtgcgtggggcggctcaggtcccaccgtcacctccacgagccccgaccaacaatcaggtcatcgcagaggtcgtggaggcgtccgtgcacgactacgaggagggcatgcgcgcctgcttcgacgccgcctacacatgggatggggattcctgctccaaacgaggagagatcgttaggcaaatcggtgatgcactgagagcaaagctccatccacttgggaggttggggcacttgagagggcgaaaattcctcctgaagggatcggggaggttcaggaaatcattgacatgggggattatgctgggggaactaagtccccaactaaagggatccattataccatctgaacgaccaaaccatatgatgagggg

SEQ ID NO: 32145 - DNA, 626 bp, Zea mays
  misc_feature: Ceres CLONE 1409064-F
  misc_feature (347)..(347): n is a, c, t, g, unknown, or other
  misc_feature (378)..(378): n is a, c, t, g, unknown, or other
  misc_feature (403)..(403): n is a, c, t, g, unknown, or other
aagctggagctccccgcggtggcggccgctctagaactagtggatcccccgggctgcaggaattcgcacgagaccattacctagaacatcctaatcgaaaatttttggactacaattgcatcaccacactcaccgcaccaccgaccactgcctccgtacgcgtccctctggcggaaaatcggtcctagtgccgagctcgttttgtttggatcttctgtatatctattaaggaggcttctccatctcctcggagcagcaaggctgtgcagcaatggagaagtataacagcaacactcaatttgcaccattgagagagactccgtttgccctcccgtggtgctcttggntagttcaagctcatatctttgagccaagccnaggggctacacattcttcccccctntaagcaacttcctgggcccccccaaaaaaattggttaaaccccctgggaaaaaatcaaacccctggaaaaaaaaagtgcccccccggtaatttggtgttggaaaaaaacccccccgggttggccccctctttctttttgaaaaaaaacccaaattttagggggtttttttttttatttttcccccgaaattttttttgggccccccttgggagagcgcccccc

SEQ ID NO: 32146 - DNA, 655 bp, Zea mays
  misc_feature: Ceres CLONE 1409071-F
  misc_feature: Encodes the peptide sequence at SEQ ID NO. 32147
  misc_feature (497)..(497): n is a, c, t, g, unknown, or other
  misc_feature (651)..(651): n is a, c, t, g, unknown, or other
ggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcngcagttcaacgagggcccccgtgggagcgaagcaggcgctctactcgagggacctcgctcgcaactgcgctttcgctccaacttcgacctcttcaggctgctgcgggcgactggcgcgacacgctcttctgcgagggtgctccgaaccccgcgncgcg

SEQ ID NO: 32147 - protein, 171 aa, Zea mays
  misc_feature: Ceres CLONE 1409071-F
  misc_feature: SWISSPROT Homolog: EC 1.14.11.20 Desacetoxyvindoline 4-hydroxylase
  misc_feature (119)..(119): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVXQFNEGPRGSEAGALLEGPRSQLRFRSNFDLFRLLRATGATRSSARVLRTPRR

SEQ ID NO: 32148 - DNA, 710 bp, Zea mays
  misc_feature: Ceres CLONE 1409076-F
  misc_feature: Encodes the peptide sequence at SEQ ID NO. 32149
ggagctccccgcggtggcggccgctctagaactagtggatcccccgggctgcaggaattcgcacgagaccattacctagaacatcctaatcgaaaagtcgccttccgccgccgtcttttgcgctaacgcttcgcctttcgatcccctttctgacttcttatagcatcatcccaagtcctcgcccggactccgcagattctctggttgctacgagttcttcgcctggtttttgggcaaggccaaaatttctgattttttttcaccgccgcaaacccctttcctgtgccataccgccattccattcctaagctgggcgtgggcggtgaagagaggaagcgaggccggctgtttcgctgaaaccccgccgccttttttttctttttcttttctggacctgattgaagaaccgtagcagattaggggaggagcggcggcggccggtcggtcagtatgattcacctgctgttcctcgtgctgttcgcggagggcgcagtagcgctgctcctcatggtgaaggtcgggccgctgcgggagctggcgatgcgcgtcgtggaccaggtgaagacgggcaagggcccggcatccgtcaagacgctggcatgcacgctctcggtcatcctcatgtccaacgtcgccagcatcctcaagatccagaatcgtgggctcaagctcggcaccgtcagccccatggaccaggtgctctggagaac

SEQ ID NO: 32149 - protein, 86 aa, Zea mays
  misc_feature: Ceres CLONE 1409076-F
MIHLLFLVLFAEGAVALLLMVKVGPLRELAMRVVDQVKTGKGPASVKTLACTLSVILMSNVASILKIQNRGLKLGTVSPMDQVLWR

SEQ ID NO: 32150 - DNA, 663 bp, Zea mays
  misc_feature: Ceres CLONE 1409078-F
  misc_feature: Encodes the peptide sequence at SEQ ID NO. 32151
aaagctggagctccccgcggtggcggccgctctagaactagtggatcccccgggctgcaggaattcgcacgagaccattacctaaaacatcctaatcgaaaagtcaatgcaagtttgtccattcgcattggtctgaatactgtagctactatcgcgagtgccactgtgccgcagctgcctgctcgccattactgcaagctgtgttcaatcaaagcttaattaggctccctctacatctgatccagctaagtatctagccagcactacagaagggcgtggcaagaatcaggagagagatagcaggggggctagctagctgagctcgtgcgacgaacaatggccggaattggcaggaacatgatggcgccgctcctggtgctcaacctcatcatgtacatcatcgacatcgggttcgcgagctggaacctgaaccacttcatcaacggacagaccaactaccccggcgtggtcggcaacggcgcgacgttctacttcctggtgttcgccatcctggccggcgtggtgggcgcggcgtccaagctggcggacgtgcaccacgtgcgcgcctggcgccacgacagcctggacaccaacgccgcgtcgtcgctcatcgcctgggccatcacggagctcgccttcaggctggactggcaggagatccac

SEQ ID NO: 32151 - protein, 109 aa, Zea mays
  misc_feature: Ceres CLONE 1409078-F
  misc_feature (14)..(109): Pfam Name: AWPM-19 Pfam Description: AWPM-19-like family
MAGIGRNMMAPLLVLNLIMYIIDIGFASWNLNHFINGQTNYPGVVGNGATFYFLVFAILAGVVGAASKLADVHHVRAWRHDSLDTNAASSLIAWAITELAFRLDWQEIH

SEQ ID NO: 32152 - DNA, 695 bp, Zea mays
  misc_feature: Ceres CLONE 1409081-F
  misc_feature (576)..(576): n is a, c, t, g, unknown, or other
  misc_feature (695)..(695): n is a, c, t, g, unknown, or other
gctctagatctagtggatcccccgggctgcaggaattcgcacgagaccattacctagaacatcctaatcgaaaaaccagtactagcagtggcgcaaaaacttttttattacaacttcccggcaggacccgtttcgttcggtccaagtctccaacccctagcagcccacccacatacaattccgtttgcccgggtcctctcctcgcccgcgaccgccgtttgactcccggacccgacccactcccaccaatcggaggcaaagatcgcgtgaaatcccgggtctcgcgcgcccatttcagccggacgctgaccaagacaaccccggcgatccccacacccgcacacacaaagacgcagaccacacaacggctcggcaagcggcagcaagcccagaccagagcgaaaacccaccgttccagcacccgattttgaaccaccgcgacactcccaagtcccaaccaaatctacgacccctccgaccgaaacgagatctccgcctcccctcacggaaaggaaagaaacgctctccccccggggcaaagggaaccgtcgccgcgtcgcggaaaactgaagcggngcacaggaggaggagaggccgaggcagggagagggttccggcggcgatggagcggtacaacccctccgaggtgtacgagctcttcgtgcgccacatgaacaacccgaggtaagggaggn

SEQ ID NO: 32153 - DNA, 660 bp, Zea mays
  misc_feature: Ceres CLONE 1409085-F
  misc_feature: Translation starting site: 227
  misc_feature: SWISSPROT Homolog: EC 1.1.1.1 Alcohol dehydrogenase
aaagctggagctccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaagctgagagcctgagacaaacgatctctctgatcgaatttgctcatctgtgttctcttccaattccaacatgcaggcgcaacttgatctgttccccagagtcttcggccacgaggcatccggagtagtagagagtgtcggtgaaggtgtgaccgagttccaagtcggtgaccacgttctcactgtcttcattggggaatgcaagagctgcaagcactgcgtctcagggaagagcacatgtgccagaa

SEQ ID NO: 32154 - DNA, 637 bp, Zea mays
  misc_feature: Ceres CLONE 1409087-F
  misc_feature: Encodes the peptide sequence at SEQ ID NO. 32155
  misc_feature (370)..(370): n is a, c, t, g, unknown, or other
  misc_feature (459)..(459): n is a, c, t, g, unknown, or other
  misc_feature (518)..(518): n is a, c, t, g, unknown, or other
  misc_feature (521)..(521): n is a, c, t, g, unknown, or other
aagctggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccanccaccgcaccgagtgccaatggcgactgcagcgagttcgacgccggcggcgcggcagcctactctggtctgcgcgtcactgaccgcgcnggtgccccgggagatggcagcggaggttgccgccgctgcggcgctcggtgccgacgtgncgnagctccaggtcggctgcctcgacagcttcgagccatggcaggacctgcccgtgctttctcgccagccccgttcgctccccgtcatcgtcactacaggcccgaatttgggagggagc

SEQ ID NO: 32155 - protein, 83 aa, Zea mays
  misc_feature: Ceres CLONE 1409087-F
  misc_feature (24)..(24): Xaa is any aa, unknown, or other
  misc_feature (44)..(44): Xaa is any aa, unknown, or other
  misc_feature (45)..(45): Xaa is any aa, unknown, or other
MATAASSTPAARQPTLVCASLTAXVPREMAAEVAAAAALGADVXXLQVGCLDSFEPWQDLPVLSRQPRSLPVIVTTGPNLGGS

SEQ ID NO: 32156 - DNA, 653 bp, Zea mays
  misc_feature: Ceres CLONE 1409088-F
  misc_feature: Encodes the peptide sequence at SEQ ID NO. 32157
  misc_feature (372)..(372): n is a, c, t, g, unknown, or other
  misc_feature (402)..(402): n is a, c, t, g, unknown, or other
  misc_feature (419)..(419): n is a, c, t, g, unknown, or other
  misc_feature (476)..(476): n is a, c, t, g, unknown, or other
  misc_feature (527)..(527): n is a, c, t, g, unknown, or other
  misc_feature (583)..(583): n is a, c, t, g, unknown, or other
  misc_feature (651)..(651): n is a, c, t, g, unknown, or other
aagctggagctccccgcggtggcggccgctctagaactagtggatcccccgggctgcaggaattcgcacgagaccattacctagaacatcctaatcaaaaaatatcccttcctcgtatatcctttcctgagtaggagagagagttgagttaggagttgttgtgctgatcatctcggtcgaccgagagatggaccaccacttcactgagatagaggggaagatggcgcacgagccactggcacacagctccaccttctccgatgagacgaaagacaaaatggagcacgattcactggtgtacagtccacgcagcatcgcgagggccacaaccaccggcatccctgtcggcgatcaaggcgtggccgtgctacntgggccgcttatcgtgggtgcagggccggncggtctggcatgcgcgncgttgctcaccatgttatacattccctacgtgctcctagagcgcgacgtgtgcgtancctcaatgtggcaccgccgcacgtaccgcaggttgtgtctgcacctacccnagcgctactgtgagctcccgctcatgcactttccacgcacctaccccacatatccnacccggcagcagttccttgtctaccctcatgagtacatgcgcgcatttggcatccgtcatttttcagnct

SEQ ID NO: 32157 - protein, 154 aa, Zea mays
  misc_feature: Ceres CLONE 1409088-F
  misc_feature (62)..(62): Xaa is any aa, unknown, or other
  misc_feature (72)..(72): Xaa is any aa, unknown, or other
  misc_feature (78)..(78): Xaa is any aa, unknown, or other
  misc_feature (97)..(97): Xaa is any aa, unknown, or other
  misc_feature (114)..(114): Xaa is any aa, unknown, or other
MDHHFTEIEGKMAHEPLAHSSTFSDETKDKMEHDSLVYSPRSIARATTTGIPVGDQGVAVLXGPLIVGAGPXGLACAXLLTMLYIPYVLLERDVCVXSMWHRRTYRRLCLHLPXRYCELPLMHFPRTYPTYPTRQQFLVYPHEYMRAFGIRHFS

SEQ ID NO: 32158 - DNA, 713 bp, Zea mays
  misc_feature: Ceres CLONE 1409090-F
  misc_feature: Encodes the peptide sequence at SEQ ID NO. 32159
  misc_feature (713)..(713): n is a, c, t, g, unknown, or other
ccccgggggggggggcggtctagaacttatggatccccccggctggaggaattcgcaccaaaacattaactaaaacatcctaatccaaaaaacgtgcctctctcacccttttcctatctgccctccaagtctccgtcaggcacccccatgccgatgaggccatgaccatgaccccccgtaggcgagcgcactactgccaatggctccctgccgtgacctgttccatgaaggaccgccccccgtggggcctctctctctgcggcagcggccgtgactccataaacgactccgctcctggtgccgccacgtccggtatgccaccgccggcactcccgagtccgcgccccgcgtattccctgctcccactgaagcagcgtcgccaccgccggactctccagggtttcgccgacctcgcctccacactcgtgctcgacgacctcctatcccccggctccgcctccgccttccgccagctcgctccccgcctccgggcccagggccgccaggtagcgctcttcgcgctccactgcgtgccgggctggggactccactccgtgtgcggccgacgtcccgagatggaggacgccgcccgcgtgctcccaaccttcttccacgtcccgctctggatgctcgccggcgacgcgcccgtcgacggcctcgaccgggcatccttccgcctccccgcgcacttcttcgccgtctacgacggtcan

SEQ ID NO: 32159 - protein, 45 aa, Zea mays
  misc_feature: Ceres CLONE 1409090-F
MEDAARVLPTFFHVPLWMLAGDAPVDGLDRASFRLPAHFFAVYDG

SEQ ID NO: 32160 - DNA, 715 bp, Zea mays
  misc_feature: Ceres CLONE 1409092-F
  misc_feature: Encodes the peptide sequence at SEQ ID NO. 32161
  misc_feature (679)..(679): n is a, c, t, g, unknown, or other
cccccggggggcgggccgttctaaaattagtggttcccccgggttgcaggaattcgcacgaaaccattacctaaaacatcctaatcaaaaaaactcgacgtctgccttctgcgcctccatttccgcctctgtctcttgctatttccaatctcacctccaaccactgcacaaatagaagtcccacatcaacattgtggttattggccatgccgactctggcaagtcgcaccaccactgtacaccttatctacaagctcggacgcctttcccacgcgcgtgatccagaggctcgagaaggaggctgctgaaatgaacaagcgtctccttcaagtacgcgtggatagctcgacaagctcaaggctgagcgcgagagaggtatcagcattgatatcgctctgcgacaagtcataaaccaccaatgactactgctcgtccattgatgctcctggacaccgggacttcatcaagaacatgatcactgttacctcccaggctgactgtgatgtccttatctttgactccaccactggtggttttgaggctgtgatcaccaacgatgtccagacccgccaacatgctcaccttgcgtactcccttggaatgaagcacatgatttgctgctgtgacgacatggatgcaaccactcccaaagacactcaggctccttatgtaacagacngtcaaggaagtctcatcctagctcaataaagctgcc

SEQ ID NO: 32161 - protein, 78 aa, Zea mays
  misc_feature: Ceres CLONE 1409092-F
  misc_feature (70)..(70): Xaa is any aa, unknown, or other
MITVTSQADCDVLIFDSTTGGFEAVITNDVQTRQHAHLAYSLGMKHMICCCDDMDATTPKDTQAPYVTDXQGSLILAQ

SEQ ID NO: 32162 - DNA, 715 bp, Zea mays
  misc_feature: Ceres CLONE 1409094-F
  misc_feature (715)..(715): n is a, c, t, g, unknown, or other
ccccgcggtggcggccgctcttcaccagtggatcccccgggctgcaggaattcgcacgagaccattacctagaacatcctaatcgaaaaactccaccctccctccctctctctctctctctccacctccaccaccagcacccaccatcccggctcgaagaccgcttccctccctccgctccacccccgcaaccctctcccgccgcgcacgcgccaccttccattcctccgctccccgcttcctcccaatcttaaccacccgccgcgccccctcccgccacccggcttcctctccccctcttcttcctccctcaaaccagacgctcgccccccatttccccatctcttcttcttcttccccatccagaggaggaaggaagaagaataagcaggaggcctctcccccccagcccagccaccccgtagcgacgacggagggcggaagaggatgagcgcgtccaggttcataaagtgcgtcacggtcgggggacggcgccgtcggcaagacctgcatgctcatttcctacacctccaacacttccccaccgactatgttccgacggtgtttgacaactcagtgctaacgttgtgggtgatggtaacactgtcaaacctcgcctctgggaaactgcaggtcaagaggattacacagactgaaaccctggagctatcggggagctgaagtttttcttcggcttccccactgatcaaaaaan

SEQ ID NO: 32163 - DNA, 706 bp, Zea mays
  misc_feature: Ceres CLONE 1409101-F
  misc_feature: Translation starting site: 181
  misc_feature: SWISSPROT Homolog: EC 2.7.8.23 Carboxyvinyl-carboxyphosphonate phosphorylmutase
  misc_feature (550)..(550): n is a, c, t, g, unknown, or other
aagctggagctccccgcggtggcggccgctctagaactagtggatcccccgggctgcaggaattcgcacgagaccattacctagaacatcctaatcgaaaatcgcctttccgatcccatccctctccagccaccttcctccgctcgccgtgcttctgcttcctccgccaccaccgccggcatggctgcgcgctgcccctacttcgccgtcgaggagtcctcccgcggcatccgctcgggggagtccccggccgcggcgctccgccggatcctcgcgacgcctggtgcgcaccaggcgccctgctgctacgacgcgctcggcgcgcgcctcgtcgagcgcgcggggtttccgatcgggttcatgggcggtttctgtgtttctgccgcgcgacttggcttgcctgatgttggcctcatttcctatggagaaatggtagatcaagggcgtctcatcaatgaagctgtttcaatcccagtgattggtgatggagacaatggttacggaaattctatgaatatcaagagaaccataaaaggatatatcaatgctnggttttgctgcaattatgcttgaggatcagggtgccacctaaagcatgtggacatactgaacggagggaaagtcatatcaaggggagggagcttgtcatgcacataaaagctgcctgtaaatgctaggaaagagaggggctcctgacattgttatt

SEQ ID NO: 32164 - DNA, 575 bp, Zea mays
  misc_feature: Ceres CLONE 1409107-F
  misc_feature: Encodes the peptide sequence at SEQ ID NO. 32165
  misc_feature (230)..(230): n is a, c, t, g, unknown, or other
  misc_feature (231)..(231): n is a, c, t, g, unknown, or other
  misc_feature (258)..(258): n is a, c, t, g, unknown, or other
  misc_feature (276)..(276): n is a, c, t, g, unknown, or other
  misc_feature (277)..(277): n is a, c, t, g, unknown, or other
  misc_feature (283)..(283): n is a, c, t, g, unknown, or other
  misc_feature (289)..(289): n is a, c, t, g, unknown, or other
  misc_feature (292)..(292): n is a, c, t, g, unknown, or other
  misc_feature (294)..(294): n is a, c, t, g, unknown, or other
  misc_feature (299)..(299): n is a, c, t, g, unknown, or other
aaagctggagctcccaccgcggtggcggccgctctagaactagtggatcccccgggctgcaggaattcgcacgagaccattacctagaacatcctaatcgaaaaaactacaatactgctgcgcgctagcggtagcgctcgcgctcccactcgcaccacagcacgccaccgctgctgccggctcctccccgcgctcgcattgcgatttgcgacctagcgcgagggtaccgnnggtggtgcgcgtgctccgtgatccggnaagcgcccgagatggcgnnggcggnaggcgncgntnccccncccaaacacgacgactcacgccgcaccccgtcaaggacagctcccctgggggcttctacggatcacagccctccccgggggcggaagcggtcttctggggtcccacttatcgggcagggttgggacccgtggggatcaccaacctggcttggcccaaaagggggggaaccagggggcaaaggggggggttaccaaaaattgggggctgttggaggaaccaacccccccggggaggattttttggaacaatggttcctgggaagaaatcggggataa

SEQ ID NO: 32165 - protein, 101 aa, Zea mays
  misc_feature: Ceres CLONE 1409107-F
  misc_feature (3)..(3): Xaa is any aa, unknown, or other
  misc_feature (5)..(5): Xaa is any aa, unknown, or other
  misc_feature (7)..(7): Xaa is any aa, unknown, or other
  misc_feature (8)..(8): Xaa is any aa, unknown, or other
  misc_feature (9)..(9): Xaa is any aa, unknown, or other
MAXAXGXXXPPKHDDSRRTPSRTAPLGASTDHSPPRGRKRSSGVPLIGQGWDPWGSPTWLGPKGGEPGGKGGGYQKLGAVGGTNPPGEDFLEQWFLGRNRG

SEQ ID NO: 32166 - DNA, 709 bp, Zea mays
  misc_feature: Ceres CLONE 1409111-F
  misc_feature: Encodes the peptide sequence at SEQ ID NO. 32167
  misc_feature (666)..(666): n is a, c, t, g, unknown, or other
  misc_feature (686)..(686): n is a, c, t, g, unknown, or other
  misc_feature (707)..(707): n is a, c, t, g, unknown, or other
gctctagaactagtggatcccccgggctgcaggaattcgcacgagaccattacctagaacatcctaatcgaaaacccttttgctcgcgcacgcgctcgtctctccaagcctcgaaccgcatctccggcggcctagtggaacgcgaagatggcgacggcgctcggcctcggtgcgcgctccggcctccgactcctgtccgcaggcgccgaggccgcctcagcaacgtcttctcgtgcattccattctactggcacaaggaggatgggggcgcacgctcatgatgagccatactacgtccacgccaagcacatgtacaacctgcacaggatgaagcaccagcagcttaaggtgtgcctcgctgtgctggctgcggtgggcactggcattggagtccctgtgtatgctgttgttttccagcagaagaagactgcatctgcataatctgaaacgccgaggcggcacgacatgaaaacatgcctgcccgtgaaatttcttttcccatttcccacatagcattttgagaggttcaggctggagcttcagttttgcttggccatttctctctctatatatttttttctctcttgctgcaggtttactctgctcattggattttgacataggaataccgatgtctgttaataatacgatgtcttggactgacangaagcatatgctgttatccnttctaattttgcttccctggntt

SEQ ID NO: 32167 - protein, 97 aa, Zea mays
  misc_feature: Ceres CLONE 1409111-F
MATALGLGARSGLRLLSAGAEAASATSSRAFHSTGTRRMGAHAHDEPYYVHAKHMYNLHRMKHQQLKVCLAVLAAVGTGIGVPVYAVVFQQKKTASA

SEQ ID NO: 32168 - DNA, 613 bp, Zea mays
  misc_feature: Ceres CLONE 1409113-F
  misc_feature (331)..(331): n is a, c, t, g, unknown, or other
  misc_feature (487)..(487): n is a, c, t, g, unknown, or other
aaagctggagctccccgcggtggcggccgctctagaactagtggatcccccgggctgcaggaattcgcacgagaccattacctagaacatcctaatcgaaaaacaagccaaacgtgcagctgaggaatcgcaacggcagtgacgtgtgcgcgttgccaaataaagctactatactagtcaccgctcgattgccgtcgcagccgcccgccggccggagatgggtgcgccggcgctggtcgtccgtcgtcgtggtggccacggcggcagtggtttgcctgtgcggggcctttgcgcaggcgcaggacatggacagcgagtgggcgcggccggnctaccgcgggttcttcggcgccccggccgggtcgctgctgccgcagtcggacgtggacctgctggagttcccgctgaacctggagtacctgggagacggagttcttctgctggtccgctctggggtacggcctcgacgccttcgacggcacctcanccgggggggggccgccctccatcggggggcaggccgcgtccctcaccccgttcatccgggaaggggccaccccgttctgtaaccaaaaaatcgggcaccctagggggatcaggcaaagggggaggg

SEQ ID NO: 32169 - DNA, 654 bp, Zea mays
  misc_feature: Ceres CLONE 1409114-F
  misc_feature (227)..(227): n is a, c, t, g, unknown, or other
  misc_feature (353)..(353): n is a, c, t, g, unknown, or other
  misc_feature (383)..(383): n is a, c, t, g, unknown, or other
  misc_feature (384)..(384): n is a, c, t, g, unknown, or other
  misc_feature (402)..(402): n is a, c, t, g, unknown, or other
  misc_feature (410)..(410): n is a, c, t, g, unknown, or other
  misc_feature (415)..(415): n is a, c, t, g, unknown, or other
  misc_feature (469)..(469): n is a, c, t, g, unknown, or other
  misc_feature (541)..(541): n is a, c, t, g, unknown, or other
  misc_feature (573)..(573): n is a, c, t, g, unknown, or other
aagctggagctccccgcggtggcggccgctctagaactagtggatcccccgggctgcaggaattcgcacgagaccattacctagaacatcctaatcaaaaaagaatatcgcatcgccgtcgcgtcgtcgtcgatctccccgccccgccccgcccgcgccgcggaatctgacacatctccctaatctctcctaggaccgggtgcccttacatccacgccgcaacgcanatcgccgtccgagccctcgcggtctctcgtctccccgtgcgagaggacgccggcagcagcggcgtgccagtgcggtggcttgggtgggggaagaccggaggcggcggcagagctcgcgcccagagnttgcacgggcaggcttgttctcggcgtcgnnctggggggaaggcgagancccccggnaaggnacgagtgaataatcatgagctcgatctgcccctttcgcggagcacaactggggngggtgggtgtatgcccctgtgaaatctgataagagaccccctgggggtgtgccctgcaaaatctgacagagncatcagtggtgtatgccctgtcactggcaggnatcatggtagcagctcaaggaaaagtggtgatcatggtgaagaaaagggcccggatcctcgtgtcggacagcaaatgccaa

SEQ ID NO: 32170 - DNA, 640 bp, Zea mays
  misc_feature: Ceres CLONE 1409121-F
  misc_feature (478)..(478): n is a, c, t, g, unknown, or other
  misc_feature (595)..(595): n is a, c, t, g, unknown, or other
  misc_feature (596)..(596): n is a, c, t, g, unknown, or other
aaagctggagctccccgcggtggcggccgctctagaactagtggatcccccgggctgcaggaattcgcacgagaccattacctagaacatcctaatcgaaaacttggatagtccgtagccgcttgccctgttcgcatcttcgcgcgtggcgcacaccgctccagctctccttcgacgggcacggccgagccgccttcgtcttggccgcagcggtgcgcgctctccatggcgtcctaattagcctagccgcaacgccgcgcccgtgcctgcgaagtagggtgtaaagttttgtatatgatgccaggcatggatgaaccccttcttggcaatggtcttaagaccagcgggaaaagagagagcctgggtagtggccgaggtcagaaaacagatgtaccttgctgggccactcatcgctgcatggatcctacagaaatttgtccagatgatatcctatcattgtttggcggtcacctttggntgagcttgccctctccagtgcctccatcgccccctccctttgcaggcgttactgggcttcagcttattgtctggcatggcgagcagcttggacacactgtgtggggcaatcgttcgnnggcaaagcagtactatcttcttggcatctaacagcagagggcag

SEQ ID NO: 32171 - DNA, 631 bp, Zea mays
  misc_feature: Ceres CLONE 1409123-F
  misc_feature: Encodes the peptide sequence at SEQ ID NO. 32172
  misc_feature (286)..(286): n is a, c, t, g, unknown, or other
  misc_feature (287)..(287): n is a, c, t, g, unknown, or other
  misc_feature (290)..(290): n is a, c, t, g, unknown, or other
  misc_feature (311)..(311): n is a, c, t, g, unknown, or other
  misc_feature (348)..(348): n is a, c, t, g, unknown, or other
  misc_feature (390)..(390): n is a, c, t, g, unknown, or other
  misc_feature (406)..(406): n is a, c, t, g, unknown, or other
aagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtgnntgncgtcggtgctcaaggaccggnggtgtcgacggcctcccgccggggcctccgggttggncggtggtgggggaacctgtttcaggtgatcctgcagcgacgncccttcatgtacgtgntgcgcgacctccgggaagagtacgggcccatcttcaccatgcggatggggcagcgcaccctcatcgtggcaacctcggcggagctcatccacgaggcgctggtgaagcagggccccatggtcgcgagccggccgaggacagccccacccgcctcctcctcagggtcggaaggtgaccgtcaactcggcgccctaacggccccctggggggggctctgccccgcac

SEQ ID NO: 32172 - protein, 78 aa, Zea mays
  misc_feature: Ceres CLONE 1409123-F
  misc_feature: SWISSPROT Homolog: EC 1.14.14.1 Unspecific monooxygenase
  misc_feature (4)..(4): Xaa is any aa, unknown, or other
MYVXRDLREEYGPIFTMRMGQRTLIVATSAELIHEALVKQGPMVASRPRTAPPASSSGSEGDRQLGALTAPWGGLCPA

SEQ ID NO: 32173 - DNA, 625 bp, Zea mays
  misc_feature: Ceres CLONE 1409126-F
  misc_feature: Encodes the peptide sequence at SEQ ID NO. 32174
  misc_feature (319)..(319): n is a, c, t, g, unknown, or other
  misc_feature (334)..(334): n is a, c, t, g, unknown, or other
  misc_feature (335)..(335): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (410)..(410): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (490)..(490): n is a, c, t, g, unknown, or other
tggagctccccgcggtggcggccgctctagaactagtggatcccccgggctgcaggaattcgcacgagaccattacctagaacatcctaatcgaaaaatctgtgtaatcggtgaccgctcttgacttgttagctccccgctcccacggtagctaaagctagctaggtgggtggtagcaccaccatggcctcgcccaagcattcccatcgccatcatcgtgcggcggcgacgaagcatcgtcggccgctggcgctgcggcgtgcgatgctgcattcgtgcgtgtgcttcctggtgggtctcgtgaccggctggccccttnccgactggacggagnncgctcnnngcgcggccgtgcacgcgaaacgcgcggccacggggggcagggtgttccgcgcgctgcacgcatgaancagacggcggggggcggggggcactggggcagctgctggcgctgcagactacagagnnnnnccagggggtggaaaaaggnaaaggaaaggaaaaaacccctgggatctgggggggggggggggacaacaacaagaacttaaaaggggtttttcggaagcccaaagggagaaacgaagggtttaaaatcccaggggaactatcttcgggtggggct

SEQ ID NO: 32174 - protein, 74 aa, Zea mays
  misc_feature: Ceres CLONE 1409126-F
  misc_feature (46)..(46): Xaa is any aa, unknown, or other
  misc_feature (51)..(51): Xaa is any aa, unknown, or other
  misc_feature (53)..(53): Xaa is any aa, unknown, or other
  misc_feature (54)..(54): Xaa is any aa, unknown, or other
MASPKHSHRHHRAAATKHRRPLALRRAMLHSCVCFLVGLVTGWPLXDWTEXAXXAAVHAKRAATGGRVFRALHA

SEQ ID NO: 32175 - DNA, 660 bp, Zea mays
  misc_feature: Ceres CLONE 1409128-F
  misc_feature: Encodes the peptide sequence at SEQ ID NO. 32176
  misc_feature (336)..(336): n is a, c, t, g, unknown, or other
aaagtggagctccccgcggtggcggccgctctagaactagtggatcccccgggctgcaggaattcgcacgagaccattacctagaacatcctaatcgaaaaagatcgtgtttgccgtgcggcacttgcgtttcgggtcgggtacggacccgcaaaaagagctccgtcagttcctctacctcctctgtaggagcacacttgtttcggaaaggaacgaatattcacgccaggccgccgcctcaattatatggcgccggcgttctcgacacaggtccccgcgctccgacgggcagcactgcgcgtgcgatgggtcacgagatgcactgttctcatcggngattctcgccggcacaagccgattctggtgcgtgcacttcgtgagggtcagcgttgtacgaccccaaccatggctacttctccaagcgggggggggccccggtggggcgttctgtgacgccagcatccgcttcaccagctcggagggggaggagtgcatatatacagcacctttgagaagttgtataggagcatgatcatcgcttgggttactgccgtgcagctctttaagccatgaaatgcctacgcaatagcagcatcgattctgcgtacaggaaatctttcagtcccattgaagaataccgagaatggggggtggcttctg

SEQ ID NO: 32176 - protein, 68 aa, Zea mays
  misc_feature: Ceres CLONE 1409128-F
MAPAFSTQVPALRRAALRVRWVTRCTVLIGDSRRHKPILVRALREGQRCTTPTMATSPSGGGPRWGVL

SEQ ID NO: 32177 - DNA, 642 bp, Zea mays
  misc_feature: Ceres CLONE 1409131-F
  misc_feature: Encodes the peptide sequence at SEQ ID NO. 32178
aaagctggagctccccgcggtggcggccgctctagaactagtggatcccccgggctgcaggaattcgcacgagaccattacctagaacatcctaatcgaaaactctcgctttctctagccatgacgctggtgaggatgccttgccgcctctgctgcttcctgctcgtcgtcgccgcctccgccgtctccgggcggggggcgggtggtcaccaccctcccgggctacgagggccgcctccccttcacctcgaaacagggtatggtggaggtggacgaggacgccggcgcggagctcttctactacttcgtccgggccgagtccggcgccgacgacagcgacaccccgttcgtcctccggatccccggcggccaacgctgctccgccttcagcggcctcgcctacgagataggtcccatcatggttcgtcgtggagccctacaacggcagcttgccgcgcctgcgctacacccaaactcgtggacaaaggggcgcatatttctttttgtgatttcgcagttgggggccgggttttccttcttcagagatgccaaaggctacacggctggagcggtatcaaccacgctgcacctgggggaagttcctcaacaagtgggtcaacgaccatcctggaggacatgcaa

SEQ ID NO: 32178 - protein, 127 aa, Zea mays
  misc_feature: Ceres CLONE 1409131-F
  misc_feature: SWISSPROT Homolog: EC 3.4.16.5 Carboxypeptidase C
MVEVDEDAGAELFYYFVRAESGADDSDTPFVLRIPGGQRCSAFSGLAYEIGPIMVRRGALQRQLAAPALHPNSWTKGRIFLFVISQLGAGFSFFRDAKGYTAGAVSTTLHLGEVPQQVGQRPSWRTC

SEQ ID NO: 32179 - DNA, 637 bp, Zea mays
  misc_feature: Ceres CLONE 1409132-F
  misc_feature (426)..(426): n is a, c, t, g, unknown, or other
  misc_feature (443)..(443): n is a, c, t, g, unknown, or other
  misc_feature (472)..(472): n is a, c, t, g, unknown, or other
  misc_feature (481)..(481): n is a, c, t, g, unknown, or other
  misc_feature (498)..(498): n is a, c, t, g, unknown, or other
  misc_feature (506)..(506): n is a, c, t, g, unknown, or other
caagctggagctcaccgcggtggcggccgctctagaactagtggatcccccgggctgcaggaattcgcacgagaccattacctagaacatcctaaccaaaaaaacgagaaggaagccaccgctccccaatcgcctgcttgccttcccatcctcctcgtagatctccggcaccgggcaccatgagctcctactccggcgaccgctcctcctcctcctccttgcgccccaccaacacctccttcgactcctacaagttcgacttcggcatcaactcctcccgctcctccggctctcgccccctccgcgaccagcggccgggcgcggctaccaaccctccaacgaggcccgccaccggcgccacgtggatgcaccagcccgccagcgccaagccgccgcggacccaccagccttcccccgccgcggcgncggcgcccaccatggcngggccgggaccccgcccaaccccccaggncggcgacanccttgggccgaacccgncccccggngcgccccccccggggggcggaacctgtcagatccaaagcccgggcccctctccctgttcccccgcggcccaggctcgctccctcgcgcatcccggtctaagccgccccgttacccccccccccccccccct

SEQ ID NO: 32180 - DNA, 639 bp, Zea mays
  misc_feature: Ceres CLONE 1409136-F
  misc_feature: Encodes the peptide sequence at SEQ ID NO. 32181
  misc_feature (269)..(269): n is a, c, t, g, unknown, or other
  misc_feature (543)..(543): n is a, c, t, g, unknown, or other
aaagctggagctccccgcggtggcggccgctctagaactagtggatcccccgggctgcaggaattcgcacgagaccattacctagaacatcctaatcgaaaaactacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacntcgaccgcatgctccacgacatccctggcatgaaggtcctcgtcctcgacccccaaaccgttgggatggtgagcgtggtgtacagccagtcggatctgctgccggaaggaggtcttcctcgtcgagaccatggacaacgcctccagctccagggagtccatggcgcaccctcaggggcgtctacttcctccgaccctccgctaacaacgtcagaaagctccgcaggcacctcgccatggcgcgccttcgccgagtaccacctattcttctcagnaatattgaaggtcccgcagattcaatacttgctgactcgatggaaaaagaggttgtgcagaaaggtcagggagtctattgctgatttttgggccat

SEQ ID NO: 32181 - protein, 133 aa, Zea mays
  misc_feature: Ceres CLONE 1409136-F
  misc_feature (11)..(11): Xaa is any aa, unknown, or other
  misc_feature (102)..(102): Xaa is any aa, unknown, or other
MVLITLVRDYXDRMLHDIPGMKVLVLDPQTVGMVSVVYSQSDLLPEGGLPRRDHGQRLQLQGVHGAPSGASTSSDPPLTTSESSAGTSPWRAFAEYHLFFSXILKVPQIQYLLTRWKKRLCRKVRESIADFWA

SEQ ID NO: 32182 - DNA, 641 bp, Zea mays
  misc_feature: Ceres CLONE 1409138-F
  misc_feature: Encodes the peptide sequence at SEQ ID NO. 32183
  misc_feature (254)..(254): n is a, c, t, g, unknown, or other
  misc_feature (258)..(258): n is a, c, t, g, unknown, or other
  misc_feature (263)..(263): n is a, c, t, g, unknown, or other
  misc_feature (321)..(321): n is a, c, t, g, unknown, or other
  misc_feature (339)..(339): n is a, c, t, g, unknown, or other
  misc_feature (340)..(340): n is a, c, t, g, unknown, or other
  misc_feature (378)..(378): n is a, c, t, g, unknown, or other
  misc_feature (407)..(407): n is a, c, t, g, unknown, or other
  misc_feature (423)..(423): n is a, c, t, g, unknown, or other
  misc_feature (507)..(507): n is a, c, t, g, unknown, or other
  misc_feature (513)..(513): n is a, c, t, g, unknown, or other
aaagctggagctccccgcggtggcggccgctctagaactagtggatcccccgggctgcaggaattcgcacgagaccattacctagaacattcctaatcgaaaaatccgcttccccgccttccgtttcccttaccccccgcatcacctaccaacgccgacaccatgggggccttcgcgaaggaggagcaccagttcctagccgagcttcggcctcgcgcagcgcaacccaggcgcgttcgcatgcggtgcgtggngcgnctcangtcccaccgtcacctccacgagcccgaccaacaatcaggtcatcgcagaggtcgtggnaggcgtccgtgcacgacnntacgaggagggcatgcgcgcctgcttcgatgccgcaangacatgggatggcgattcctgctccaagncgaggagagatcgttnagcaaatcggtgatgcactgagagcaaagctcctccaccttggcaggcttgtgtcacttgagatggggaaattcttctggaggnattcgnggaggttcaggaatcatcgacatgtgtgattatgctggtggggctaagtcgccactagatgatccattatccatctgacgaccaacatatggggggtgggggtgtggatcccctggggagggggggtg

SEQ ID NO: 32183 - protein, 57 aa, Zea mays
  misc_feature: Ceres CLONE 1409138-F
  misc_feature: SWISSPROT Homolog: EC 1.2.1.3 Aldehyde dehydrogenase (NAD(+))
  misc_feature (4)..(4): Xaa is any aa, unknown, or other
  misc_feature (13)..(13): Xaa is any aa, unknown, or other
  misc_feature (19)..(19): Xaa is any aa, unknown, or other
  misc_feature (47)..(47): Xaa is any aa, unknown, or other
  misc_feature (49)..(49): Xaa is any aa, unknown, or other
MPQXHGMAIPAPXRGEIVXQIGDALRAKLLHLGRLVSLEMGKFFWRXSXRFRNHRHV

SEQ ID NO: 32184 - DNA, 629 bp, Zea mays
  misc_feature: Ceres CLONE 1409141-F
  misc_feature: Pfam Name: DUF1365 Pfam Description: Protein of unknown function (DUF1365)
  misc_feature (294)..(294): n is a, c, t, g, unknown, or other
aagctggagctccccgcggtggcggccgctctagaactagtggatcccccgggctgcaggaattcgcacgagaccattacctagaacatcctaatcgaaaaaaaaaaaatatcgaattacatcaaatccgaggagcagccacagccatccatggaggcgctctacttgctggcctccctggccgcgactgtcgtcacctccgccttccactcgctcctgctgttcctccgcctcctcctccgctacccgcgccgcgctgcccctaccgatgatgggcccgccgcggcggcgcgnctctacgaagggccgggtccggcacgcgcgacggcgcccggcggcgcacaccttcgagtaccccgcgcgctacgccctcgtcgacctcgaccgactgccgctccccggccacctcctccgccgacgatgccccgcgcgtctcctccacttccggccccgtgcaccctcttgacggtacccgagagcggggcgtacgagcaccaacccgctgggcatttactactgctacgattctggaggacaggggcaagatggaaagctcataacgggcattgccgagtcacaaacaccccctgggcaaaaagagtggagtttaccttccaaccggctctgat

SEQ ID NO: 32185 - DNA, 633 bp, Zea mays
  misc_feature: Ceres CLONE 1409144-F
  misc_feature: Translation starting site: 267
  misc_feature (460)..(460): n is a, c, t, g, unknown, or other
  misc_feature (485)..(485): n is a, c, t, g, unknown, or other
  misc_feature (563)..(563): n is a, c, t, g, unknown, or other
aaagctggagctccccgcggtggcggccgctctagaactagtggatcccccgggctgcaggaattcgcacgagaccattacctagaacatcctaatcaaaaaaatgagctcgctctcctgctcctacaggctgcagttgcgctgtgcctgtgcttccagttccatcgctttcccctcctccccagtccccactcccagatgcgatttccctctccaccgccacagcgcctagcttagccagccagccggcggccatcgccgccgcaatgcgacccgcgtcggaggacgaggccgcctcggaccgctgcagcggcagctacagccccagcgccgacgtcagcgagtccgaaacctccagtgactgctccgcgcccaccacgcgccgcttcgcctcctcctcctcggcctccgccacgtctccccgcctcgcgtcctcctcctcgtcgctccccaccccggnatcggccaccgccttctacctctcnagccaaccccgaccctctccgagatcgacatgatgaaggagcgcttcgcgaagctcctgctcggcgaggactgtcggncagcgggaagggcgtctgcacgcgctcgcatctccatccatcacaactctcccgccacgtgttcgggagt

SEQ ID NO: 32186 - DNA, 607 bp, Zea mays
  misc_feature: Ceres CLONE 1409147-F
  misc_feature (226)..(226): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (234)..(234): n is a, c, t, g, unknown, or other
  misc_feature (237)..(237): n is a, c, t, g, unknown, or other
  misc_feature (241)..(241): n is a, c, t, g, unknown, or other
  misc_feature (242)..(242): n is a, c, t, g, unknown, or other
  misc_feature (244)..(244): n is a, c, t, g, unknown, or other
  misc_feature (246)..(246): n is a, c, t, g, unknown, or other
  misc_feature (247)..(247): n is a, c, t, g, unknown, or other
  misc_feature (607)..(607): n is a, c, t, g, unknown, or other
aagctggagctccccgcggtggcggccgctctagaactagtggatcccccgggctgcaggaattcgcacgagaccattacctagaacatcctaatcgaaaaacgggtcaccagtcaccacatccctccctccctgccatttgtttggttgttcctctcgcagtctcgctcgccaccaggcagcaggcatcccaatctcgcgagagccagtagcggcggcggcggantcannngnggngggnngngnncctcgtgagaactgcaaaaccaccggtcgtatacagtaggcctgcctgcctgcctgccagcaaaccctcccgatcggccgcactgaaatgatcagagtgagtcccctcatcctcgtcggcccgctccgtggttattggcccaatccctcaagcctctggggcccgccgttcaccaccccccatcacgttaagggaaagggggctggggtcggataacagggaaaaggaccccgccgccggtgccgcaagaaccctctccgcccccattcgcggggaaaatggaatccggtcccgaagcccctggaacggcaaggccaaacccaaacaattccggtttcctaaggtgcccccaaggcccan

SEQ ID NO: 32187 - DNA, 647 bp, Zea mays
  misc_feature: Ceres CLONE 1409152-F
  misc_feature: Encodes the peptide sequence at SEQ ID NO. 32188
  misc_feature (430)..(430): n is a, c, t, g, unknown, or other
aagctggagctccccgcggtggcggccgctctagaactagtggatcccccgggctgcaggaattcgcacgagaccattacctagaacatcctaatcgaaaaagcggtccgatagccaggaaggccgtgcacgtcgaccgacggacgccaccatggcggggctcaccataggcgacaccgtccccaacctggagctggactccacccacggaaagatccgcatccacgactacgttggggacggctacgctatcatcttctctcacccggccgacttcacgcccgtgtgcacgacatagatggcggcgatggcgcggtacgccaaggagttcgagaagcgtgacgtgaagctgctgcacatctcgtgcgacaatctggagtcgcacaggcagtggaccaaggacgtgtaggcgtacggctgtaagcatcancagtttgtgcatacgacgacgaaggtgacgttcccgatactggaggacccggcgcgcgacgccgtcctgacagtgagcatggtggaccccgaccacaaagacgacgtgtgggaggagcatgacgtaccgcgcgcatcatgtcgtcgggaccgaacaggccgagaagctgagcttcctgtaccggccaccacggagcgggacatggacgaggtgctgc

SEQ ID NO: 32188 - protein, 48 aa, Zea mays
  misc_feature: Ceres CLONE 1409152-F
  misc_feature: SWISSPROT Homolog: EC 1.11.1.15 Peroxiredoxin
MAGLTIGDTVPNLELDSTHGKIRIHDYVGDGYAIIFSHPADFTPVCTT

SEQ ID NO: 32189 - DNA, 601 bp, Zea mays
  misc_feature: Ceres CLONE 1409153-F
  misc_feature: Encodes the peptide sequence at SEQ ID NO. 32190
  misc_feature (311)..(311): n is a, c, t, g, unknown, or other
tggagctccccgcggtggcggccgctctagaactagtggatcccccgggctgcaggaattcgcacgagaccattacctagaacatcctaatcgaaaaagcagtccgatagccaggaagcccgtgcacgtcgaccgacgtacgccaccatgccggggctcaccataggcgacaccgtccccaacctggagctggactccacccacggcaagatccgcatccacgactacgttggcgacggctacgctatcatcttctctcacccagccgacttcacgcccgtgtgcacgacggagatggcggcgatggcggngtacgccaaggagttcgagaagcgtggcgtgaagctgctgggcatctcgtgcgacgacgtggagtcgcacaggcagtggaccaaggacgtggaggcgtacggcgggaagcagcagcagcagcagcatacgacgacgaaggtgacgttcctgatcctggcggacccggcgcgggacgccatccggcagctgaacatggtggaccccgacgagaaggacgcgccggggcggaacatggcgtcccgcgcgcttcacgtcgtcgggccgaacagggcgtggggctgagctcctt

SEQ ID NO: 32190 - protein, 148 aa, Zea mays
  misc_feature: Ceres CLONE 1409153-F
  misc_feature (6)..(145): Pfam Name: AhpC-TSA Pfam Description: AhpC/TSA family
  misc_feature: SWISSPROT Homolog: EC 1.11.1.15 Peroxiredoxin
  misc_feature (55)..(55): Xaa is any aa, unknown, or other
MPGLTIGDTVPNLELDSTHGKIRIHDYVGDGYAIIFSHPADFTPVCTTEMAAMAXYAKEFEKRGVKLLGISCDDVESHRQWTKDVEAYGGKQQQQQHTTTKVTFLILADPARDAIRQLNMVDPDEKDAPGRNMASRALHVVGPNRAWG

SEQ ID NO: 32191 - DNA, 637 bp, Zea mays
  misc_feature: Ceres CLONE 1409156-F
  misc_feature: Encodes the peptide sequence at SEQ ID NO. 32192
  misc_feature (588)..(588): n is a, c, t, g, unknown, or other
aagctggagctccccgcggtggcggccgctctagaactagtggatcccccgggctgcaggaattcgcacgagaccattacctagaacatcctaatcgaaaaagcagtccgatagccaggaagcccgtgcacgtcgaccgacgtacgccaccatgccggggctcaccatacgcgacaccgtccccaacctggagctggactccacccacgggaagatccgcatccacgactacattggcgacggctacgctatcatcttctctcacccagccgacttcacgcccgtgtgcacgacggagatggcggcgatggcgtgctacgccaaggagttccagaagcgtggcgtgaagctgctgggcatctcgtgctacgacttggagtcgcacaggcagtgcaccaaggacgtggaggcgtacggcgcgaagcagcagcagcagcagcatacgacgacgaaggtgacgttcccgatcctggcggacccggcgcgggacgtcatccggcagctgaacatggtggaccccgaccagaaggacgcggcggtgcggagcatgccgtcccgcgcgctccacgtcgtcgggcccgacaaggnctgtgagctgaagcttctgtacccggacaccacggagcggaacatggac

SEQ ID NO: 32192 - protein, 162 aa, Zea mays
  misc_feature: Ceres CLONE 1409156-F
  misc_feature (6)..(150): Pfam Name: AhpC-TSA Pfam Description: AhpC/TSA family
  misc_feature: SWISSPROT Homolog: EC 1.11.1.15 Peroxiredoxin
  misc_feature (146)..(146): Xaa is any aa, unknown, or other
MPGLTIRDTVPNLELDSTHGKIRIHDYIGDGYAIIFSHPADFTPVCTTEMAAMACYAKEFQKRGVKLLGISCYDLESHRQCTKDVEAYGAKQQQQQHTTTKVTFPILADPARDVIRQLNMVDPDQKDAAVRSMPSRALHVVGPDKXCELKLLYPDTTERNMD

SEQ ID NO: 32193 - DNA, 638 bp, Zea mays
  misc_feature: Ceres CLONE 1409159-F
  misc_feature: Encodes the peptide sequence at SEQ ID NO. 32194
agagctggagctccccgcggtggcggccgctctagaactagtggatcccccgggctgcaggaattcgcacgagaccattacctagaacatcctaatcaaaaaatctgccatcttctatctatccctttcatctcagttttgcatctactactgctggcttcactccgaaatccaaccgaaatctcacaggaaaggaggaaacctcgtttctccaactgctttgagtgatactccaatccttgggcgtcattgccgcctgttttttgggctcggaaaggcgctgtctgattcctgaatatttattttggaaatgctctctgctgctacacaactaaccatggatgacactacctttttcctgacagagcacgaatgctcatatgtgtctccttctctactcatactttttgatgagtgggatgatcgctagacaacgcgcttggttcaccatgacatcagatcctgccgaaccaaggtgctacctgtcacacataattctgtggcaacattaattgaaggacgtgatcttgagattcggacaactcacttcagcatgcagctatgatctcatccagttagtactgagtactgtactctcacgaaagtcatgctgttgggagggagctctagactcgaca

SEQ ID NO: 32194 - protein, 30 aa, Zea mays
  misc_feature: Ceres CLONE 1409159-F
MDDTTFFLTEHECSYVSPSLLILFDEWDDR

SEQ ID NO: 32195 - DNA, 640 bp, Zea mays
  misc_feature: Ceres CLONE 1409160-F
  misc_feature: Encodes the peptide sequence at SEQ ID NO. 32196
  misc_feature (640)..(640): n is a, c, t, g, unknown, or other
aaagctggagctccccgcggtggcggccgctctagaactagtggatcccccgggctgcaggaattcgcacgagaccattacctagaacatcctaatcgaaaaccactgggtcttcagaccattacctttatctactccagagcggagaacaacccgatcgacaccatgagggtgttgctcgttgccctcgctctcctggctctcgctgcgagcgccacctccacgcatacaagcggcggatgcgggtgccagccaccgacgccggttcatctaccgccgacggtgcatctgccacctccggttcacctgccacctccggtgcatctcccaccgccggtccacctgccgccgccggtccacctgccaccggcggtccatgtgccgccggcggttcatctgccgccgccaccatgccactaccctactcaaccgccccggactcagtctcgtccccagccacacccatgcccgtgccaacagccgcatctcatcccgtgccagctgcagggaacctgcggcgttggcaccaccccgatcctgaggcagtgcgacgagttcctgaggcatcagtgcatcccgacggggacgccctactgctcgactcagtgacagccgttgcgatcgcagtgtggccaccatn

SEQ ID NO: 32196 - protein, 147 aa, Zea mays
  misc_feature: Ceres CLONE 1409160-F
MRVLLVALALLALAASATSTHTSGGCGCQPPTPVHLPPTVHLPPPVHLPPPVHLPPPVHLPPPVHLPPAVHVPPAVHLPPPPCHYPTQPPRTQSRPQPHPCPCQQPHLIPCQLQGTCGVGTTPILRQCDEFLRHQCIPTGTPYCSTQ

SEQ ID NO: 32197 - DNA, 673 bp, Zea mays
  misc_feature: Ceres CLONE 1409162-F
  misc_feature: Encodes the peptide sequence at SEQ ID NO. 32198
aagctggagctccccgcggtggcggccgctctagaactagtggatcccccgggctgcaggaattcgcacgagaccattacctagaacatcctaatcgaaaactgtccgcgccaccgctcctcgacccccgcccaacactcccagtcgtcacgccgtcgccgccgcgagtccttcattcaccatgatcatctccaagaagaaccgccgcgagatctgcaagtacatcttccatgagggggttctatatgccaagaaggactacaacctgatcaagcaccccaagcttgacgtgcccaacctcgaggtgattaagctcatgcacagcttcaagtcgaaggagtatgtcaagtacatcttctcctgagagtactactactgtgacctcaccaacgatggaattgagcacctccgcagcttcctcaacctgccgctagaggttgtgacaaaaaccctcaagaagtcctccaagcccccgccccgccccctttggtcctggcgcaccggggggacagccccaggggtcccccctcgctttggggaaaaacccgacctacgctccgggggattagggattggctatacccaacggaggcccccccgcagggagaaaagggggttgaatttttgggaggctgggagaacagggttaatggggttcccccgccgggaaatt

SEQ ID NO: 32198 - protein, 60 aa, Zea mays
  misc_feature: Ceres CLONE 1409162-F
  misc_feature (3)..(61): Pfam Name: S10_plectin Pfam Description: Plectin/S10 domain
MIISKKNRREICKYIFHEGVLYAKKDYNLIKHPKLDVPNLEVIKLMHSFKSKEYVKYIFS

SEQ ID NO: 32199 - DNA, 652 bp, Zea mays
  misc_feature: Ceres CLONE 1409167-F
  misc_feature (411)..(411): n is a, c, t, g, unknown, or other
  misc_feature (432)..(432): n is a, c, t, g, unknown, or other
  misc_feature (556)..(556): n is a, c, t, g, unknown, or other
  misc_feature (569)..(569): n is a, c, t, g, unknown, or other
aagctggagctccccgcggtggcggccgctctagatctagtggatcccccgggctgcaggaattcgcacgagaccattacctagaacatcctaatcgaaaaggaagcttgccgacaactgcactggtctccagggcttcctcgtcttcaacgctgttggcggaggaacaggctctggccttggttccctcctcctggagcgtctgtctgttgactacggcaagaagtctaagcttggtttcactgtgtacccatccccccaagtttcgacctcagtggttgagccatacaacagtgtcctgtccacccactccctccttgagcacactgatgtggctatcctgctggacaacgaggccatctatgacatctgccgccgttcccttgacattgagcgcccaacctacacaancctcacaggcttgtgtcccangtcatctcatccctgactgcctcccctgagttcgatggtgctcttaacgtggatggggatgaggtccaaaccaacttggtgccctacccgaggacccactccgggtttcccccctaggctcagncatccttgttggnaaagcctaacacaacaattgtttgggccgaaattcccaaaaggccttcaaaccttccccctgggggccaaggggatccccccc

SEQ ID NO: 32200 - DNA, 633 bp, Zea mays
  misc_feature: Ceres CLONE 1409169-F
  misc_feature: Encodes the peptide sequence at SEQ ID NO. 32201
  misc_feature (356)..(356): n is a, c, t, g, unknown, or other
  misc_feature (399)..(399): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (421)..(421): n is a, c, t, g, unknown, or other
aagctggagctccccgcggtggcggccgctctagaactagtggatcccccgggctgcaggaattcgcacgagaccattacctagaacatcctaatcggaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgncgccgggtcacctgccaccgccggtccatgtgccgccgccggntcatctgccgnnncgcacatgncactaccctactcaaccgcccggcctcagcctcatcccccagcacacccatggccgtgccaacaggcgcatcccagcccggtgcagctggagggaaccctgcggggttgccaggacccccgatcttggggcaagggggccaaggtcctggaggaatcaggggagccccgaagggggacgcccttactgttccccccaagggcaagcgtttgg

SEQ ID NO: 32201 - protein, 54 aa, Zea mays
  misc_feature: Ceres CLONE 1409169-F
MAVPTGASQPGAAGGNPAGLPGPPILGQGGQGPGGIRGAPKGDALTVPPKGKRL

SEQ ID NO: 32202 - DNA, 633 bp, Zea mays
  misc_feature: Ceres CLONE 1409174-F
  misc_feature: Encodes the peptide sequence at SEQ ID NO. 32203
  misc_feature (526)..(526): n is a, c, t, g, unknown, or other
  misc_feature (531)..(531): n is a, c, t, g, unknown, or other
  misc_feature (590)..(590): n is a, c, t, g, unknown, or other
aagctggagctccccgcggtggcggccgctctataactagtggatcccccgggctgcaggaattcgcacgagaccattacctagaacatcctaatcggaaaaatcaccaccactgggtcttcagacccttagctttatctactccagagcgcacaataacccgatcgacaccatgacggtgctgctcgctgccctcgctctcctggctctcgctgccagcgccacctccacgcatacaaggggtggctgcgtctgccagccaccgacgtcggttcatctaccgccgacggagcatctgccacctccggttcacctggcacctccggcggatctcccaccgccggttcacctgccgccgccggaccacctgccaccgccggaccatgtgccgccgacggatcatctgccgtcggcaccatgacactaccctactcaaccggcccgtgctcagcctcatcaccagccagacccatgcccgtgtctacagtcgcagcccagcacgtgtcagctgcatggaatctgcttngttgncagcaccccgatcctgtgcaagaaggttctagctacgaggcatcagctgatcccgacgncgacgccctactgctcgcctcagtgtcagacgttgcacgagca

SEQ ID NO: 32203 - protein, 82 aa, Zea mays
  misc_feature: Ceres CLONE 1409174-F
MTVLLAALALLALAASATSTHTRGGCVCQPPTSVHLPPTEHLPPPVHLAPPADLPPPVHLPPPDHLPPPDHVPPTDHLPSAP

SEQ ID NO: 32204 - DNA, 654 bp, Zea mays
  misc_feature: Ceres CLONE 1409180-F
  misc_feature: Encodes the peptide sequence at SEQ ID NO. 32205
ggagctcaccgcggtggcggccgctctataactagtggatcccccgggctgcaggaattcgcacgagaccattacctagaacatcctaatcgaaaaaaagttcgatgcctttttctagaggcgaggaggtaggcgccgttatttggtaccggccatcatgtttgctcccgccgcttccctctccctggcctcacgttccccagatctgaagtcattaaaaccagcggatctcacctcggcgagcgaccgcggcatctgtggaagcgagtgctacagccagcagccatgagatggtatgcatcggctagtctcctgagggcgctggtcctgagtgcggcggcatctgcgatcaggcgtcgttggtccaagatcctgcggggccactaggcgtgtgtactcctgaatcctcgacatcgacacggatggggcggattctgctcagatacgggaaggaagatgatgtactcctctgactgtggctctggtgacgccgtcccgaaaccccatacaagtgctgccgaagacgacttctcggaggtgggtcgggccccctgtcggaccaaaggagggctaaacccagctgcctatatggcacagatttaccatggcctaactggatttgttggtatactccaagctttaaaagggccaagg

SEQ ID NO: 32205 - protein, 33 aa, Zea mays
  misc_feature: Ceres CLONE 1409180-F
MRWYASASLLRALVLSAAASAIRRRWSKILRGH

SEQ ID NO: 32206 - DNA, 651 bp, Zea mays
  misc_feature: Ceres CLONE 1409184-F
  misc_feature: Encodes the peptide sequence at SEQ ID NO. 32207
aagctggagctccccgcggtggcggccgctctagaactagtggatcccccgggctgcaggaattcgcacgagaccattacctagaacatcctaatcgaaaaatcaaattcatcctcctcctacttaccatagagagaacttgtctcacgcgctatgtgtactacatcacagcggactgcggctcctctcgccgcgcgatcatcgtcttcatcgccatcccacggttacatttctctctgcacagccgatcagatactgtgcagagcccatcatcctcatggagaaaataactccgccgtctgtcgccgtctcgctctcacactcctcgctgcgactgctgcacttgattccaaagcatctcccgacgatcccctccacggtgaagctgctcacgcgtctggaaagcgaatacacccagacttcacacatactgtggagaggattcaagcgcaggcgcagcagatgcaagccagcttagagtgacagtatccacgaaaggcccttagtacggaaactacctcgaggctactaacaagctcaatgtcatggtcactccctaccgacaggaagaccatcactggatacggctctgccatgagatctccctctctcaggtgaacttacctccctagggaaaaccatgtttacttt

SEQ ID NO: 32207 - protein, 109 aa, Zea mays
  misc_feature: Ceres CLONE 1409184-F
MCTTSQRTAAPLAARSSSSSPSHGYISLCTADQILCRAHHPHGENNSAVCRRLALTLLAATAALDSKASPDDPLHGEAAHASGKRIHPDFTHTVERIQAQAQQMQASLE

SEQ ID NO: 32208 - DNA, 644 bp, Zea mays
  misc_feature: Ceres CLONE 1409189-F
  misc_feature: Encodes the peptide sequence at SEQ ID NO. 32209
aagctggagctccccgcggtggcggccgctctagaactagtggatcccccgggctgcaggaattcgcacgagaccattacctagaacatcctaatcgaaaaacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcctgcgtccgagcgagcgggtcgaggtacggcggaaccgctacaaggtggcggttcacgcgtaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggttagtggggtttattcggatgataataaccttcagcttgaggccaccacacagttccgcaaattgctctctatagagaggagtccccccatcgaagaagttatcaaaacaggtgtagttccaagatttgtgcagtctctcaccagagaggatttcccccagc

SEQ ID NO: 32209 - protein, 96 aa, Zea mays
  misc_feature: Ceres CLONE 1409189-F
  misc_feature (1)..(60): Pfam Name: IBB Pfam Description: Importin beta binding domain
MVEIRKSRREESLLKRRREGLQAQVPAPPSGVEKKLESLPAMVSGVYSDDNNLQLEATTQFRKLLSIERSPPIEEVIKTGVVPRFVQSLTREDFPQ

SEQ ID NO: 32210 - DNA, 593 bp, Zea mays
  misc_feature: Ceres CLONE 1409195-F
  misc_feature (496)..(496): n is a, c, t, g, unknown, or other
  misc_feature (499)..(499): n is a, c, t, g, unknown, or other
aaagctggagctccaccgcggtggcggccgctctagaactagtggggatcccccgggctgcaggaattcgcacgagaccattacctagaacatcctaatcaaaagatttcgtagtaagtcctcgaccatccctgcaaattaccgcgatggctcccaagatcctagtcatccttgtgttcctcgccgtggcctcaccggcggctctggccgccttcgatgtgatagaaagctggccgaaagcccacgtactccacgttcctgaagctcctgcaggacccaaggtcgcgggcgagcgaatcagctccggtcggcgacgctactggtcgtccccgacaaacttgccaagcctctggcgtcgctgcccgccgataaggtgcggccggcggtgggagaacacgtccttctcagttacttcgaccccatcaagctggacgagatgaagacacgcaccgccatcctccccacgctggtcttcgtcaccgacagaaaatcggcngtntcaactaacacaggggcgacgaacggcaaatgtacttcgggggtcccggggccccctgggtgggcaagctcgtgaaagtcgtcccaagggggcc

SEQ ID NO: 32211 - DNA, 765 bp, Zea mays
  misc_feature: Ceres CLONE 1409204-F
  misc_feature: Encodes the peptide sequence at SEQ ID NO. 32212
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (58)..(58): n is a, c, t, g, unknown, or other
  misc_feature (301)..(301): n is a, c, t, g, unknown, or other
  misc_feature (765)..(765): n is a, c, t, g, unknown, or other
nnnnnnnnnnnnnnnnnnnnttgggtttgtgttgcggtttgtggttgggtttctccanaccatagctggggctccccgcggtggcggccgctctacaactagtggatcccccgggctgcaggaattcgcacgagaccattacctagaacatcctaatcgaaaaaaactcacagcacaaacgttcctctcctcttccatcgtcgtcctcgctcccggccccgcctgtctagtctagtcccctcttctcgcgtgcaacccctgtactgtacgtgctaggcacaccgctagctgcagctacagnagggtaggaaatggtttctggtgcgggtcatggagggtacggcggcggcgacgacgggcaggccgtcgacttccggggcaacccggcggacaactcgaggaccggaggctggctgggcgccggtctgatcctgggcacgcagctggcgccacgcgagtgcgtgacgggccccccccatgaaccgtggtgaacgctaccccgacgggggtagcggcaccctctaccaactcccaaggtccggccacccgcgggtggaccaaccttttcctggggcaaccgcttcgcaccctgcctcggcccgtccgctcaggcgcgcgtttcgctccgtacgaacggcttgaggtatctggcccgggctaagcctccacccggatcgcccaatatctcccggcgaaacacatttacgacccacaaaacacgaggtagaaaggtaccccccaacgcgcagggaacacgccccctcn

SEQ ID NO: 32212 - protein, 59 aa, Zea mays
  misc_feature: Ceres CLONE 1409204-F
MVSGAGHGGYGGGDDGQAVDFRGNPADNSRTGGWLGAGLILGTQLAPRECVTGPPHEPW

SEQ ID NO: 32213 - DNA, 692 bp, Zea mays
  misc_feature: Ceres CLONE 1409213-F
  misc_feature: Encodes the peptide sequence at SEQ ID NO. 32214
aagctggagctcaccgcggtggcggccgctctagaactagtggatcccccgggctgcaggaattcgcacgagaccattacctagaacatcttaatcgaaaaaacaccgccctcttgtgctctccctgtccctgccctcccccgctataataccgccacgccctcgtcgccatcgtcaccacaccaccactccctccctgccctctcactcccgatccctcctccaccaccgcttcctccgcgtcacccctctcgtcgtcgcctcacgaggcgaccagcggcggaccctccgcggcgcaaccatggggctcttcaccgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagagttggtgcagatggatcaaaggctactggtgccttcatcttgacagcgagccataacccaggtggtccta

SEQ ID NO: 32214 - protein, 130 aa, Zea mays
  misc_feature: Ceres CLONE 1409213-F
  misc_feature (16)..(130): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKKATTPFDGQKPGTSGLRKKVTVFQQPHYLQNFVQSTFNALPVDQVRGATIVVSGDGRYFSKDAVQIITKMAAANGVRRVWVGQNSLMSTPAVSAVIRERVGADGSKATGAFILTASHNPGGP

SEQ ID NO: 32215 - DNA, 766 bp, Zea mays
  misc_feature: Ceres CLONE 1409219-F
  misc_feature (35)..(35): n is a, c, t, g, unknown, or other
gggggggggcgcaccgctacccccccttatgtgcngggtcgttcgggcccccacacaacactggcgctccccgcggtggcggccgctctagaactagtggatcccccgggctgcaggaattcgcacgagaccattacctagaacatcctaatcgaaaactctctgactcgctaggggccttgattttagccgtcgccgctgctcatctcacctccctcgagaagacgcctgctcctcggcgatcgatacgatggctgtcttctccgacctctattccgccgctggcctcgagtcccgctaggctcacctccgcggctaaaccgatgtgctccggtgactcccttactacggcggacattaaggcctgcgtcgcggtgtcgtggaaccctgccgctgaggttcctaatgtcggcttgctggagcgaggccgtatctggggctgcagccaccagattccctgcctaaggctgctgcgtgaccatggccctgtcgggctcaacctcctgggggaggtgctcctgcgggatgaggctggaggaccaagggggacccttggcccactttagctggggcaaattggaccgcagggcaagaaaggggggcctgaatggaaggggggcctacaagctggccgggggtcgtcttttctggggtgggaaacgagggggcgttaaaaattttctcccccccctttaatgggttccgtctgcgcccctgggcgaaagggggctataaaatggttcttctacaagaaaagtttgggggg

SEQ ID NO: 32216 - DNA, 667 bp, Zea mays
  misc_feature: Ceres CLONE 1409220-F
  misc_feature: Encodes the peptide sequence at SEQ ID NO. 32217
tggagctccccgcggtggcggccgctctagaactagtggatcccccgggctgcaggaattcgcacgagaccattacctagaacatcctaatcgaaaaacactcgtccactcaccccctctttgctctgcctcgccgcgccgcagagcagagcatggcgcccccacgccctctcctcgccgccgtcttcctcgccgcggcggttctgctcctcctttctccggcagaggcggggacggtgggcgtgaactacggccgcgtggcgaacaacctgcccaacccagcggcggttgtgcagctgctcaagcagcagggcgtcgcgcaggtgaagctgtacgacgccgaccccaccgtgctgcgcgccctcgcgaacaccggcatcaaggtggtggtggcgctgtccaacgagcaggtcgcggcggaggcgtcgcgcgcgtcctacgcgctgctgtgggtgcgccggaaacgtggcgccgtaccaacccggccacgaagatccagggaaatcggccgtgggcaacgaggaagtccgcgacggcccaaaaacgtggacggtggaacttggtcccaggcattggcccaacgtgtacggccgcgccttgggcaaggattcgggccttccaacggggggccgggaaaggggggttgttcagcccaattcgtggattt

SEQ ID NO: 32217 - protein, 171 aa, Zea mays
  misc_feature: Ceres CLONE 1409220-F
  misc_feature: SWISSPROT Homolog: EC 3.2.1.73 Licheninase
MAPPRPLLAAVFLAAAVLLLLSPAEAGTVGVNYGRVANNLPNPAAVVQLLKQQGVAQVKLYDADPTVLRALANTGIKVVVALSNEQVAAEASRASYALLWVRRKRGAVPTRPRRSREIGRGQRGSPRRPKNVDGGTWSQALAQRVRPRLGQGFGPSNGGPGKGGCSAQFVD

SEQ ID NO: 32218 - DNA, 701 bp, Zea mays
  misc_feature: Ceres CLONE 1409222-F
  misc_feature: Encodes the peptide sequence at SEQ ID NO. 32219
aagctggagctccccgcggtggcggccgctctagaactagtggatcccccgggctgcaggaattcgcacgagaccattacctagaacatcctaatcgaaaagtcttctgtcttcccttccttccctagccgcgctccccccgcgctcccgcccccgtcccccttccaccgaccctgcatgtcggtcatgaggggagggtgaggacggtgctacactctgtgagcggcaccgactccgtcggcaacgaccagtttgctccatcttcgcgatctcgactacgactacaatacactagttttggtagagagggagagactgcggtcagagagccggacgatctgtgaagcctgcgcgcgcagctcgccatcctctcagtggatgttgttctacgtgaacgacttcatcctgagcaaacgaagcttccagaaactggatttcacgctccgtctcagcgtggcctgcggccacttcatgctgcatcttccattgcatgttagcattgcattaccatgacctcaaagctgagcccctgattcaagttgagccgaacgaccgctgcaacaggatatttccactgtactactgcttctgcataaataatgagctggacaatgtagacttgcgctacgtcccatatgccttcgtggacacattccagtctttcgctcctgccaccgcagatatactgcagtgtgtagtca

SEQ ID NO: 32219 - protein, 70 aa, Zea mays
  misc_feature: Ceres CLONE 1409222-F
MLALHYHDLKAEPLIQVEPNDRCNRIFPLYYCFCINNELDNVDLRYVPYAFVDTFQSFAPATADILQCVV

SEQ ID NO: 32220 - DNA, 713 bp, Zea mays
  misc_feature: Ceres CLONE 1409222-R
  misc_feature (1)..(1): n is a, c, t, g, unknown, or other
ncgattgggtaccgggccccccctcgaggtcgacggtatcgataagcttttttttttttttttttgagagtcggccgccggtggcctgggagtcctgtgcccacgccggcgagttgccgggagtgaagccccagcatccaagcccaatcctcctggcgtgcgcttaattcaatttcacattctgatgctggcgaatagtgtcacaaatggaaggaggaaacgatgcttgtacgaagttccagtttactaccctcaccacacacgcacgcacgagtacatatataattctctcttcaacaagtgaagagaaggcctagcaccattgctaaaccttttcttgcttctcgtccacaacaaggggaatcatctccgtctgattccttgcttgcgctgttcctagactccctggggctgcagcctgccgctgcgagatcagatgcctcacgtagacatagaaagtgcaaccaaccagggtgattccacacccgattgcattcattgcacagattggattccggaagaacgaccacgacactaacactgccatcccgacattaaagttgccctgaacgatgaacgtcactgctgtttggttaatggatgacccaaaacatggagaaattaaaggcaaacccaagccccccccgacctaggatgaaagtccgccccggaaccaatggatcatggggggaaaacccagttcatttcccccc

SEQ ID NO: 32221 - DNA, 738 bp, Zea mays
  misc_feature: Ceres CLONE 1409223-F
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (367)..(367): n is a, c, t, g, unknown, or other
  misc_feature (368)..(368): n is a, c, t, g, unknown, or other
  misc_feature (370)..(370): n is a, c, t, g, unknown, or other
  misc_feature (552)..(552): n is a, c, t, g, unknown, or other
  misc_feature (553)..(553): n is a, c, t, g, unknown, or other
  misc_feature (638)..(638): n is a, c, t, g, unknown, or other
  misc_feature (701)..(701): n is a, c, t, g, unknown, or other
  misc_feature (703)..(703): n is a, c, t, g, unknown, or other
aagctggagctccccgcggtggcggccgctctataactagtggatcccccggctgcaggaattcgcacgagaccattacctagaacatcctaatcgaaaactctcattccagaggactccgcgtcgtcaggcccgcttcgcgtgcgacgccggcatatagggtttcgccggcgccggcgatggacccaccccccgtgagccccgatcgctgggggcccagtcagggctctggcgtcgggccctccggcctccgccgatatggtctcaatttctccgcctccagactcctccaggcccccatcgcgcgccatgttgagtactccggcgtagtccagtccgggccctggcccnnnnnnnnttttggggnnanaaaaaatatgggggggggggcgcggagtagaaatatagtgaatgagatttttattttagatataaaaacgaaaaatgttccccccccccccgggtgttgtttctcccccccccccccggtggggggggacccccttcgggttgggccccggtttgtttttgtgggggggtttggtgaaaaanncccacaaaaaagggggggccttttttctctctccccccccccgttgtgggcccccccccccgttttgggggggaaaaaagggccncggagaaaggttttctttttaagaaagtccgcggggaaaatattttcgggggggggggggggntntccccttctggggggggcaacaacaaaagaaaaaa

SEQ ID NO: 32222 - DNA, 628 bp, Zea mays
  misc_feature: Ceres CLONE 1409224-F
  misc_feature: Encodes the peptide sequence at SEQ ID NO. 32223
aagctggagctccccgcggtggcggccgctctagaactagtggatcccccgggctgcaggaattcgcacgagaccattagctagaacatcctaatcgaaaagtttttctctcgagtctctcccggttcggatccaaattctaatcaaccgaagcaatccgacctgagaccaagacccgcaccacgcggctcgccgccgatggcgaacgccgacgccgacgaagcgccgctgctctctgtggaacacctccgtccaggatcctgcagccgcgagctcgagctgcgggagttccgcgaccgctacgtgatccgttcgctcgacggcgccgccgctttcgccgtccttcgctccggcggctccatccgccctctctccccagaggaagccgtagctgagagcgactgcaaggtttccagaatatacggggtggtaggcaccataagattgctcgctggaagctatgtactcgttatcacttctcagaaagatgctggctcttatctgggctcccctgtgtaccaagtgaactcaatgaaattcttatgctgcaacgaggctatcaagcacttgactccacaggaaagaagggatgaggcatacttcatgtctctcctgagattgcagaaac

SEQ ID NO: 32223 - protein, 143 aa, Zea mays
  misc_feature: Ceres CLONE 1409224-F
MANADADEAPLLSVEHLRPGSCSRELELREFRDRYVIRSLDGAAAFAVLRSGGSIRPLSPEEAVAESDCKVSRIYGVVGTIRLLAGSYVLVITSQKDAGSYLGSPVYQVNSMKFLCCNEAIKHLTPQERRDEAYFMSLLRLQK

SEQ ID NO: 32224 - DNA, 712 bp, Zea mays
  misc_feature: Ceres CLONE 1409225-F
  misc_feature: Encodes the peptide sequence at SEQ ID NO. 32225
  misc_feature (611)..(611): n is a, c, t, g, unknown, or other
  misc_feature (620)..(620): n is a, c, t, g, unknown, or other
aagctggagctccccgcggtggcggccgctctagaactagtggatcccccgggctgcaggaattcgcacgagaccattacctagaacatcctaatcgaaaaatataataggttctctcgagccttcgccgccaagagcccgatacccgccgtcctccctgctcctgctgccgcgtgcccctctccggccacccgccgccggcgcagtgtccatgaactagcacctctttcttcgcccggtacccattcagttcgtccgcctccttctcttcgagtttgggtgcccatggagaccagcagtgcgcccgccgccgccaccgaggccggctggtacgtgcttggaccgaaccaggagggcgtcggaccctacgcgcttgctgagcttcgagaacatttcgcaaacggttatttcaatgagagcacaatgctctgggcagaagggaggaaggaatggatgccactctcgtccatctctgagctacactccgcagtcgcagcgaaggatcaatctgaaacagatgctccagatgttgatgatgattttgagaaatttcagaagggagttatcgaagccgagacagaagttgaaggccttgaaaggcaatgatgtgnacccagcangatgatgagggggcaagaacccccccctgaatgggaagggaaaaaatttccggggggtgtgtggggccccttttaaaaaggggggcccgctt

SEQ ID NO: 32225 - protein, 106 aa, Zea mays
  misc_feature: Ceres CLONE 1409225-F
METSSAPAAATEAGWYVLGPNQEGVGPYALAELREHFANGYFNESTMLWAEGRKEWMPLSSISELHSAVAAKDQSETDAPDVDDDFEKFQKGVIEAETEVEGLERQ

SEQ ID NO: 32226 - DNA, 670 bp, Zea mays
  misc_feature: Ceres CLONE 1409230-F
  misc_feature: Encodes the peptide sequence at SEQ ID NO. 32227
  misc_feature (627)..(627): n is a, c, t, g, unknown, or other
aagctggagctccccgcggtggcggccgctctagaactagtggatcccccgggctgcaggaattcgcacgagaccattacctagaacatcctaatcgaaaaattcgcaccaccgccgcgccgcccaaaccctagccgccgccgccgccgccgccgccatggtcgccgtcaaccgccccctcgtctccgtgaaggccctagagggcgacatggtaaccgacgcccccggcatcgccttaccgcccgtcttcggggcgccgatccgccccgacgtggtcaggttcacccacaagctgctgtcctgcaacaagcgccagccctacgcagtctcccgccgcgccggccaccagacgtcggccgagtcctggggtaccggccgcgccgtgtctcgtatcccccgcgtccccggcggcggcacccaccgcgccggccagggagcgttcggcaacatgtgccgcggcgggcgcatgttcgcgcccaccaagatctggcgcaagtggcaccgccgcgtcaacatcaacctccgccgcgtcgccgtcgcctccgggcttcgcgccaccggcgtcccggccctcgtccaggcgcgcgggcaccgcatcgagtctgtccccgagatgccccttgtcantcccgactccgcggagtccattgagaaggacttccaggcggtc

SEQ ID NO: 32227 - protein, 171 aa, Zea mays
  misc_feature: Ceres CLONE 1409230-F
  misc_feature (23)..(171): Pfam Name: Ribosomal_L4 Pfam Description: Ribosomal protein L4/L1 family
  misc_feature (157)..(157): Xaa is any aa, unknown, or other
MVAVNRPLVSVKALEGDMVTDAPGIALPPVFGAPIRPDVVRFTHKLLSCNKRQPYAVSRRAGHQTSAESWGTGRAVSRIPRVPGGGTHRAGQGAFGNMCRGGRMFAPTKIWRKWHRRVNINLRRVAVASGLRATGVPALVQARGHRIESVPEMPLVXPDSAESIEKDFQAV

SEQ ID NO: 32228 - DNA, 647 bp, Zea mays
  misc_feature: Ceres CLONE 1409242-F
  misc_feature (469)..(469): n is a, c, t, g, unknown, or other
  misc_feature (647)..(647): n is a, c, t, g, unknown, or other
aagctggagctccccgcggtggcggccgctctagaactagtggatcccccgggctgcaggaattcgcacgagaccattacctagaacatcctaatcgaaaaaataccaccttctctctttccttcacacacgcagttcacgtacacgcgatgagcacaccgcgtcgcggagggcagcaccacggcgacaagcgcaccgtgacacgagcagcctcccgaaacagcgacggacacggtgtaggagaattgagcttctggtccacggcggggcctcggttcgccgtcgccccgccgcgaccttgggcgccgccgcctgagcacgcggtcgtcttcgcgcagtcaccagacgatccgtcgacgctgaccatgctgtggggaccgcccggcgaggtgcccgttgccgtcttccctgcggcaccggaagggcgacccgatgcgttcgctggtagcgcgccgtgcctgccgcttgnaaggcaactcgcgggccactaggggtggcgcaactgtccaaattccaggtgcccccgctgtcactccacgcagcgctagcgcttccggccgcgcccacacgcggcgaaacgaaatccctaagcccctgaccttcatgaacctccattcgttggacagaacttcccccgactacccgtn

SEQ ID NO: 32229 - DNA, 689 bp, Zea mays
  misc_feature: Ceres CLONE 1409243-F
  misc_feature (582)..(582): n is a, c, t, g, unknown, or other
  misc_feature (583)..(583): n is a, c, t, g, unknown, or other
  misc_feature (605)..(605): n is a, c, t, g, unknown, or other
aaagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggnncttgtagctgtccagcgccggncccacctcgggcgtccgcggctcctagccgggccgccctgagccgccgccgcgccgcaccgtcgaagcttccgctggcagcagc

SEQ ID NO: 32230 - DNA, 657 bp, Zea mays
  misc_feature: Ceres CLONE 1409244-F
aaagctggagctccccgcggtggcggccgctctagaactagtggatcccccgggctgcaggaattcgcacgagaccattacctagaacatcctaatcgaaaaagggaggggaatcttcgtagagcactaggcagcgacggagtcagcgcagcttcgtctccttccttccttcccctttcgctggccgctggccgtcggcaccatcacctacggccacgggcgcagcgcggcgccgctccgtaccgggtccgcgggcctctcgccagggggacccgataagcctccgctgctctgctcggctgctcttaccgtctctcccgtccacggtccacttagctagaaacacacaacaaacaaggagaaatcgcaaggaggagcagcgcctgccgccgcgccgtatccagcgaggcagcccccccgccccgatctgccggcccgacacgctgggatcttcctttccttagccgaccggtcaacgccgcagatattctccttccctgcggctctggaggtttccgtaaacccgtcaccccccctccttctattccttgcaggtatcgacgatcagacggagcagttgcttcaatctcgacttcgacctccatctgcgttgaaccattttggggattttgggagaggggggggtggcttgcttgg

SEQ ID NO: 32231 - DNA, 770 bp, Zea mays
  misc_feature: Ceres CLONE 1409252-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (89)..(89): n is a, c, t, g, unknown, or other
  misc_feature (90)..(90): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (364)..(364): n is a, c, t, g, unknown, or other
nnnnnnnnnnnnnnnnnnnnnnnnnnnnnnnnnnnnnnnnnnnnnnnnnnnnnnnggggggggtttttttttttgtttnnnnnnnntgnnggnnnnnnnnnnnnctnnnnnnnnnnnnnnnnccaagctggggctccccgcggtggcggccgctctagcactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgagagggagcagcgctgctgtcgacgnagatcgtgaaccgcggcgttggagccgtcggccccggacgccgggtcgccggcccttctcggggcgcgggcggcgccgccttgcgggacttcctggagctgggggaacctccaggacggggggccttgggtaaccactaacctcttaaaccagggggggggaacctggggcccccttcccccgtccttgggtgtggggggggggggcccccaaattggggaaaccctcccccccccaaaaaaatttgggggaaaaggggggggggggggaggacccacaaaaacccgcccccggggggggcggttttcttccggggggggggggcttctcacaaattcggggaaaaaaaggggtccccccccccggggccggtgaacccccaaaaaattttgggggggggaaaggc

SEQ ID NO: 32232 - DNA, 662 bp, Zea mays
  misc_feature: Ceres CLONE 1409253-F
  misc_feature: SWISSPROT Homolog: EC 4.4.1.8 Cystathionine beta-lyase
  misc_feature (581)..(581): n is a, c, t, g, unknown, or other
ggagctccccgcggtggcggccgctctagaactagtggatcccccgggctgcaggaattcgcacgagaccattacctagaacatcctaatcgaaaagactcccgtgctctctctctctctctctctcggatccgaattgccagcgcaccagtcgagctcgcgggaactcgccggcaccggcgatggtctccgccctactggtcggacagggcggggcgcgccaccacggatgatgggagaggcgcgccccactcgcggccatacctccgaatcctaatcccagccagccccacccgcgcgccgacgagtactggagcaatgcaggtgtggtagactcctcgaagaggaccgtgaaaatgacgtatctctgagattgtctgaatgtcagtaatttgctgacgatgcttcacgggattttggagccaatccagtctaggggaggcctcaattgcagacaccacatcactaattttcgttgcacctactccgcgtacaactattgcatatcttggaacaagttgcgagagtatacgatcagaaccaccatatatgtcctgaccagcgactatctcttgtccagnctgaatgaggtgtgttactgcagctaatgccgccatcccgttgaggaagcatagtgcttgatctgctttctcaaggttatc

SEQ ID NO: 32233 - DNA, 679 bp, Zea mays
  misc_feature: Ceres CLONE 1409256-F
  misc_feature: Encodes the peptide sequence at SEQ ID NO. 32234
  misc_feature (29)..(29): n is a, c, t, g, unknown, or other
  misc_feature (396)..(396): n is a, c, t, g, unknown, or other
  misc_feature (397)..(397): n is a, c, t, g, unknown, or other
  misc_feature (493)..(493): n is a, c, t, g, unknown, or other
  misc_feature (515)..(515): n is a, c, t, g, unknown, or other
tccccgcggtggcggccgctctagaacangtggatcccccgggctgcaggaattcgcacgagaccattacctagaacatcctaatcgaaaaagtttctatcttgctccccaaaccagcgcaaaccctgccctgacaccggcagcgacacgtccaccggcggcgccatggtgctcgaggcaacgatgatctgcatagacaattcggaatggatgcggaacggcgactacgctccgtcgcggttccaggcgcaggccgatgccgtcaacctcatctgcagcgccaagacccagtcaaacccggagaacacggtaggcgtgatgacaatggccgggaagggtgttcgcgtgcttgtcactcccaccagcgacctcgggaagattctcgcctgtatgcanngggttagaagttggcgctgaggcaaacttggctgcggcaatccaggttgcccagcttgctctaaagcatcgccagaacaagaggcagcagcagagnattatagtttttcattggaagntcctgtgaagaccgacaaagaaagttttggagaccatttgggaagaagctgaaaaagaacaatgttgctctttgacattgtttgacctttggtgaatccgatgatgaaaaacctgagaaatggaaagcatgggattgctgctgttaacagcaagtgatagcaag

SEQ ID NO: 32234 - protein, 83 aa, Zea mays
  misc_feature: Ceres CLONE 1409256-F
  misc_feature (77)..(77): Xaa is any aa, unknown, or other
  misc_feature (78)..(78): Xaa is any aa, unknown, or other
MVLEATMICIDNSEWMRNGDYAPSRFQAQADAVNLICSAKTQSNPENTVGVMTMAGKGVRVLVTPTSDLGKILACMXXVRSWR

SEQ ID NO: 32235 - DNA, 713 bp, Zea mays
  misc_feature: Ceres CLONE 1409265-F
  misc_feature: Encodes the peptide sequence at SEQ ID NO. 32236
cgctctcaactagtggatcccccgggctgcaggaattcgcacgagaccattacctagaacatcctaatcaaaaaaaagtcggttctttctcgctttgtttctcgcgttctggccggttctacctgagataggttcgtctctctcgtggcaacgactgaccgccgccctcgcccccgaccccgggtaggttcccatgtcttcgccggtcccttcgccgtcaaagagcatccactacgttatatctgccagcatgacatctccatcatgcgactggtgctaattatgtgatcttcatgggctgactcatctgcgaacgccgaggaatcggcgcccgcgactgctgctgttaacgtttctgttgcaactcatagcatctcgcgtcctacactcagttcctacgtgcctcctcatctccgtggccgctcagctgtagctgctgttggagctcatgcaggctcagtagcaccagcacaaggtggaccactgccattggttgctgcacaaccttctgttcagggcgctgttgttgtcgctcctcgctgaactggcattgagaatggcggcggtgccgatagcattggtgctcctctccagtgttatagcgatgctgccgcgagcgcaggccgcgcagcttggaactcacgtcctggtggatgcgaccgcagatagcggtagtcagactcgtatgccaaagtcgacgctgaagaacatga

SEQ ID NO: 32236 - protein, 52 aa, Zea mays
  misc_feature: Ceres CLONE 1409265-F
MAAVPIALVLLSSVIAMLPRAQAAQLGTHVLVDATADSGSQTRMPKSTLKNM

SEQ ID NO: 32237 - DNA, 650 bp, Zea mays
  misc_feature: Ceres CLONE 1409271-F
  misc_feature: Translation starting site: 323
  misc_feature (347)..(347): n is a, c, t, g, unknown, or other
  misc_feature (530)..(530): n is a, c, t, g, unknown, or other
  misc_feature (531)..(531): n is a, c, t, g, unknown, or other
  misc_feature (599)..(599): n is a, c, t, g, unknown, or other
gctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggccgggacagctgactagctgagaggcatggggatggacgccggcggcggcnagctgccgtacagctacgccggccagcaggacggcgggaagctggtgaagagcgtcagccgcgtggagccgcgcaggttcggcctgggccctcgtggcgggcttcctcgtcgtcacctgcgcctacttctccaccgccaagttcgacgccatccagatcgccatgaccagccgacccttccgnnaatgcggcttgggccgtcggagtcggtcgcctttgggaagtgggcgcccgccgccgccgacacctccnacgcctcccggcaggggaattagattttgggcgcgagggtccatgggccga

SEQ ID NO: 32238 - DNA, 743 bp, Zea mays
  misc_feature: Ceres CLONE 1409275-F
  misc_feature (686)..(686): n is a, c, t, g, unknown, or other
aagctggagctccccgcggtggcggccgctctagaactagtggatcccccgggctgcaggaattcgcacgagaccattacctagaacatcctaatcgaaaaaaataaaaaaaatcggacgacctacgcacacgctcagacaggtttacgcgctgacaagctgcccttccgcgaactacacgttcgacgaaatgccgccgcgagacctcttcatcgtcaactgagattcgcctcgcatcttctcggattccttccccaactttcgtccccatcagcggacctactcgagatcgacgagacacgtcggagcccgcttcctaggcgtcccagcgcccgactggatctcctggctcggctcgccttgatggtccctgaggtggggccggagtgctagctcgaggcgatgagaaagcttgagtcgaatctccggtgctcggagaggacagctccatcacgttgaggaggtgtgtgtcacttgagatgcataggattctaccggtatctcgcagcgcggcgcggggatgcatcgacgtgtcttcccttgccgcgccatcatcgccatgatccccagcgtgcagtagacgatcagcgcgactatcgcgatcgtgcggctgtggaggaagccatcgggaggggcgcgtgggacacgctcttcgagctcttcagagccgtctattgtggggaggntagtatgcgtagtccggagagaaactgcgtctctgctggagatgctactaaatgcag

SEQ ID NO: 32239 - DNA, 753 bp, Zea mays
  misc_feature: Ceres CLONE 1409278-F
  misc_feature: Encodes the peptide sequence at SEQ ID NO. 32240
  misc_feature (717)..(717): n is a, c, t, g, unknown, or other
ggagctccccgcggtggcggccgctctagaactagtggatcccccgggctgcaggaattcgcacgagaccattacctagaacatcctaatcgaaaaatagctggggcactgctcgctcgctcgctacgcggacctgtggcgtacgcgtaccactccgagacagcaggagcgtgctagagcaccccggcgaggatggcgcggatcccgtgctgcgagaaggacagcgtcaagcgcgggcagagaacgccctagtactcaacaagctgctctcctacatcgccctgtacgggacgcgcaactggcgcctcatcccctacaatgccggactgcagtgatgcgggatcagctgccggctccggtggaccaactacctgcgtcccgacctcaagcacggggagttcacggacaccgaggagcagaccatcatcaagctgcactccgtcaatggcaacaggtggtcggcgatcgcatcgcacctgccgggtcggacggacaacgacgtctagaaccactggaacaccaagctgaacaataagctgtccgggatgggcatcgaccccatcacgcacaagtgcttctcgcacctcatgagcgagatcgccaccacgctggcgccgccgatgttggcccacctcgacgagaccgcgctgggtgatcaaggaaaacaaaaatggctccacctcctcaccaagaagcgccccaccgacttcccgtcgnccgcggtgcccgacatgtccggcgatcgcgaggcgg

SEQ ID NO: 32240 - protein, 69 aa, Zea mays
  misc_feature: Ceres CLONE 1409278-F
  misc_feature (58)..(58): Xaa is any aa, unknown, or other
MGIDPITHKCFSHLMSEIATTLAPPMLAHLDETALGDQGKQKWLHLLTKKRPTDFPSXAVPDMSGDREA

SEQ ID NO: 32241 - DNA, 675 bp, Zea mays
  misc_feature: Ceres CLONE 1409280-F
  misc_feature: Encodes the peptide sequence at SEQ ID NO. 32242
  misc_feature (308)..(308): n is a, c, t, g, unknown, or other
  misc_feature (485)..(485): n is a, c, t, g, unknown, or other
  misc_feature (558)..(558): n is a, c, t, g, unknown, or other
  misc_feature (559)..(559): n is a, c, t, g, unknown, or other
  misc_feature (666)..(666): n is a, c, t, g, unknown, or other
  misc_feature (667)..(667): n is a, c, t, g, unknown, or other
  misc_feature (675)..(675): n is a, c, t, g, unknown, or other
aaagctggagctccccgcggtggcggccgctctagaactagtggatcccccgggctgcaggaattcgcacgagaccattacctagaacatcctaatcaaaagtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacaagctccgccaggttgctgtgtgaagtccaaggttgtcacatggattcagcacaagatttccaacccaggancattctctataaagttgtggccaccaagtgaaagcacacggatcatgcttgttgacaggatgacaaacaatctgtccacagagtccattttctctcgcaaatatcgccttttgggaaagcaagaggctcatgagaatgcaaaaacgattgaagaactttgctttgccttggctgatnagcatttcagagaggagcagatgggggatgggaagttctgctgtccagctatatgcaaaggaacgagcaaatnnatttgttggaagttctgaaaaaaggcccaaggactactgcagaactggaggcacctgtagctgacacaacctcttgtgtctgctgatactgtactagatatatctgnntggcaagn

SEQ ID NO: 32242 - protein, 74 aa, Zea mays
  misc_feature: Ceres CLONE 1409280-F
  misc_feature (45)..(45): Xaa is any aa, unknown, or other
  misc_feature (69)..(69): Xaa is any aa, unknown, or other
MLVDRMTNNLSTESIFSRKYRLLGKQEAHENAKTIEELCFALADXHFREEQMGDGKFCCPAICKGTSKXICWKF

SEQ ID NO: 32243 - DNA, 734 bp, Zea mays
  misc_feature: Ceres CLONE 1409281-F
  misc_feature (262)..(262): n is a, c, t, g, unknown, or other
tccccgcggtggcggccgctctagaactagtggatcccccgggctgcaggaattcgcacgagaccattacctagaacatcctaatcgaaaattacctttcttcttcggtttggcatctccacccttcctaacttcctcgcctgaggttgccaccccctggcaactcgaccgctcccggttcctcccccctcgggcgccctgatctggtcgcggcggagtcgccagatctggttcacggtcgcgagtccagccggtgggcagncgtacggagggctgcgggatgaatgcctagctgatgagccgctaggagccgcggcgtgacatcaacggtgtcatcatcggcgccatgctgctatccctctgcggcctcagcatcgtaaaggccagatactgcgccaccgcccctcagctaggtcaaggaccagctccaagagcagatgaacttcagcatccgtatggagccggaagagccttccacggtcaaaacgcccttttaggaggaagaaggaggaccacgtacaaaatggggggaacgccaaccacaaccacggagtctggagaaaaaaaaacgccggagagcctcttcggccggggaaaaacgggggaaagggaaacccatcctcccaaatgaaaaaaaaaccctccaaaaaggaagaaaaattttcggaaaaaacccgggggaaggaaaccccttccccatttttggaccggggatataattgttttggtgaaaa

SEQ ID NO: 32244 - DNA, 667 bp, Zea mays
  misc_feature: Ceres CLONE 1409286-F
acagctggagctccccgcggtggcggccgctctagaactagtggatcccccgggctgcaggaattcgcacgagaccattacctagaacatcctaatcgaaaaccggaatggtatcgtgcgacctgtagtcgtcgccagccacctcgctccctcctagacgacacccagctagtgctcccttccacacccaggaacgagccacctaaccccgtccgccatgtcggtcctcgccggctcccaaaactcgccaccggcgccggcttcatctccgccgccgcgtctcctcgctccgatcgacccccgaaacgccggaaaccgcgggcttcgcgaggtgcaatttcttgggccgcgtccgaccttgattcagtttctgtaagcggcctgagcttgggatttgatccaaattgcctctcttcgtccaagcgttatataacataacagtgccacaggcgaattgaagagagaaggggggcacttgatcgctgtatgatggcgcaaggacccaatttcgctggcatgattgacggccctgacaatgctggggaaatctgcgacatggcatactaccggaaagctcgcctgactttcaaacatgcccgaacccagccttactaccctgccgaccagcacagctggcgactccattgcaaagcccgcgaaacccagg

SEQ ID NO: 32245 - DNA, 674 bp, Zea mays
  misc_feature: Ceres CLONE 1409289-F
  misc_feature: Encodes the peptide sequence at SEQ ID NO. 32246
tccccgcggtggcggccgctctagaactagtggatcccccgggctgcaggaattcgcacgagaccattacctagaacatcctaatcgaaaagtcggcgttgtttcgtctccaccgccgctctcctttccagtctccaccaccgctcgtctccccgtaccgcccgcaacccccctcccctgcgagatccggggcgcgatgtggcgcagctgcgtctcgcggggcctctccagggccaaggcctccgcctccaggctcctctccacggcgtcgtcgtcctacacggtggtcgaccacacctacgacgcagtggtggtgggggccggcggcgcggggctccgggcggcgatcggcctctccgagcacggcttcaacaccgcgtgcatcaccaagctcttccccacgcgctcgcacaccgtcgcgggctcagggaggcataaatgctgcacttggaaacatgagtgaagaatgactggaggtggcatatgtatgacactgttaagggaagcgatttggctgggtgaccaggattctattcagtatatgtgcagagaggcaccaaaagctgttatagagcttgagaactatggactaccattttcaagaactggaagagggaaagatataccaacgtgggcttttggagggaagaagcttaattttttggcaaaggtga

SEQ ID NO: 32246 - protein, 88 aa, Zea mays
  misc_feature: Ceres CLONE 1409289-F
  misc_feature: SWISSPROT Homolog: EC 1.3.5.1 Succinate dehydrogenase (ubiquinone)
MWRSCVSRGLSRAKASASRLLSTASSSYTVVDHTYDAVVVGAGGAGLRAAIGLSEHGFNTACITKLFPTRSHTVAGSGRHKCCTWKHE

SEQ ID NO: 32247 - DNA, 716 bp, Zea mays
  misc_feature: Ceres CLONE 1409291-F
  misc_feature: Encodes the peptide sequence at SEQ ID NO. 32248
  misc_feature (650)..(650): n is a, c, t, g, unknown, or other
gctctagaactagtggatcccccgggctgcaggaattcgcacgagaccattacctagaacatcctaatcgaaaacgggatcgctctctctttgggctaccggctccgccgccgctccgccgccctaagccaggtgctgaaggccttcgtcggtcttttcaccggcgacgaccacccactaggaaaagaattttcctggcatatttttgtttccagaaatattcgtgtcaagttggtatgtcagggatcacagcaatttggcgtcggtcatgtccattagctgctagtcagattctaatggagacatattttggcccatctgtatcttctggtgttctgaggtggttcagcagcggcactaagcactcaagaaaacctgaattttctgttgctaaccatatcagggcggtggatttgcattctgcttctgcagttaattatgtgtcaacgatcagaaggttgcccctttcatgccgtatggacactaattgtttgattacttcaaagtccagacatggtgcattgccaggattcttaggtagatcaagcttctatcgtggatactcttcagatactgggaatcagccagaagcttcgcagagtggtgtctctaatcttccttctacagaaagctctgtagttggcactgcnagtgctggtggtggttcatggattgaaatctggacatgtcgcagtctactatgatgcacactgagc

SEQ ID NO: 32248 - protein, 155 aa, Zea mays
  misc_feature: Ceres CLONE 1409291-F
MSGITAIWRRSCPLAASQILMETYFGPSVSSGVLRWFSSGTKHSRKPEFSVANHIRAVDLHSASAVNYVSTIRRLPLSCRMDTNCLITSKSRHGALPGFLGRSSFYRGYSSDTGNQPEASQSGVSNLPSTESSVVGTASAGGGSWIEIWTCRSLL

SEQ ID NO: 32249 - DNA, 690 bp, Zea mays
  misc_feature: Ceres CLONE 1409295-F
  misc_feature: Encodes the peptide sequence at SEQ ID NO. 32250
  misc_feature (144)..(144): n is a, c, t, g, unknown, or other
  misc_feature (545)..(545): n is a, c, t, g, unknown, or other
  misc_feature (594)..(594): n is a, c, t, g, unknown, or other
  misc_feature (619)..(619): n is a, c, t, g, unknown, or other
aaagctggagctccccgcggtggcggccgctctagaactagtggatcccccgggctgcaggaattcgcacgagaccattacctagaacatcctaatcgaaaaacaccaacaaaccaaacaccatccgccacgaccacgactccncgagagagcggaggaggagggggagcaatggcagagccgggccagcagttgctgcggtcgttcgtggaggtggcagcgggctcgcacttccctatccagaacctgcccttcggggtcttccgccggcgggggtcgccaccgcaggctccgctccccccggtggccatcggggacttcgcgctcgacctcgccaccgtcgccgacgcgggtctcttcgacgggcccgcgctctccggctccccgtgcttccaccaggagacgctcaacatgtttcttggggatgggccgaccggcgtggagggaggcgcgcgccacgctacaaaaaatcctctcagccgacgagccagtcttgcgtgacaacgaagccctggaggaataaatgtcttattccaatgagtgantatcgagatggttctaccaatcaccggttggaggttacacaggatttcnttttgttctgtgcaccatgcaaggnaactgcggattcaatcttccgagggccgcagactccagttaatcccaaattggttttatcttccaatagga

SEQ ID NO: 32250 - protein, 109 aa, Zea mays
  misc_feature: Ceres CLONE 1409295-F
  misc_feature (11)..(107): Pfam Name: DUF1969 Pfam Description: Domain of unknown function (DUF1969)
  misc_feature: SWISSPROT Homolog: EC 3.7.1.2 Fumarylacetoacetase
MAEPGQQLLRSFVEVAAGSHFPIQNLPFGVFRRRGSPPQAPLPPVAIGDFALDLATVADAGLFDGPALSGSPCFHQETLNMFLGDGPTGVEGGARHATKNPLSRRASLA

SEQ ID NO: 32251 - DNA, 704 bp, Zea mays
  misc_feature: Ceres CLONE 1409299-F
  misc_feature: Translation starting site: 211
  misc_feature (457)..(457): n is a, c, t, g, unknown, or other
  misc_feature (680)..(680): n is a, c, t, g, unknown, or other
agagctggagctcaccgcggtggcggccgctcttcaatagtggatcccccgggctgcaggaattcgcacgagaccattacctagaacatcctaatcgaaaaaaaatcacaaagccagcccatcacctcagtcctcacactgacatttcactctcggctgctggagtgtcggccgctgccatctgcctgccgctcactcccacgcgccgcaatgtgccactccccactcggcgccgccaccaccaccgcgggggcgctagcgctcctcttcctcctgccgctagcctcggccgccgccgccggcggcggcaccgcggcgaaggcgacgcccaacatcacggcgctcatgtccaagggcgggtgcaaggcgttcgcgtcgctgctggacaagtcccccgacgctctgtcggcgttcaagttcgcggtgagcggcgccgtgacggcgttctgcctgacgnaacgaggccgtgcgcgggttcatgcccagctacggaaacctgagcgcgaacggaagggggcccttgttgttgttccacggggggcccgggaactaccgctggggggcctgaaaacaaaaaagggccccaagaaacacttgcacaccaagggggcccccacgaaaaaaaaactggaggggggaaaaaacggggcaaaaaaagtgaattttggaaccccccgggncaaaaccccccccccccgtggttt

SEQ ID NO: 32252 - DNA, 666 bp, Zea mays
  misc_feature: Ceres CLONE 1409304-F
  misc_feature (259)..(259): n is a, c, t, g, unknown, or other
ccccgcggtggcggccgctctagaactagtggatcccccgggctgcaggaattcgcacgagaccattacctagaacatcctaatcaaaaatcttcgccgccgctaaacgttccccccacgcccccacctatccacgcgaaacctttcttcccccggggagacgattcgtcagggaagagaaaagagcaagaggggccatgaacgctggccaggttggggaccccggtcgctggggctccaaattctgggggacccggcnggggggttccaaaggggaaatgaccgaattccgccgttaggggccccccccctgaaaacccccggaacgggggaacccgggtttttttcccccaaattgggggggaagggaaaaaataaagggggggggtttcccccccactttttggggggaggggccgcccctggggaaaccaagaaaaaaaccggcgctcccccgcaatattaaaaaaaatttggggggcgggccaaagggaaaaaagaaaaaaaaatgggttggggttcaaaaaaacaaacatttttgggggcacgcccttgtgtttcccaaaaaaaagggggggggggaaaaaaaaaaagggcgccccctcttgggtgggggccccacacacaaaaagggggggggggggggggggcccccccctccccctg

SEQ ID NO: 32253 - DNA, 790 bp, Zea mays
  misc_feature: Ceres CLONE 1409311-F
  misc_feature: Encodes the peptide sequence at SEQ ID NO. 32254
  misc_feature (14)..(14): n is a, c, t, g, unknown, or other
  misc_feature (35)..(35): n is a, c, t, g, unknown, or other
  misc_feature (38)..(38): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (47)..(47): n is a, c, t, g, unknown, or other
  misc_feature (476)..(476): n is a, c, t, g, unknown, or other
ggccccccccggcncccaaacaccccccccccctnttntggnnnntnttaaaactggagctcaccgcggtggtgggcgctctattaactagtggatcccccgggctgcaggaattcgcacgagaccattacctagaacatcctaatcgaaaaatgtgagtaatcggtgaccgctcttgagttgttagctccccggtcccacggtagctagagctagctagggggatggtaacaccaccggggggtcgcccaagcattctcatcggcatcatcgtgcgggggggaccaatcatcgtcggccgctggcgctgcggtgggggatggtgcatgcgtgcgagtgcttcctggtggatctcgagagcgggctggccccttgcgactggacggacggaggttcgagcgcgatcaggcacgccaacggcgggtgtcacggcgcaggggttccgggcgctgttcgttttgtgggcggcacccccnacgcccgcacgcactgccccggctggtggcgcttgcgcccctaccagcaccagccggtggagcctagcgcgaacgccaagttagaagaggccgcgggggggcgggggaggagggcggacacccaccacctccctcttcgcggcatccctcccacccccaaacacgcggtccccgccgtgttagtttttttcttcggtgatcacccgccgtgagaccggcgggggccatcaacacgtttggggggcccaccggacaagcccacgtgggcctcggcgggagtgccccgcgcgggaaccaagccaggggggggccca

SEQ ID NO: 32254 - protein, 122 aa, Zea mays
  misc_feature: Ceres CLONE 1409311-F
  misc_feature (53)..(53): Xaa is any aa, unknown, or other
MVHACECFLVDLESGLAPCDWTDGGSSAIRHANGGCHGAGVPGAVRFVGGTPXARTHCPGWWRLRPYQHQPVEPSANAKLEEAAGGRGRRADTHHLPLRGIPPTPKHAVPAVLVFFFGDHPP

SEQ ID NO: 32255 - DNA, 908 bp, Zea mays
  misc_feature: Ceres CLONE 1409311-R
  misc_feature (429)..(429): n is a, c, t, g, unknown, or other
ggggcttggcgcatttcgtttgcgatgttcgccttttgtttcttctggcgagcccactattggggtacgggccccccctcgaggtcgagggcatcgatagcttctcgtgccgttttttttttttttttttgaatcatgcatatgcctgatcgatgcatgcttatatagcatagttacatagtttcatactcctcgtggaagtacctcgtgtgtggatggttcggggtatcgtcttccttgggccggcacatgggaaagcttgcctcgctcggatcgacctttttcccctctgatagccggtccaccccggctccgggggctaggtggggaagctttttaggttggggtccagtgggtgtccagagagatttttcgggggtgctgtttttggcggggggcggcggggcccaggaggggaaaagaacaaanaaacaaaaaaaaaaaaaatgtattccataaatcccttgtttttggctgagggtgagagtgaaaaaaaacaccccccacgcgagtaaaccccattcacaacagaaatccaattgggcggccgccctggacggaacgccagttatcttactctctcctaatacctcgctcaccttcctcgctgcgctctactcccagcacgtgcgtcgtctctgccagcaaataatggggctgatgttcgcgtacgcctagtctgtcctgaggatagatgggtggatagtatgggatcttcggacgctctcggtgacctcagtgcgtcctatgattgttactactactgtctgtgtgatgtcatcttgttcggaaggtaatgggagaggtgtagttgcgcgactctcggtattagggatgcgagctgtgtcggattgtgtcgcctgcgggttggctggaggcacgagtcttgcactgcgcgaccggtgcgg

SEQ ID NO: 32256 - DNA, 688 bp, Zea mays
  misc_feature: Ceres CLONE 1409316-F
  misc_feature (11)..(11): n is a, c, t, g, unknown, or other
  misc_feature (29)..(29): n is a, c, t, g, unknown, or other
  misc_feature (45)..(45): n is a, c, t, g, unknown, or other
  misc_feature (48)..(48): n is a, c, t, g, unknown, or other
  misc_feature (53)..(53): n is a, c, t, g, unknown, or other
  misc_feature (55)..(55): n is a, c, t, g, unknown, or other
  misc_feature (56)..(56): n is a, c, t, g, unknown, or other
  misc_feature (79)..(79): n is a, c, t, g, unknown, or other
  misc_feature (81)..(81): n is a, c, t, g, unknown, or other
  misc_feature (353)..(353): n is a, c, t, g, unknown, or other
  misc_feature (555)..(555): n is a, c, t, g, unknown, or other
caaggccaacnaaaaaccaacacacaaantgaagaaaacaaacanccnacccntnnaccccgcagacacagccccgatntnttttaaaactgggtgctccacggcgggtggcggccggctctagaactagtggatcccccgggctgcaggaattcgcacgagaccattacctagaacatcctaatcgaaaaataaagattactcatagattaaagtagggtttggacgtctgcctgtccatttcggcgtctgttcttagcggccgacaagcggaatctggatcaagtcccctgcttcaacccatcccctctcatcgattcattgccaccaggcagctggattgctcacagcgntgggatggggagatttggatttcgaaccaaccggaattgaaaaattgccggttcggccaacagggggtttcgatggtcccggggtccgccccggaaaagggtcccaaactctggggtggttcccaaaaacaccggggggcgggtatttttctcccgcctcctcgccctggggggggcttgtgggggaaaaaaaagatatttncttccaagtggggtgggaaccccccggggggggggggggcccccccccctcttttttgaggaccaaaaaagagggggggggcccccccggggggggggccccccagggggggcacccctcccttcccggcggc

SEQ ID NO: 32257 - DNA, 681 bp, Zea mays
  misc_feature: Ceres CLONE 1409318-F
aagctggagctcaccgcggtggcggccgctctagatccagaggatcccccgggctgcaggaattcgcacgagaccattacctagaacatcctaatcgaaaagttcttccagcgaagcaagcagactaaaaaaaccgtatcgtctcgactgttcagtttccttctcttcccgcagaccgggttgccgaccaggttccaccgttccagagtacccaagcgaatcccgcgtctggttcgcgcgatggcgtaggagcagtccaacccccagcaccagtaagcgaaggagagggaggttatggtggagtagcagcagccgaggaggtccccgaagctgaggtacctggacttcgtccaggtggcggctgcccatgccgcggtgtgcctcgctgggctctacggcctcgccaaggaccacgccgtgccgctacgctacagagttgacgccgtcgagtctgccgtcaagggcgtcgctatgcccgtctacgacgcttctgcgagctggcgctcgatgtactcgactttctcgaccgaaaggtgaacgacacggtgcacgagttgaaaaacacctcccgggcgggctgaacgaggggtcaggccatgtttaccccttgattcagcctttccgaaagtgggctcaaattgctcccaaagcacaagtcccaccctgagggccaaacccctg

SEQ ID NO: 32258 - DNA, 692 bp, Zea mays
  misc_feature: Ceres CLONE 1409319-F
  misc_feature: Encodes the peptide sequence at SEQ ID NO. 32259
  misc_feature (530)..(530): n is a, c, t, g, unknown, or other
  misc_feature (598)..(598): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (612)..(612): n is a, c, t, g, unknown, or other
tccccgcggtggcggccgctctagaactagtggatcccccgggctgcaggaattcgcacgagaccattacctagaacatcctaatcgaaaaactactacatctgacagcgtgaaagctcggctagctccttctgacttctggtacctcgtcgccgaggacccagactccgatccccaccccaccataccatggccaccgcggttgcggatgcgttgttccgcatcatcaatggcgctgatcactctcgtccgcgactacatcgatcgaatgctccaggacatccctggcatgaaggtcctcgtcctcgaccccctcaccgttgtgatggtgagcgagatgtacagtcagacggatctgctgcggaaggaggtcttcctcgccgagaccatggacaacgcctccagatccagggagaccatggcgcagctcaaggtcgtctacttcctccgaccctccgctaacaagttgaaaagctccgtagggacgtcgacatgtcgcgccttcgacgagaccacctattcttctcggnaaataatgaaggtcccggcacattcagatacttgcttgactcgatgaacaacaggaggttggtgcagnaaannnttcagagntcctatgggttgatgtttgtgggccattagacccattacgatttcaactctcgacatacgaaaataactacagtgtatat

SEQ ID NO: 32259 - protein, 115 aa, Zea mays
  misc_feature: Ceres CLONE 1409319-F
  misc_feature (101)..(101): Xaa is any aa, unknown, or other
MALITLVRDYIDRMLQDIPGMKVLVLDPLTVVMVSEMYSQTDLLRKEVFLAETMDNASRSRETMAQLKVVYFLRPSANKLKSSVGTSTCRAFDETTYSSRXIMKVPAHSDTCLTR

SEQ ID NO: 32260 - DNA, 704 bp, Zea mays
  misc_feature: Ceres CLONE 1409319-R
ccgattgggtaccgggcccgccctcgaggtcgacggtatcgataagcttttttttttttttttttgcaatcaatttgtacacagatattctcttgcttttgcagacatacaccaacattaggcgttagaagctggagcagctacatatcttcaagaaatttgatcctatgcacctagaactatgttacagatttatcacaaattttattcgatgcaaaattgagtcaacactgtcaaatcttactaagatactctgcaaatgggagataaaaccattcagctcataggatagtgcttgatttagatatcctttgtgcctctcccaaatctccaggaaatctatttgaacttagaaccccggaacctccaacgaaaaaagggactctaggatttgccgcattataaagggctaccgaccccgcttcctcctaagttgtccctcccacaatgaatatgagaacatcttgaggcctgccctgttggaaatgattgccccccagcggatagccagcatcccccaatgtaccttttaacagttacttcccatcgtttgaaaccaaaagaagccggcggttggggtgtagaacattcatctactcgccctaaaacccccaaacccgtatttgcgagcaaattttttaacaggaatgaaagtttccccctacaaagtcccccctgtttcccctatttcctgggaccgggct

SEQ ID NO: 32261 - DNA, 608 bp, Zea mays
  misc_feature: Ceres CLONE 1409325-F
  misc_feature: Encodes the peptide sequence at SEQ ID NO. 32262
  misc_feature (138)..(138): n is a, c, t, g, unknown, or other
  misc_feature (413)..(413): n is a, c, t, g, unknown, or other
  misc_feature (424)..(424): n is a, c, t, g, unknown, or other
  misc_feature (437)..(437): n is a, c, t, g, unknown, or other
  misc_feature (467)..(467): n is a, c, t, g, unknown, or other
aagctggagctccccgcggtggcggccgctctagaactagtggatcccccgggctgcaggaattcgcacgagaccattaacctagaacatcctaatcaaaaaataaataacacacaaagttgtccgatcaaagcttgncgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacgtccgggtgcccgctggccgccacgctgtcggagcgcttccgcgtgctgctgctggagcgcggcgcctcgccctacgacgacgaccgcatcnggggacatggncccgctttcgcgnacaccgctgtccggacaccctcccccgggnttcccccccgggcaaaggttttttggggggaaagaggggttttaaatctcccccccggggggttggggggggggaaaatttttaaaaacccggtttttaaaacgggggccaaggaaaaaaaaaaagggggggggcgggggt

SEQ ID NO: 32262 - protein, 153 aa, Zea mays
  misc_feature: Ceres CLONE 1409325-F
  misc_feature: SWISSPROT Homolog: EC 4.1.2.10 Mandelonitrile lyase
  misc_feature (89)..(89): Xaa is any aa, unknown, or other
  misc_feature (97)..(97): Xaa is any aa, unknown, or other
  misc_feature (107)..(107): Xaa is any aa, unknown, or other
MSGRSRHFTMSTLLATSFFFVLLCSSLQVRGVNYTFVKDAALAPSVSYYDYIIVGGGTSGCPLAATLSERFRVLLLERGASPYDDDRIXGHGPAFAXTAVRTPSPGXPPRAKVFWGERGVLNLPPGGLGGGKIFKNPVFKTGAKEKKKGGGRG

SEQ ID NO: 32263 - DNA, 675 bp, Zea mays
  misc_feature: Ceres CLONE 1409327-F
  misc_feature: Encodes the peptide sequence at SEQ ID NO. 32264
cgctctagaactagtggatcccccgggctgcaggaattcgcacgagaccattacctagaacatcctaatcaaaatcaagctagctagttaactgtgcaattagttgagtcagtagataagctgttccgtcttagcttatctaccgatcgagctcgcggcaatggcgatgatggcatgcaataacactcgaccccgcaagctgtcgctgccatgccgcacccgtactttccaagccttaatactaagcacagcagtcttcctggctgcttccacggccgtcgtcgtcggcaaggagccacaaccaccgtcctcctccggcggcggctgtcactaccgcttcgagctcacccacgtagatgccaacctcaaccttaccagcgacgagttgatgcgtcgtgcctatgacaggagccgcctccgcgcggcgagcttgaccgcctactcggacggacgacacgaagggcgcgttagcattcctgacgcctcgtacatcatcacgttttacttgggcaaccagcggcccgaggacaacatctccgacgtcgtggacaccgtcagcgacatattttggacgaccgaataatgagtgtaccgggtccatgacaaggtcatgctgccttgcttgcacccaagtgccagcacccggccgctgtcgtggcgacaaacgagtccagc

SEQ ID NO: 32264 - protein, 140 aa, Zea mays
  misc_feature: Ceres CLONE 1409327-F
  misc_feature: SWISSPROT Homolog: EC 3.4.23.12 Nepenthesin
MAMMACNNTRPRKLSLPCRTRTFQALILSTAVFLAASTAVVVGKEPQPPSSSGGGCHYRFELTHVDANLNLTSDELMRRAYDRSRLRAASLTAYSDGRHEGRVSIPDASYIITFYLGNQRPEDNISDVVDTVSDIFWTTE

SEQ ID NO: 32265 - DNA, 738 bp, Zea mays
  misc_feature: Ceres CLONE 1409329-F
  misc_feature: Encodes the peptide sequence at SEQ ID NO. 32266
ggagctccccgcggtggcggccgctctagaactagtggatcccccgggctgcaggaattcgcacgagaccattacctagaacatcctaatcgaaaaaccccccctttgccgtcacagccatctgctcgacgcttccccacacctctctcccatggccgggactgcagccgtcacgcccaggaaactgcagagcaaggtccgcctacgagggtttgccctcaaggtggacgccctcaaggagaacgccgccttcctctaccgcttccccgacgtcgaggacgacgcgctccatctcctcctctaccagctcaacgaggaaccgctgcagtcgtcgatactggaccgcccacgcctatcacgcccgcgtggttgctgattgcccaggccaagtactggatctatgcggcaacgccagcaagcacaagaagcaagatctgcatctgcccgggaacattgcttctgtcgagtcgcaactccactacaattcaatcaggagatgattgtacgtagcacatcggcacattagctgtcctcgccagaatctgcccatatctcctgcctatataggtataggtataaggcgtctcctgcagagactgaactcgagatagatatctatctaagccggctattcaccaggagcgacgcacgctgctcgagagagatactactgttcacttcactatcgctctgctgagcatattcggataagatctgcatatctcagtgtacgagcta

SEQ ID NO: 32266 - protein, 74 aa, Zea mays
  misc_feature: Ceres CLONE 1409329-F
MAGTAAVTPRKLQSKVRLRGFALKVDALKENAAFLYRFPDVEDDALHLLLYQLNEEPLQSSILDRPRLSRPRGC

SEQ ID NO: 32267 - DNA, 680 bp, Zea mays
  misc_feature: Ceres CLONE 1409337-F
  misc_feature: Encodes the peptide sequence at SEQ ID NO. 32268
  misc_feature (501)..(501): n is a, c, t, g, unknown, or other
aaagctggagctccccgcggtggcggccgctctagaactagtggatcccccgggctgcaggaattcgcacgagaccattacctagaacatcctaatcaaaaagttccactccgcctccgctgccggtcgccgtctccgagactccgacagtccgaccgcaagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactggactgattaaggttgatcgagtcctgtactcatcagttgtataccctcacaaattatggtttcgttccaaggactctttgtgaagacatgacccaatggatgtgttagtcctgatgcaggnatcctgttgtttcctgggtccgtcctgcgagcaagagcaatcgggcctattgccatgatgggacaggggtgaaaggatgacagattaatagcagcctggggctgatgatcctgaatatcggactacaacgacctcagtggagttggctcctcatcccctgaaaaaaaacaaggggtttt

SEQ ID NO: 32268 - protein, 98 aa, Zea mays
  misc_feature: Ceres CLONE 1409337-F
  misc_feature: SWISSPROT Homolog: EC 3.6.1.1 Inorganic diphosphatase
MSEEDKTAASAEQPKRAPKLNERILSSLSRRSVAAHPWHDLEIGPDAPAVFNVVVEITKGSKVKYELDKKTGLIKVDRVLYSSVVYPHKLWFRSKDSL

SEQ ID NO: 32269 - DNA, 641 bp, Zea mays
  misc_feature: Ceres CLONE 1409342-F
tccccgcggtggcggccgctctagaactagtggatcccccgggctgcaggaattcgcacgagaccattacctagaacatcctaatcaaaaatgattacaagaaaaatagtttcaatgccagattttctttgcttgctcatttgatcgcgcagagtgctgctgatgataacattatggatttgattcagaggcacattatctttcactcacatgatcaggaggggtatgaactggcaatgcatgtgttgtatcagctgcagagtatcagtgttgctaattcaccagaaagctctacctccacctctaaacattacgagaagttctttatatcacttgcgaggtccttgattgattcactgcctgcttcagacaaatcttttagcaaacttttatgcgatgcaccatatctacctgagtctttgtttagatcactggaggatctttgcatgtcagaagacaacagccaacaattaaaggatggagatggggaccgtgttacccaaggcctgggaactgtatggagcctaatcttgggtcggcctccgcttccccatggttgcttggaaattgctctgaagggggctgcccactctcaagatgaagtcaggggaaaagcaattaaaattggttgcaaaaagggt

SEQ ID NO: 32270 - DNA, 671 bp, Zea mays
  misc_feature: Ceres CLONE 1409350-F
  misc_feature: Encodes the peptide sequence at SEQ ID NO. 32271
  misc_feature (369)..(369): n is a, c, t, g, unknown, or other
  misc_feature (413)..(413): n is a, c, t, g, unknown, or other
  misc_feature (459)..(459): n is a, c, t, g, unknown, or other
  misc_feature (570)..(570): n is a, c, t, g, unknown, or other
  misc_feature (621)..(621): n is a, c, t, g, unknown, or other
  misc_feature (642)..(642): n is a, c, t, g, unknown, or other
tccccgcggtggcggccgctctagaactagtggatcccccgggctgcaggaattcgcacgagaccattacctagaacatcctaatcgaaaaaaaaaattcgattccacgaagcagcaatcgcaagttcgaagctctaaaataatctcttcccgacgtctctggaaggtcagcatctgaacccaggtagcctccagcgctggagacgtgccgtactcaaaccctagccaccaatggcagccggcggcggggctccgtgggcggagcgcgcgcgggtggtggggacgcagatccgcaacaggttccgcgtggcgcccgtggaccaccggtcgctgtggctgcgggcggacggtcgtgtcgccactgagggnggtccggcggtggttcggaatcgcgttcgggcctgcctgcaganggggccggagcgcggatcggaactccacatcgacggagactcaccntggaggcggtggcaaagcttcggtccagcggttttgagattctacagaaagagagggggcaaagaagtttatggggattgaagactctgggttattttccgttcgctcaanggcattggctggtcctcttattggcatggattgctatgtttttatgatggncctaaacttccagttcagggnttaaggggggggaaaggaagcttccttcg

SEQ ID NO: 32271 - protein, 102 aa, Zea mays
  misc_feature: Ceres CLONE 1409350-F
  misc_feature (61)..(61): Xaa is any aa, unknown, or other
MAAGGGAPWAERARVVGTQIRNRFRVAPVDHRSLWLRADGRVATEGGPAVVRNRVRACLQXGPERGSELHIDGDSPWRRWQSFGPAVLRFYRKRGGKEVYGD

SEQ ID NO: 32272 - DNA, 677 bp, Zea mays
  misc_feature: Ceres CLONE 1409352-F
  misc_feature: Encodes the peptide sequence at SEQ ID NO. 32273
  misc_feature (474)..(474): n is a, c, t, g, unknown, or other
  misc_feature (495)..(495): n is a, c, t, g, unknown, or other
  misc_feature (536)..(536): n is a, c, t, g, unknown, or other
  misc_feature (555)..(555): n is a, c, t, g, unknown, or other
  misc_feature (558)..(558): n is a, c, t, g, unknown, or other
  misc_feature (559)..(559): n is a, c, t, g, unknown, or other
  misc_feature (569)..(569): n is a, c, t, g, unknown, or other
tccccgcggtggcggccgctctagaactagtggatcccccgggctgcaggaattcgcacgagaccattacctagaacatcctaatcaaaaagaaaaaaaaactaggtcttccactcttcctccactagtctactcggcagatttcactgactctcaccggcggtttttgtgcctccaccggccgccgccatgccgtacctcgtccgcgagcggctctacttcggcggcatcaaagacgccattgccgcactcacggagtcttcctccacgccggacttcacccacgtcctctccgtggtcagctccgcctccatctccttcatcaccgattgccgcccgggcctcgagatcccccaccgaggaggtcctccgcgtagtcgccggcgaggagggcgcggcaccgaactgccgcggttcccccggggacgctgatgcgggtggtggagcgcgccgggcacgggctgcgggtcacgncgcatggccgtgccgctgcgngaccaccggaggaggaggacctgctcgaccgcctcgagccntgccttgggttcatgaganggnncaagaagggntcggaaatgtcccgtcattgtttttttttgctgggggtgtcgaggagcgcttcccatcattgttgcttatctttatgagagcagaacagaaatctcttgaagaagctt

SEQ ID NO: 32273 - protein, 80 aa, Zea mays
  misc_feature: Ceres CLONE 1409352-F
MPYLVRERLYFGGIKDAIAALTESSSTPDFTHVLSVVSSASISFITDCRPGLEIPHRGGPPRSRRRGGRGTELPRFPRGR

SEQ ID NO: 32274 - DNA, 696 bp, Zea mays
  misc_feature: Ceres CLONE 1409354-F
  misc_feature: Encodes the peptide sequence at SEQ ID NO. 32275
  misc_feature (417)..(417): n is a, c, t, g, unknown, or other
  misc_feature (497)..(497): n is a, c, t, g, unknown, or other
  misc_feature (498)..(498): n is a, c, t, g, unknown, or other
  misc_feature (506)..(506): n is a, c, t, g, unknown, or other
aagctggagctccccgcggtggcggccgctctatcctaatggatcccccgggctgcaggaattcgcacgagaccattacctagaacatcctaatcgaaaaaaaaagaactccttctacgcccagccatctctaaaccctacccacagccaccgccgccgccgccgctccctgacccctagtgtccggatttaacttcaaacatggcggacgtcgatgtcgagccggaggtcgccgccggtgctcccaagaagaggacgttccgcaagtacagctaccgcggcgtcgacctcgatgcgctgcttgacatgtccaccgacgacctcgttcagctcttcccagcgcgcgccaggagaaggttccagaggggtttgaaagagaagcccatggcgctcatcaagaagctgcgcaaggcgaanaaggatgctcctgtcggcgagaaagcagagccagtgaagacccatctcccgcacatgatcattgtccccgagatgattgnnagcattgntggtgtctaccatggcaagaccttcaaccaaggtgaaatcaagcctgaaatgattggcacctatctgcagagttttccatttcctacaagccggtaaacccgggagggcccggtattggtgcactcactcctcggggttaacccctctaaaaggattggatcccaaaatctgaaggcccccaaggtggcc

SEQ ID NO: 32275 - protein, 133 aa, Zea mays
  misc_feature: Ceres CLONE 1409354-F
  misc_feature (55)..(132): Pfam Name: Ribosomal_S19 Pfam Description: Ribosomal protein S19
  misc_feature (72)..(72): Xaa is any aa, unknown, or other
  misc_feature (99)..(99): Xaa is any aa, unknown, or other
  misc_feature (102)..(102): Xaa is any aa, unknown, or other
MADVDVEPEVAAGAPKKRTFRKYSYRGVDLDALLDMSTDDLVQLFPARARRRFQRGLKEKPMALIKKLRKAXKDAPVGEKAEPVKTHLPHMIIVPEMIXSIXGVYHGKTFNQGEIKPEMIGTYLQSFPFPTSR

SEQ ID NO: 32276 - DNA, 722 bp, Zea mays
  misc_feature: Ceres CLONE 1409357-F
  misc_feature: Encodes the peptide sequence at SEQ ID NO. 32277
  misc_feature (587)..(587): n is a, c, t, g, unknown, or other
  misc_feature (619)..(619): n is a, c, t, g, unknown, or other
  misc_feature (635)..(635): n is a, c, t, g, unknown, or other
ggcggccgctctacaactagtggatcccccgggctgcaggaattcgcacgagaccattacctagaacatcctaatcaaaaaaaaaacaaatctgtgaaaattctctccctctctctctctctttctatctggaattctggatgcagtctgcaaggatgacacaagaacaagaacaacgccatcaatcaatcaatcaacacacacgagatctactgtatatagagcagagaagggggatactaatttgtcagcaaaactaagacaaggaagcacttattttgtgcttgcttagctgcgatcaattagcccgacgtcgtgccggcgcctcctcctcctatattattccacttcccttccttcctttgcaggagcaacaactaagagcttgtccctttccctctcgtctcctcccctcccctccgtgtccactcacatcttctctcctggagaccgcctcggacgaacacggacaagatgggcgccttcttcggtgctgcaccgccgcacggtctcgcttctttccgccatgaggaggatgatcagcaacatcaggacgccgccgatgaggtgtaccactgtggacgatngtcaatcgagttatcgatgaacggccgtgaancacggtgggcccctgnctaggggtaaagctgtgggacccggggccaactgggcgccccccccagggaaaccccaagtttaaaggggttttttagaaggggggg

SEQ ID NO: 32277 - protein, 53 aa, Zea mays
  misc_feature: Ceres CLONE 1409357-F
  misc_feature (38)..(38): Xaa is any aa, unknown, or other
  misc_feature (49)..(49): Xaa is any aa, unknown, or other
MGAFFGAAPPHGLASFRHEEDDQQHQDAADEVYHCGRXSIELSMNGREXRWAP

SEQ ID NO: 32278 - DNA, 562 bp, Zea mays
  misc_feature: Ceres CLONE 1409359-F
  misc_feature (97)..(97): n is a, c, t, g, unknown, or other
  misc_feature (419)..(419): n is a, c, t, g, unknown, or other
  misc_feature (483)..(483): n is a, c, t, g, unknown, or other
  misc_feature (489)..(489): n is a, c, t, g, unknown, or other
ggagctccccgcggtggcggccgctctagaactagtggatcccccgggctgcaggaattcgcacgagaccattacctagaacatcctaatcgaaaanattccgctgcgcacaggcgcacagcccagtccagtacaaacagcagcagcttcgcctccacctccacgcgaggcaagcgcccggcccggctcccgcagcgcaaaaccctagcctcgcccgtcccaaaccctggcggctacggtctctgatcccggtccaatggcgtcgtcgccggacttgttccctaacgttgccttctccgacgtctctgccgccgcccccgcggccgaggccaccgcccgcgttcgggctcggcggcgccaacggggccccgcgcctctgcctcgtcaaagtccgggaaagggaccaaagggggggaaancccccccggggggcgaaaaatttccgaaaccccccccccccccgccaaaaaagggggggggggnaggggnatattttttttatttaaagaaaatggggggggggcgccccccccaccaagagatggagggtgtgtggttcgtg

SEQ ID NO: 32279 - DNA, 635 bp, Zea mays
  misc_feature: Ceres CLONE 1409361-F
  misc_feature: Translation starting site: 426
  misc_feature: SWISSPROT Homolog: EC 2.7.11.24 Mitogen-activated protein kinase
  misc_feature (444)..(444): n is a, c, t, g, unknown, or other
  misc_feature (501)..(501): n is a, c, t, g, unknown, or other
  misc_feature (532)..(532): n is a, c, t, g, unknown, or other
tggagctccccgcggtggcggccgctctagaactagtggatcccccgggctgcaggaattcgcacgagaccattacctagaacatcctaatcaaaaggcccgcgcctcgctctctcttgtctcgcccgctagctcccatcccagcctcccaccgcgcccgcctgccccaacctcccccctcccctccccgctccgctccgctccacgcacggcgccagatctgctgctgctgcggcggccggtggacgccgcgccgcgcgtgccggcggcggtgacgtgagcggcggatcctgcccggccgtgccatcccggcgacgatgacagcgtaagcgggcggcggacgaccgcgcccccccggcccctactcccgaggtcattggcgtgtgctccttggcagaaaatggcgatgatggtggatccccccaatggcatggcaagtcaggnaaaagcatactatactatgtggcagacactggtttgagatcgacaccaagtacgtgncgatcaagccccatcgaaaagagagctacgnaaatcgttgctcatctggtaaccgcgagaccaatgaaaagtcgcgataaaaagataaacaacgtcttgacacccgtgtgatgcgctaaagacgctgaaagagt

SEQ ID NO: 32280 - DNA, 614 bp, Zea mays
  misc_feature: Ceres CLONE 1409366-F
  misc_feature: Encodes the peptide sequence at SEQ ID NO. 32281
  misc_feature (457)..(457): n is a, c, t, g, unknown, or other
tccccgcggtggcggccgctctagaactagtggatcccccgggctgcaggaattcgcacgagaccattacctagaacaatctaatcgaaaatttcttctctcgttcacctcgcgtgcgcgaaccaactagggcgaccgctgccgccctacggcctacgcccagctgctcaggtcttattcgggcctttggcggcgagaaccgaccgcgccaggataatggctcaccgtggacacctagatggactgactgcccaagctccagcactgatgcgccatggttccttcgctgcaggcagcctttctagccactcacctttggagtcttcatctacactggagatgctggagaacaagcttgccatgcaaactgcagaagtggaaaagcttatcatggagaatcagcggttagcatcaagccatgtggtcttgaggcaggacattgttgatacagagaaangagatggcaaataaaccccgcctccccccaagggggaaagtcccaaaccggaaacggggtttttcaaatattaaaaaaattttttggggggaagaaaaaataaaattatggggggggggggggacgacacaacttgggggggggggggggggggggg

SEQ ID NO: 32281 - protein, 84 aa, Zea mays
  misc_feature: Ceres CLONE 1409366-F
  misc_feature (81)..(81): Xaa is any aa, unknown, or other
MAHRGHLDGLTAQAPALMRHGSFAAGSLSSHSPLESSSTLEMLENKLAMQTAEVEKLIMENQRLASSHVVLRQDIVDTEKXDGK

SEQ ID NO: 32282 - DNA, 684 bp, Zea mays
  misc_feature: Ceres CLONE 1409367-F
  misc_feature: Encodes the peptide sequence at SEQ ID NO. 32283
  misc_feature (407)..(407): n is a, c, t, g, unknown, or other
  misc_feature (427)..(427): n is a, c, t, g, unknown, or other
  misc_feature (525)..(525): n is a, c, t, g, unknown, or other
cgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggccccggccacatccaagccgccgcctccggccccggccacacccaagccgccgcctccggccccggccacaccncaagccgccgccagcggggngaggaagaagggcgggtgggcgcgggtggtggagcctcacgggcgtccccgcgtgagggtttaacgtgggaggcgcggcggctgcggtacgaagcggnggcaccggaaggtggtcgccgatgcacgtgcgcccaaggcgggggccaagctcacgctggctctactcccacggtaacgccgccgacttcggccagatgtacgagcttcttcgtcgaggtcagcgcccacctcaacgtcgacctgcatggggtatggat

SEQ ID NO: 32283 - protein, 91 aa, Zea mays
  misc_feature: Ceres CLONE 1409367-F
  misc_feature (71)..(71): Xaa is any aa, unknown, or other
MGAVTSTVAARFAFFPPSPPSYGFEQPAPLPAPATPEPPAPATSKPPPPAPATPKPPPPAPATPQAAASGXRKKGGWARVVEPHGRPRVRV

SEQ ID NO: 32284 - DNA, 621 bp, Zea mays
  misc_feature: Ceres CLONE 1409368-F
  misc_feature: Encodes the peptide sequence at SEQ ID NO. 32285
  misc_feature (370)..(370): n is a, c, t, g, unknown, or other
  misc_feature (371)..(371): n is a, c, t, g, unknown, or other
  misc_feature (407)..(407): n is a, c, t, g, unknown, or other
  misc_feature (409)..(409): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (424)..(424): n is a, c, t, g, unknown, or other
  misc_feature (433)..(433): n is a, c, t, g, unknown, or other
  misc_feature (436)..(436): n is a, c, t, g, unknown, or other
  misc_feature (438)..(438): n is a, c, t, g, unknown, or other
  misc_feature (443)..(443): n is a, c, t, g, unknown, or other
aagctggagctccccgcggtggcggccgctctagaactagtggatcccccgggctgcaggaattcgcacgagaccattacctagaacatcctaatcgaaaaatgaccgactagcccatggtctctctccgctccgacgcgcccgacccaccaccacatccctcatggctgccctcgccgacatcgactcctcggcacttccgccgtccgagtcatccaaaggcaagggcaagatggacaaggaggaggaggacgaggcgaagggcgcggagaagatgtgcggcatctgctatctcgacggccggcgggccatccgcggcgagctcgactgctgcgcccatttcttttgctttgtctgcatcatggctggnngccgcgtcgagtcccgctgtcccttctgcagggccngnttnnncacacatcgncgcccgccngtngncgggncggtccccgacgagcgaatcgtctcgaatccaagagcgcaaccaggtacaccatttcctcagggcaacggggagcaaactaaggggggcggaaaatccctttacctggaaacccccttttgcacccgtttggaaaaaacttccccggggaagaaacaaaatttcggggcaaaccctgg

SEQ ID NO: 32285 - protein, 152 aa, Zea mays
  misc_feature: Ceres CLONE 1409368-F
  misc_feature (70)..(70): Xaa is any aa, unknown, or other
  misc_feature (82)..(82): Xaa is any aa, unknown, or other
  misc_feature (83)..(83): Xaa is any aa, unknown, or other
  misc_feature (84)..(84): Xaa is any aa, unknown, or other
  misc_feature (92)..(92): Xaa is any aa, unknown, or other
  misc_feature (94)..(94): Xaa is any aa, unknown, or other
MAALADIDSSALPPSESSKGKGKMDKEEEDEAKGAEKMCGICYLDGRRAIRGELDCCAHFFCFVCIMAGXRVESRCPFCRAXXXTHRRPPVXGXVPDERIVSNPRAQPGTPFPQGNGEQTKGGGKSLYLETPFCTRLEKTSPGKKQNFGANP

SEQ ID NO: 32286 - DNA, 682 bp, Zea mays
  misc_feature: Ceres CLONE 1409370-F
  misc_feature: Encodes the peptide sequence at SEQ ID NO. 32287
  misc_feature (287)..(287): n is a, c, t, g, unknown, or other
  misc_feature (340)..(340): n is a, c, t, g, unknown, or other
  misc_feature (341)..(341): n is a, c, t, g, unknown, or other
  misc_feature (405)..(405): n is a, c, t, g, unknown, or other
  misc_feature (453)..(453): n is a, c, t, g, unknown, or other
  misc_feature (454)..(454): n is a, c, t, g, unknown, or other
  misc_feature (649)..(649): n is a, c, t, g, unknown, or other
  misc_feature (682)..(682): n is a, c, t, g, unknown, or other
aaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtgngtggcgtcggtgctccaaggaccgcggggtgtcgacggcctcccgccggggcnnctccgggttggccgggtggtgggggaaccctgttccaggtgatccctgcagcgacggcccttcnatgtacgtggtgcgcgacctccgggaagaagtacgggcccatcttcanncatgcggatggggcagcgcacccctcatcgtggtccacctcggcggagctcatccacgaggcgctgggtgaagcagggccccatgttcgcgagccggcccgaggacagccccacccgcctcctcttcagcgtcggcaagtgcaccgtcaactcggcgcctacggcccccctgtggcgtgctctgcgccgcacttnccgtcgccgagatcgtgtccccgcaccgcgtcn

SEQ ID NO: 32287 - protein, 75 aa, Zea mays
  misc_feature: Ceres CLONE 1409370-F
  misc_feature (65)..(65): Xaa is any aa, unknown, or other
MRMGQRTPHRGPPRRSSSTRRWVKQGPMFASRPEDSPTRLLFSVGKCTVNSAPTAPLWRALRRTXRRRDRVPAPR

SEQ ID NO: 32288 - DNA, 651 bp, Zea mays
  misc_feature: Ceres CLONE 1409383-F
  misc_feature (573)..(573): n is a, c, t, g, unknown, or other
  misc_feature (589)..(589): n is a, c, t, g, unknown, or other
  misc_feature (651)..(651): n is a, c, t, g, unknown, or other
aaagctggagctccccgcggtggcggccgctctacaactagtggatcccccgggctgcaggaattcgcacgagaccattacctagaacatcctaatcgaaaaagattagtagttaatacatcacacatattattgagaccaactatcaacataaaaagcacaatagtgtaccaacaatggcagccaaaatattttgcttccttatgatccttgtgctttctgcaagtgctgctaccgcgaccattttcccgcaatgctcacaagctcctataacttcccttcttcacccatacctctcatcagcagtgtcttcagtgtgtgaaaacccaattcttcaatcctacaggatccaacaggcaatcgcagcaggcatcttacctttatcacccttgttcctccaacaaccgtcagccctattacaacagttacctttggagcatttgttgacacaacacattacggcacaacaactactacaacttgtgctaggaaaccttgctgcatactctcagcaacatcagcttcttgcattcaaccaactggctgcattgaactctgctgcttatttgcaancacaactaccattcangcagctagctgctgcctacccccagcaatttcttacgatgcatcaactggcagcattgaacn

SEQ ID NO: 32289 - DNA, 744 bp, Zea mays
  misc_feature: Ceres CLONE 1409388-F
  misc_feature: Encodes the peptide sequence at SEQ ID NO. 32290
tccccgcggtggcggccgctctacaactagtggatcccccgggctgcaggaattcgcacgagaccattacctagaacatcctaatcgaaaaaaacccgaaacccactagtaccgccacacgaattcccgaccccgatggcgacatcgccaccgcagaaccctagctccggcgagccctccgatgcgtcgatcctcgcagccgcggcgctcgaggcgcccgtgcgcgtatggagatccctcgtcgcgcgcttccctcccctcccggactcctccagcttccttgctggcgtctccgacctccagctccgctacttcggcaacagccggccccgccgccgcaggcgctccgctctacctctccctctccgcccggtggccgcgcactctgctcggattgctggtgagatgcccaaagcctttgtgatcttagatgatgttgtgcaacacaccctgactaatttgcacagtattcacaaaagcttactattttggcaggccaaggctgagggaacaaattctcagaaagtgtactcgatgatatttgagagaggcccaagggcctttgttgatgccacatatcaaacactccctagactcgggagcaatggacgccctgaccaatacattttgcattctgcatctgatatggggtcaacaaaactccttggcctgacaaggaagcaacactgcttggccccttttcttgcagacggtcttcccgaagtgaaaaaatgcccgcaacgg

SEQ ID NO: 32290 - protein, 203 aa, Zea mays
  misc_feature: Ceres CLONE 1409388-F
MATSPPQNPSSGEPSDASILAAAALEAPVRVWRSLVARFPPLPDSSSFLAGVSDLQLRYFGNSRPRRRRRSALPLPLRPVAAHSARIAGEMPKAFVILDDVVQHTLTNLHSIHKSLLFWQAKAEGTNSQKVYSMIFERGPRAFVDATYQTLPRLGSNGRPDQYILHSASDMGSTKLLGLTRKQHCLAPFLADGLPEVKKCPQR

SEQ ID NO: 32291 - DNA, 618 bp, Zea mays
  misc_feature: Ceres CLONE 1409392-F
  misc_feature: Encodes the peptide sequence at SEQ ID NO. 32292
tggagctccccgcggtggcggccgctctagaactagtggatcccccgggctgcaggaattcgcacgagaccattacctagaacatcctaatcgaaaagttacttttcctcccccggcgaccgaagccgccgcccagccacgccatggactctctcctcgccagctacgcctcttccgacgacgacgctgatgaggccccacctgctcctcctcctgctcattcccccgccatcgccacttcctccggtggcggcgcaggcgggtttttctcctcgctcccgcaacccaagtccgcccccgcaccgctcttctcctccctcccggcgcccaaatccacccccacgccgctcttctcctctctctcggcgcccaaatcctcccccgcccctaaccccaccttctcctctatcccgccgcccaagtcttccggaggaaaccctaagcgcgtcgtccagtatcgcccgcagccgatccggcagcccacaggcgacagctccgacgacgaggaggacgatcccaagaagcgcgcgcgagcaacaacgaggcgcgcttgcgcccggggctgctggctcgggccccgggcccccgtcccccccgcctcgaaaaattgcccggggt

SEQ ID NO: 32292 - protein, 158 aa, Zea mays
  misc_feature: Ceres CLONE 1409392-F
MDSLLASYASSDDDADEAPPAPPPAHSPAIATSSGGGAGGFFSSLPQPKSAPAPLFSSLPAPKSTPTPLFSSLSAPKSSPAPNPTFSSIPPPKSSGGNPKRVVQYRPQPIRQPTGDSSDDEEDDPKKRARATTRRACARGCWLGPRAPVPPASKNCPG

SEQ ID NO: 32293 - DNA, 655 bp, Zea mays
  misc_feature: Ceres CLONE 1409393-F
  misc_feature: Translation starting site: 166
tggagctccccgcggtggcggccgctctagaactagtggatcccccgggctgcaggaattcgcacgagaccattacctagaacatcctaatcgaaaaaatccactccactccatcatcccgtgcctcacgagtcacgagtcactccaggtccaggctgagcagcaatggcgccgcgaacgctcggcttcaacgcggccccgctcctccagattctgcggtccctgtgcctcctggccctcgccgcggcggcggcggtgtccgggcggcgccacggggcctccccggcgcgcggcagcgggcagagcatgtacctggcgccggcctgccgggcgcacacggcgtcggtggcggacttcggcggcgtgggcgacggcaccacttccaacaccgcggcgttccggtccgaggtggaccacctgtcgcagtactcggacgaggacggcggcggtggcatgctgtacgtgcccggggcaagtggctgacgggccccttcaacctgaccagccacttcaccctctacctccaccaagacgacgtcatcctcggctcccaggacgtacgcgagtggtcaatcgtggatcccctgccttcttacggaagagcgagggacaaggtctcgaggtagggtcgctatccgcatcggcagatagaagc

SEQ ID NO: 32294 - DNA, 694 bp, Zea mays
  misc_feature: Ceres CLONE 1409395-F
  misc_feature: Translation starting site: 113
  misc_feature: SWISSPROT Homolog: EC 2.6.1.2 Alanine transaminase
caaagctggagctccccgcggtggcggccgctctagaactagtggatcccccgggctgcaggaattcgcacgagaccattacctagaacatcctaatcaaaaagtgttcgtcatggccgccagcgtcaccgtggaaaacctcaaccccaaggtcttaaaatgtgagtatgcagtccgtggggagattgtcatccatgctcagcgtctgcagcaacaactacaaacacaaccagggtctcttccttttgatgagatcctctattgcaatattgggaatccccaatctcttggtcagcaacctgtgacatttcttcagggaggttctttgctctttgtgattattccgtgcctcttggaaaaagaggaaaccaaatcattgttcagtgctgatgcaattttctcgagcaaagcagattcttgcaacaatttcctggaagggtaacaggtgcattatagtcacagtcagggtatcaaaggactgcgtgatgcaattgcttgctggaatcattgtcacgtgatggattcccttcaaatgcagatgacattttcattacagacggagcaagtcctggggtccacatgatgatgcaattactgattaggaatgagaaagatggcattctgtgcccaattcctcagtaccccttgtactcagcctccatagctcttcatggtggagctcttgtcccctatt

SEQ ID NO: 32295 - DNA, 703 bp, Zea mays
  misc_feature: Ceres CLONE 1409402-F
  misc_feature: Encodes the peptide sequence at SEQ ID NO. 32296
  misc_feature (404)..(404): n is a, c, t, g, unknown, or other
  misc_feature (501)..(501): n is a, c, t, g, unknown, or other
  misc_feature (530)..(530): n is a, c, t, g, unknown, or other
  misc_feature (544)..(544): n is a, c, t, g, unknown, or other
  misc_feature (553)..(553): n is a, c, t, g, unknown, or other
  misc_feature (574)..(574): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (584)..(584): n is a, c, t, g, unknown, or other
  misc_feature (586)..(586): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
caaagctggagctccccgcggtggcggccgctctagaactagtggatcccccgggctgcaggaattcgcacgagaccattacctagtacatcctaatcgaaaaacctgccacatctggccatctctcagtctcacacgcgctgccatggacggatccatgtggtgcgctgccaactacgtgcctctgacgccgctcagcttcctggagcgcgccgcggtcgtgtacggcgaccgcgcggccgtcgtttgcggcgataggcggttctcgtggcgcgagacgagggagcggtgcctcgccggggcagccgctctcgctcgtctcggcgttggccgccgcgacgtggtcgcggtcatcgcctcgaacgtaccggcgatgtacgagctccatttcagcgtgccgatgnaccggcgccgtcctgtgcacgctcaacacccgccacgacgcggccaatggtgtccgtcctgctgaaacactcggaagccaagtccttcctcgggggnagtcgcagttcccacgccgtggcccgcgnacgcgctcaggctncctcgccgnacgccaaagacaggcttcccncgnnncattncncgggtttctggaccctagcagcagcagcaccccgggcggcggctgcggcagacgagnnnnnnnnnnntccccggnnnncccggggaaaatacaaagggcttttttggcggaagcgcg

SEQ ID NO: 32296 - protein, 107 aa, Zea mays
  misc_feature: Ceres CLONE 1409402-F
  misc_feature (87)..(87): Xaa is any aa, unknown, or other
MDGSMWCAANYVPLTPLSFLERAAVVYGDRAAVVCGDRRFSWRETRERCLAGAAALARLGVGRRDVVAVIASNVPAMYELHFSVPMXRRRPVHAQHPPRRGQWCPSC

SEQ ID NO: 32297 - DNA, 658 bp, Zea mays
  misc_feature: Ceres CLONE 1409403-F
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (540)..(540): n is a, c, t, g, unknown, or other
  misc_feature (541)..(541): n is a, c, t, g, unknown, or other
  misc_feature (587)..(587): n is a, c, t, g, unknown, or other
  misc_feature (589)..(589): n is a, c, t, g, unknown, or other
aaagctggagctccccgcggtggcggccgctctagaactagtggatcccccgggctgcaggaattcgcacgagaccattacctagaacatcctaatcgaaaaacttactggtcctcactcccacaccaaccaaccaacctcctctgcctgccgcttctcctgctgcgggcggtcacggctgcaagtactagaggaggacatccgcttccattactgcgcctgcgaggatcggnnnaggaaccagttaagcggggaagggtttctccaaattttttccgggggggggggggaaaataaaaaattttcccccccaaggggggtcctcgagaggggggccccggggttcttccctctttttgggttccccccggggggttcctcccttgggggggggaagaggccccccccctgggggggggggggggggccccccccccccgggggtccccccccccccccttccttttttggtggtgggggtgaaaaaaaaaaaaaaaaaaaaaaccccccccccccccccccaggggggggagggggtgnncccccccccccgggggtgggtttggttttgttttataaaaaaaacncntctcttttttctttttttttttttaaggaagggggggggggacccccgccgccccccccggcgagcgcg

SEQ ID NO: 32298 - DNA, 688 bp, Zea mays
  misc_feature: Ceres CLONE 1409412-F
  misc_feature: Encodes the peptide sequence at SEQ ID NO. 32299
  misc_feature (638)..(638): n is a, c, t, g, unknown, or other
aaagctggagctccccgcggtggcggccgctctataactagtggatcccccgggctgcaggaattcgcacgagaccattacctagaacatcctaatcgaaaaacatcgacccagccatctcctcaccctcgttcaccacacagtccgccactcctttactagcttgtgatttgtacgtcgaccagatcactggtcgcgtggcggacgacgacacatggtcaatgctagtgtgtctgcatcatggtgggcgttcctcctgctcgccggggtgctgctgctctcagcagccacgtccgctgctcaggacggagtgctcgaacgcgaccgcaaggacgacctgcgatgtagcaagcacgcgtgcgagtggcattacggaaaggacaccccgcggaacaggtgaatgccacagcgagtgccgctagcggcaccatcaagctgacgcgtgctaggaccttgacagcggcgtgaactcctacgtctcccgctcctgcaggaaccagtgccgacaccaatgactgcaccgacaccatagccagccgtggaacatccaggaatgcatgaggcggtgccgtcatcgctgactggacgtcgacatgcaccaagactacagacaccacagtcatagcccgtataaggcntcatgacagatgccagcatcccaacattccagactgtcgaaggaagcata

SEQ ID NO: 32299 - protein, 61 aa, Zea mays
  misc_feature: Ceres CLONE 1409412-F
MVNASVSASWWAFLLLAGVLLLSAATSAAQDGVLERDRKDDLRCSKHACEWHYGKDTPRNR

SEQ ID NO: 32300 - DNA, 683 bp, Zea mays
  misc_feature: Ceres CLONE 1409416-F
  misc_feature: Encodes the peptide sequence at SEQ ID NO. 32301
  misc_feature (284)..(284): n is a, c, t, g, unknown, or other
caaagctggagctccccgcggtggcggccgctctagaactagtggatcccccgggctgcaggaattcgcacgagaccattacctagaacatcctaatcaaaacactcgggttggttagaagaacccaatgcaagtgtgagtgagctgacggcacggcggacgcgctcgcctctcctctcctctcctctcctcttcttccggctctccctctccgcatgccattccaacgcattaccggtatttttagccgccggaggagacgggtagctgcgtagccactagcngagagagagagggaggggagaaaccatagctcctggccgttctgcctgcccatccaccgcggcgccggccgtccgtctcccgtccacatccctcctcctctcctgcaaggttcctgtgcgtagcgcagaggggtcggagtcggagtcggagtcggagaagatgatgggcgggttcctctccagggtcctcctgttggcttttggctatgcctatcctgcctacgaatgctacaagactgttgaactgaacaaaccagagattgcgcagctcatattttggtgtcagtattggattttagttgccctgttgacagttttggagagattcggagatttcacaatatcatggctaccgttctactcggaagcaaagctgatgttcttttgtatacttgtgga

SEQ ID NO: 32301 - protein, 79 aa, Zea mays
  misc_feature: Ceres CLONE 1409416-F
MMGGFLSRVLLLAFGYAYPAYECYKTVELNKPEIAQLIFWCQYWILVALLTVLERFGDFTISWLPFYSEAKLMFFCILV

SEQ ID NO: 32302 - DNA, 653 bp, Zea mays
  misc_feature: Ceres CLONE 1409420-F
  misc_feature: Encodes the peptide sequence at SEQ ID NO. 32303
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (593)..(593): n is a, c, t, g, unknown, or other
  misc_feature (594)..(594): n is a, c, t, g, unknown, or other
  misc_feature (653)..(653): n is a, c, t, g, unknown, or other
ggagctccccgcggtggcggccgctctagaactagtggatcccccgggctgcaggaattcgcacgagaccattacctagaacatcctaataaaaaaagtaatcagtgctcagtgctcactagcccaagtcgccctaaacctagcccgggcacccgccagaccagccagcccaacaacgcaaaacgcgacgcggccaccgccttgtccatgggctcctcggcgcagctcaggcggctgaagcctctgtaccagctggtggtgaacaacatcctgaccatcgtggccgtgccgctcgccgccgcggtcctgctcaaggcggcggagctggggcccgaggagatcctggcccgggcccgcgcgctccggccggcgcacatgctcctggcggggttcctgccggccgtggcgacggtgctgtacctgacgctccggccgcgcgcggtgtacctggtggactacgcgtgcttccgcaccaaccccaactgccgcgtcccgttcgcgacgttcctggagcactcccgcgtgtggccgggcttcgacgagcgcagcgtccggttcatgacgcgcctgctgaggnnncccgggggctgggnngaggagacgtgcctgccgtacgcgcagcactacatcccgccgtcgcgcgacctggagtn

SEQ ID NO: 32303 - protein, 148 aa, Zea mays
  misc_feature: Ceres CLONE 1409420-F
  misc_feature: SWISSPROT Homolog: EC 2.3.1.119 Icosanoyl-CoA synthase
  misc_feature (124)..(124): Xaa is any aa, unknown, or other
  misc_feature (129)..(129): Xaa is any aa, unknown, or other
MGSSAQLRRLKPLYQLVVNNILTIVAVPLAAAVLLKAAELGPEEILARARALRPAHMLLAGFLPAVATVLYLTLRPRAVYLVDYACFRTNPNCRVPFATFLEHSRVWPGFDERSVRFMTRLLRXPGGWXEETCLPYAQHYIPPSRDLE

SEQ ID NO: 32304 - DNA, 653 bp, Zea mays
  misc_feature: Ceres CLONE 1409421-F
aaagctggagctccccgcggtggcggccgctctagaactagtggatcccccgggctgcaggaattcgcacgagaccattacctagaacatcctaatcgaaaagacgacacacctgacacgtgggtctatcagtcatcctggtccttttattttctttcttctctcacccggttcttcctcctcccgagtcccgaactctcgatccactcatccgctgagggcgtcggccttctggcccttctccccccggccgacctcgcccctccggcgctccgtccgcttcctgaactcgtctccctcacggacgttctcctccctccgctcgccgcgccgcaacccggagaggagaccgccgctcggtcgagcaccacctggggcccagcgtcctcgcgaccagctctagcgcggcgtccgccctctgcagccctggtgtccccgcgactggcttcggccggcacacaactccacagttaggtctccgtctgcacagcgcggcgatcttctctctccttcccgccctctgcagtccctctcagtccctctccgtctgcttgattctgctccaacctcagactaccctcgctctgaaaatgtcattacgcacccaatgcgcttgtagctgtatgctgcaaccctactctgcctcgtcttct

SEQ ID NO: 32305 - DNA, 700 bp, Zea mays
  misc_feature: Ceres CLONE 1409424-F
aagctggagctcaccgcggtggcggccgctctataactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggtggatcgtgaccgcagcggcatctacggcggtgcccacgccacctacgggcagcagcagtagcagggaggaggcggacacccgatgcgtgagcaggagcagggcatgctacacgacaatgcgccgactgcgtctgaagcgctgacggaggccacactggtcctcctggacggactgctgctgccgatgtccggactgtggctaaagaccaacctggaagggttggcccggggcaaaaccggggttcctgaccgtcaacaagtggtgggtccccgccgggtggtcaatcggaaaagccttcttgggggactctacccttccggctttggaattggggggctttcctctaaaaattggccggccaaaagggggccggcggttattcaaaggggccccgggaaatgggggggaaggcccccccaaaagaggtggggggggcgcggggaaccggggggaaaataaaaactgggggggggccaaggcccctccgggg

SEQ ID NO: 32306 - DNA, 705 bp, Zea mays
  misc_feature: Ceres CLONE 1409425-F
  misc_feature: Translation starting site: 271
  misc_feature: SWISSPROT Homolog: EC 3.4.16.5 Carboxypeptidase C
tcaccgcggtggcggccgctctagaactagtggatcccccgggctgcaggaattcgcacgagaccattacctagaacatcctaatcgataaatccaatacgcacaggaacccactctctctccccacgatggaaaaaatggcgatggtgacctcccgcactcccggctctcctctgcctcgccgccgacgacgacgtcgtcgcggaggatgccgccgccgccgccggagaacgcagcctccgccagacctgcaacgctatcttcccagctatggaagaggagcgtttcagcagcgcgctcatcctcctgtctaaagacaaagaggtaaacccgatcgcgggaggagacgactggctcagtatgatgtccggggagctactaaagcatcacgatacggagcacaacacgaccgacgatggcgaagacctcggtcaccacctcagtagacttccggctgcagcacgagcacaacagcataacgacctacgtcatcttcgaagctaggcttaaaaagaatgaggacgaccccgccgaagactatgtcaccgaagggacattaatgaaatggcgatcaggctgtcttctacgagaatggggccattaacattgccaacaacaagccgcttgtctggaataaattcaagtgtgacacgatcacaaagatcatatttgaagatcagacaatcgtaactgcgtatagctaca

SEQ ID NO: 32307 - DNA, 534 bp, Zea mays
  misc_feature: Ceres CLONE 1409431-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (25)..(25): n is a, c, t, g, unknown, or other
  misc_feature (26)..(26): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (41)..(41): n is a, c, t, g, unknown, or other
  misc_feature (54)..(54): n is a, c, t, g, unknown, or other
  misc_feature (60)..(60): n is a, c, t, g, unknown, or other
  misc_feature (61)..(61): n is a, c, t, g, unknown, or other
  misc_feature (180)..(180): n is a, c, t, g, unknown, or other
  misc_feature (288)..(288): n is a, c, t, g, unknown, or other
  misc_feature (411)..(411): n is a, c, t, g, unknown, or other
nnnnnnnnnnnnnnnnnaaaccccnnccccnnnnnnggganagggagggccccngggggnncccacataaaaaactgcagctccccgcggtggcggccgctctagaactagtggatcccccgggctgcaggaattcgcacgagaccattacctagaacatcctaatcgaaaagcttcggngatcgggacgcggagaggggaaaggcgagtcgtcgactcgtcgtccgggcagcttccctccctctcctctccgcccccgcttacctaggccggccccgcctacgcccncctcccgccgccgcacgatgagcacttctcccgccgccgccgacggtttcgcctttgccgcctactgctgccgccgacgaggccgccgcgggcgacagagaacggtgggtggtccgatggaanaagggggtccggccctttcaacaacgggggggggaaccccccgttttcccctccggcccgaaggggggggcctttttcggggaaaaaaaaaccccccttcggggccaaaccgggggtctcttc

SEQ ID NO: 32308 - DNA, 686 bp, Zea mays
  misc_feature: Ceres CLONE 1409435-F
  misc_feature: Encodes the peptide sequence at SEQ ID NO. 32309
  misc_feature (621)..(621): n is a, c, t, g, unknown, or other
aagctggagctccccgcggtggcggccgctctataactagtggatcccccgggctgcaggaattcgcacgagaccattacctagaacatcctaatcgaaaaatcttcttcctcgtgcgcgtgcagccgccttgcttgcggccctgcctctctcctctcctgctctcccaccggccaccgtcgccggccgccaccgtcgccgccatgcctttccgattccagttcccatggctcaagaacccaactacaaacggcggcacctccaacatagacactaaccctagcccccgcttccccaaccccttcctccctatccaagcccatgtcacctccttcttctcctccttcccccgggcgctcccgccgccgccgccctgggcgcgcatcacctcgccagcctccacctccggggccctacctacctctgagatcgaggagcggctcgccggggtgcccgtgtacgcgctcgccaacgccgcccaggagttcgtgcttgtgtcgtccacacgcgtgggagggcaagggggcgagagcgtgagtccaacgccggcgctcgggctgctctgcttccggaaggaagatgctgacgcgctgctggagcagatggatggcgatatgcgcngccggctctggtgtcgttcctgtcgcgctgaacaggttatccaatggaagtcggattggtgtggc

SEQ ID NO: 32309 - protein, 161 aa, Zea mays
  misc_feature: Ceres CLONE 1409435-F
  misc_feature (140)..(140): Xaa is any aa, unknown, or other
MPFRFQFPWLKNPTTNGGTSNIDTNPSPRFPNPFLPIQAHVTSFFSSFPRALPPPPPWARITSPASTSGALPTSEIEERLAGVPVYALANAAQEFVLVSSTRVGGQGGESVSPTPALGLLCFRKEDADALLEQMDGDMRXRLWCRSCRAEQVIQWKSDWCG

SEQ ID NO: 32310 - DNA, 676 bp, Zea mays
  misc_feature: Ceres CLONE 1409436-F
  misc_feature: Encodes the peptide sequence at SEQ ID NO. 32311
  misc_feature (457)..(457): n is a, c, t, g, unknown, or other
aagctggagctccccgcggtggcggccgctctagaactagtggatcccccgggctgcaggaattcgcacgagaccattacctagaacatcctaatcgagaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcacaagctcctatagcttcccttcttcccccgtacctctcaccagtggtgtcttcggtatgtcaaaacccaattcttgaaccctacaggatccaacaggcaatcgcagctggcatcttacctttatcacccttgttcctccaacaatcatcagccctattacagcagttacctttggtgcatttattggcacaaaacatcagggcacaacaactacnacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactggcagcattgaactctcctgcttatttacagcagcaacaactactaccacagtt

SEQ ID NO: 32311 - protein, 172 aa, Zea mays
  misc_feature: Ceres CLONE 1409436-F
  misc_feature (1)..(170): Pfam Name: Zein Pfam Description: Zein seed storage protein
  misc_feature (100)..(100): Xaa is any aa, unknown, or other
MAAKIFCLLMLLGLSASAATATIFPQCSQAPIASLLPPYLSPVVSSVCQNPILEPYRIQQAIAAGILPLSPLFLQQSSALLQQLPLVHLLAQNIRAQQLXQLVLANLAAYSQQQQFLPFNQLAALNSASYLQQQQLPFSQLPAAYPQQFLPFNQLAALNSPAYLQQQQLLPQ

SEQ ID NO: 32312 - DNA, 691 bp, Zea mays
  misc_feature: Ceres CLONE 1409437-F
  misc_feature: Encodes the peptide sequence at SEQ ID NO. 32313
  misc_feature (589)..(589): n is a, c, t, g, unknown, or other
tccccgcggtggcggccgctctagaactagtggatcccccgggctgcaggaattcgcacgagaccattacctagaacatcctaatctaaaagacaaccagacgcgccagggtttcaggcttccacgaatctccccgccgccctcaattcccctcggcgccgccgcctcctcccctcgcttcggtcctcggttagttaaccatccaggttctgtcaagatgtctgatagccatgagactgacaggaacattgagatttggaaaattaagaaactgatcaaggcattggaatcagccagaggcaatggcacaagcatgatctctctgatcatgcctccacgtgatcaggttgctcgagtggctaagatgttaggtgatgaatatggtactgcttcgaacatcaagagtagagttaatcgtcaatctgtgttggctgccatcacctcagctcagcagaggttgaagctctacaacaaaggcctctaaaacggtaattggttctgtacactgggactatttgttactgaagacggaagggaaaagaaaggtactaattgattttgagccattcaagcctatcaatgtatcacntctacctttggtgacaacaagttcccacactgaaggctttaaatgagctcttgatctgatggcaaaaaagttggggttcattggtgatggggaggggaaagt

SEQ ID NO: 32313 - protein, 88 aa, Zea mays
  misc_feature: Ceres CLONE 1409437-F
  misc_feature (6)..(89): Pfam Name: eRF1_1 Pfam Description: eRF1 domain 1
MSDSHETDRNIEIWKIKKLIKALESARGNGTSMISLIMPPRDQVARVAKMLGDEYGTASNIKSRVNRQSVLAAITSAQQRLKLYNKGL

SEQ ID NO: 32314 - DNA, 671 bp, Zea mays
  misc_feature: Ceres CLONE 1409439-F
  misc_feature: Encodes the peptide sequence at SEQ ID NO. 32315
  misc_feature (544)..(544): n is a, c, t, g, unknown, or other
  misc_feature (622)..(622): n is a, c, t, g, unknown, or other
  misc_feature (635)..(635): n is a, c, t, g, unknown, or other
  misc_feature (636)..(636): n is a, c, t, g, unknown, or other
tccccgcggtggcggccgctctagaactagtggatcccccgggctgcaggaattcgcacgagaccattacctagaacatcctaatcaaaaatcgagctgagctgagcatcatggggtagtgtgtgtgtgaggcgatagagaagctagtgctcataaccaaccaccactcagtcctcctcctctaccctttcccttccgccgcgttcctacttggtcctagagggagagagatctcgaactccaagggcgcatgctccggttgctagctacgatgccgtgtgcgtagctgcggcagcccttgatcgatcaatcgatcgcttgtgcggaatgagccggatcgagtggagtcagctagctagatactccgtggtcgtcgtcgtcgttggacgtacgccagaagagggagctagagaagaataccgtacagctgcttccaacatggcagctgcctcgtctgcccacctgttcggactcggcgacgggcagatgcagatgcagccgcagcagcagcaggcgccgcctcctcctcttgtgaacacccggncgcgccgccgcccaaagaagaagcggaaccaacccggtacccaaccttgaacggcggaggtgatcgcgctttccccangacgtgaggcgannaaacccgttccggggggcgagtggggcaacaaggg

SEQ ID NO: 32315 - protein, 88 aa, Zea mays
  misc_feature: Ceres CLONE 1409439-F
  misc_feature (73)..(73): Xaa is any aa, unknown, or other
MSRIEWSQLARYSVVVVVVGRTPEEGAREEYRTAASNMAAASSAHLFGLGDGQMQMQPQQQQAPPPPLVNTRXRRRPKKKRNQPGTQP

SEQ ID NO: 32316 - DNA, 694 bp, Zea mays
  misc_feature: Ceres CLONE 1409440-R
  misc_feature: SWISSPROT Homolog: EC 1.8.1.4 Dihydrolipoyl dehydrogenase
agaattgggtaccgggccccccctcgaggtcgacggtatcgataagcttttttttttttttttttagggcaaccaacaactaatatcgctaataacgaagccaacaaaaacccagccccaccgttaaaaaaagacccttttaacaatctggacccaaaaaagaaacatttgtagtgcttgtattcactgatgaatttcttcctccaatttgtaacctactgcaactgcctaaaacgacaccctccccgttaccgttgtctatctcgttttgaggaggaaaacagggtcgtaacaaagctgaggacctctcggagtggttggggtggctgccttgggttgctatccggactttgtctaggatgcaaatggttcctttgcccaatgagaaacaccggaattaaccttggctgcttagaaaagccatccaggaccccttacaaatcatggtgtgcgtgaacaccgaacttgatgtctcgcacactagttcctacggagatggaattttgatgctcgtgaatgagatcggcagcctgcttacccaacacgtgaaccgcaagaatttcacccgtgtgaggtcagtaaatcaacttagcagtcccatctccttcattttctgccaagacttattgcttagcctaaagcgtagacttacaaggttcatcccaatcccttgatttatcgggcttgctagcag

SEQ ID NO: 32317 - DNA, 660 bp, Zea mays
  misc_feature: Ceres CLONE 1409440-F
  misc_feature: Encodes the peptide sequence at SEQ ID NO. 32318
aaagctggagctccccgcggtggcggccgctctagaactagtggatcccccgggctgcaggaattcgcacgagaccattacctagaacatcctaatcgaaaagtcgaaacctccgccccggtggatagacccctcttcgcctcctccgagcgaggctgagtgctcatggattgatacgccttcttctcttatctcgaggtaatagtctcggccaattgtcgcatttcgtcgctatggggtcaacagcggccgtctccgtctccgcctcgacgatagagtctagcggctgggccagatctgaggctgcgcgccggccaggtggaatccgggactgcggactccggagcgaggacctcacgtgtcactcgattcgaatctcgcaggcgcccgcgaggctgacggtgtcgaggacgccatcgcaggcggcggtgaacaatgtcgcgatggcggtgacctgacgattcgattacgatctcgtatcatcgaagacgggcgaactgtgctaaggacgccgcgctgcaggcggttgaaaagggcttgacatgaacttaattgagggacatggtgtggatgctgcctgttcaaaaagaaactacgtcggggggaaggggatgctagctggaacgagcaggggcctctgcttctgaagaacatctgtgc

SEQ ID NO: 32318 - protein, 74 aa, Zea mays
  misc_feature: Ceres CLONE 1409440-F
MGSTAAVSVSASTIESSGWARSEAARRPGGIRDCGLRSEDLTCHSIRISQAPARLTVSRTPSQAAVNNVAMAVT

SEQ ID NO: 32319 - DNA, 653 bp, Zea mays
  misc_feature: Ceres CLONE 1409444-F
  misc_feature: Encodes the peptide sequence at SEQ ID NO. 32320
aaagctggagctccccgcggtggcggccgctctagaactagtggatcccccgggctgcaggaattcgcacgagaccattacctagaacatcctaatcgaaaaagactcatccaatcgacccctctttgatctgcctctccgcgctcctacagaatagcatggcgccaccacactctatcatcgacgccgtattcctcgccgcagcggatctgctcctcctttctccgaaagatgcggagacggtgggcgtgaactactgccgcgcgtcgaacaacctgcgcaaaccagcgtcgtgtgagcagttgcccacgaagcacggcaccctccatgtgaaactgtaagacgccgatcccacggtgatgcgagccctgctcaacaggagcatgccgcgtgtgtcgtggctgtgcatgaccttgtcgagacgctcgagtttactgcgaccacgcacttttgtgcttgcttcggaacggaagagggacccacacgtcctcaagaatcaagttctgcgccgtgcgcaactaatgctgcccatcccgcaagaaggtgcaggtcgagctggtgacgcacatgcacctggtggaggcgacctatgccaggatcgggctcgactgatcgtcaaggcggctctcttcttccagagggggagtaccacc

SEQ ID NO: 32320 - protein, 60 aa, Zea mays
  misc_feature: Ceres CLONE 1409444-F
MAPPHSIIDAVFLAAADLLLLSPKDAETVGVNYCRASNNLRKPASCEQLPTKHGTLHVKL

SEQ ID NO: 32321 - DNA, 666 bp, Zea mays
  misc_feature: Ceres CLONE 1409446-F
  misc_feature: Encodes the peptide sequence at SEQ ID NO. 32322
tggagctccccgcggtggcggccgctctagaactagtggatcccccgggctgcaggaattcgcacgagaccattacctagaacatcctaatcgaaaaacagctgaaagcagccaaaacgcagaagctgcactgcatacatcgagctaactatctgcagcgatgtctcgctcctgctgcgtcgccgtgtcggtgcttctcgctgtcgccgcgacagccagcgccaccgcgccggcatggctgcacgaggaggccatggccacgggcccgctggtcgcagagggtgcaagggtggcgccctccgcgtccacctgggctgccgacaaggcgtcgccggcgaggccgagcggcggcatggccacgcagggcgacgaccagagctcgtcgggcggcagtggcagcagcggtgagcacggcaaggaggagggcgagaagcagggcaagagctgcctcaccaaggaggagtgccacaagaggaagatgatctgcggcaagggctgcacgctctcggcgcacagcaagtgcgccgccaagtgcaaccagtcctgtgtccccccctgctaggagccgaggccggagttttgccggcggcaatacctcgatcgatcgagtggttcacttcacttcctttggtataagtcttggggggtgccgttgcgctgcgctgg

SEQ ID NO: 32322 - protein, 133 aa, Zea mays
  misc_feature: Ceres CLONE 1409446-F
MSRSCCVAVSVLLAVAATASATAPAWLHEEAMATGPLVAEGARVAPSASTWAADKASPARPSGGMATQGDDQSSSGGSGSSGEHGKEEGEKQGKSCLTKEECHKRKMICGKGCTLSAHSKCAAKCNQSCVPPC

SEQ ID NO: 32323 - DNA, 664 bp, Zea mays
  misc_feature: Ceres CLONE 1409449-F
  misc_feature (493)..(493): n is a, c, t, g, unknown, or other
tggagctccccgcggtggcggccgctctagaactagtggatcccccgggctgcaggaattcgcacgagaccattacctagaacatcctaatcgaaaaatccgacccagtatccccgacaaagtcaatgcgatgcgtctcctccttgctctatcgactatcgtagccgattccccgttgcaagtaactaaaactaagtctcaagtctgcagagtaaccggagtagcatagcactagcaagcaatggccgctctcacttccgctctcctcttcgccgccctcctcgtggccgcccagtacgtgctccgcttgctccactccttcctgtgggtcccgttccgcctggaacgccgcttccggcggcagggaatccggtggccaccacgaagcctggtctccggtaacgcagccgactaccgcgacctgctagccgccgccaggtccgcgcccctctcctccttcgccacaacggagtcgtcgcccgcgccacgccgnagtacgcgatctggctggcgcggtacggccggccgttcgtgtactgattcgggccccggacgcggctggtgatctccgacacggagctcgtgaaggccgtgatgaccgactccacggggggctttgatagggacggctcggacggcaacacccgctcgcaagcagctcatt

SEQ ID NO: 32324 - DNA, 707 bp, Zea mays
  misc_feature: Ceres CLONE 1409453-F
  misc_feature: Encodes the peptide sequence at SEQ ID NO. 32325
  misc_feature (390)..(390): n is a, c, t, g, unknown, or other
  misc_feature (447)..(447): n is a, c, t, g, unknown, or other
  misc_feature (481)..(481): n is a, c, t, g, unknown, or other
  misc_feature (549)..(549): n is a, c, t, g, unknown, or other
tccccgcggtggcggccgctctagaactagtggatcccccgggctgcaggaattcgcacgagaccattacctagaacatcctaatcgaaaaaacacaacaatctctctcccctcactccctctctgcagcgcgcagctttcaaagcgttgggagagatggcagaggagacgcaaccagaggccgcagccgccgccgcgcccgccgcggccgaggtagtcgtgaccgaagctgcgccggcggaggcggaggtgcctgcggcggcggaagctgaagccgaggccaaggatgagaagaaaggtgacgaggcggagctcacccgccgatgaccgcgggggtggggaccggctcgttcaaggaggaaagcaacctgggtggaagacctgcccgancccggagaagaaggcgctcgacgagttcaagcagctgatcgctgctgcctcgcccgncccggtgagttcaatctgcctcccccgccgccgnccgccgaagggcaaggaaacaaaggggtggaggaagccaaggcccaggtgggctgggatggccccggntttgagaagtccaaaaaacgaagggtgcgcccgccccgaagaggccaaggcctgagaaccttggcttgaggaaagccagcccttccgagcccgagccgcaggaaaaaaaaccccgtccgggccactggggaggggggaacgggcacccagaaaggggg

SEQ ID NO: 32325 - protein, 56 aa, Zea mays
  misc_feature: Ceres CLONE 1409453-F
MAEETQPEAAAAAAPAAAEVVVTEAAPAEAEVPAAAEAEAEAKDEKKGDEAELTRR

SEQ ID NO: 32326 - DNA, 540 bp, Zea mays
  misc_feature: Ceres CLONE 1409455-F
  misc_feature: Encodes the peptide sequence at SEQ ID NO. 32327
  misc_feature (258)..(258): n is a, c, t, g, unknown, or other
  misc_feature (316)..(316): n is a, c, t, g, unknown, or other
ccgcggtggcggccgctctagaactagtggatcccccgggctgcaggaattcgcacgagaccattacctagaacatcctaatcgaaaaacttcacctcttctgcttccttctccccagcatacagtgccagacaggatacccacacattcatggaggtggttcaagaagtccttaggcatggctcagcagatagtgtccgtgctgtcataagagctaacaaaaagagctacagccttgtccagctcattgcagcctcnttttgatgtctacaacattttgtgcagcaaaaatatgacacccaaatggggatgccangatttcctctttccaaggaagaatgggaaccagggttcccttcgggaagcccgggtggacagggggctaaaccccccccggatttgggtgctggggaattttggaacccgggttttcgggggggaattggaaaaacccccttggccctttttttttcccaagaagggggggtttttttcttgggggggggggggggcccccaaattatttttggggggggttta

SEQ ID NO: 32327 - protein, 37 aa, Zea mays
  misc_feature: Ceres CLONE 1409455-F
MEVVQEVLRHGSADSVRAVIRANKKSYSLVQLIAASF

SEQ ID NO: 32328 - DNA, 671 bp, Zea mays
  misc_feature: Ceres CLONE 1409456-F
  misc_feature: Encodes the peptide sequence at SEQ ID NO. 32329
  misc_feature (379)..(379): n is a, c, t, g, unknown, or other
  misc_feature (382)..(382): n is a, c, t, g, unknown, or other
  misc_feature (443)..(443): n is a, c, t, g, unknown, or other
  misc_feature (451)..(451): n is a, c, t, g, unknown, or other
  misc_feature (475)..(475): n is a, c, t, g, unknown, or other
  misc_feature (476)..(476): n is a, c, t, g, unknown, or other
  misc_feature (479)..(479): n is a, c, t, g, unknown, or other
  misc_feature (492)..(492): n is a, c, t, g, unknown, or other
  misc_feature (503)..(503): n is a, c, t, g, unknown, or other
  misc_feature (505)..(505): n is a, c, t, g, unknown, or other
  misc_feature (513)..(513): n is a, c, t, g, unknown, or other
  misc_feature (557)..(557): n is a, c, t, g, unknown, or other
  misc_feature (558)..(558): n is a, c, t, g, unknown, or other
  misc_feature (577)..(577): n is a, c, t, g, unknown, or other
tggagctccccgcggtggcggccgctctagaactagtggatcccccgggctgcaggaattcgcacgagaccattacctagaacatcctaatcaaaaaacagtcccacgccctccagtcaaagcaagccgctgcttggccggccgggaaggctcggtcgcagcgccgaggaatggcggccaagccggtcaccgtcggcgacctcatccaccgcgtcgcctcttcctgcctctccaaccgcctgccgtgcaaccacaccttccgcgactccgtggacagcgactttgacgacgacgacgacgacgacgaccccttcgccgacgccgtctccagcagcgagaaatgccagcggtccccgcccgtgcccggaggtcgaggaanagnaggaggaggacgagaagttcaagatctgggaggagagggagcaggaaaaggagagggtggncgccgcgnccaagggggccgaggcgggccgcnnagncgaaagcgctganggcgaaagggncngaccccgnccccgggggggcgccccgccaaacaacacgccccaagaaccggnnggcccctgggaaccccganaaaaagcctcacttccatatcgtccctctgtctcccagttccttttcctttgggggccttcccacaactcctttccagcattcccaaacggggc

SEQ ID NO: 32329 - protein, 106 aa, Zea mays
  misc_feature: Ceres CLONE 1409456-F
  misc_feature (70)..(70): Xaa is any aa, unknown, or other
  misc_feature (71)..(71): Xaa is any aa, unknown, or other
  misc_feature (94)..(94): Xaa is any aa, unknown, or other
  misc_feature (102)..(102): Xaa is any aa, unknown, or other
  misc_feature (103)..(103): Xaa is any aa, unknown, or other
MAAKPVTVGDLIHRVASSCLSNRLPCNHTFRDSVDSDFDDDDDDDDPFADAVSSSEKCQRSPPVPGGRGXXGGGREVQDLGGEGAGKGEGGRRXQGGRGGPXXRKR

SEQ ID NO: 32330 - DNA, 674 bp, Zea mays
  misc_feature: Ceres CLONE 1409459-F
  misc_feature: Encodes the peptide sequence at SEQ ID NO. 32331
tccccgcggtggcggccgctctagaactagtggatcccccgggctgcaggaattcgcacgagaccattacctagaacatcctaatcgaaaaaagaaccaaaggttcaagctccacaggcggcaagctccttcttcatccacgccctccctccgccttgagaaccataggtccgagctctgcaagccccttcccccttcctccacgccctacgttcttgattgattcctgtttgcttgtgattttgcatttcggaaatcgaatcttgttgttcttggggatcattggggggcgattttaggatactagagtctagggctaagaaattgtatggcatcttggagtagtaggggtggagtccttaggcagatgctataggcctattgccgggacctcgccgagttcggcacccagcctacgccgcgagatcgaggtcggacacgaggccactgcctgggctcgccgcccttggggtttcttgtcggtgctgctgctctttgggctcctctggccgaagagcttgggctgaagccatgtgggttggatgcaagtgggctgggtgcaggtaacttggggtccgagctcatggaagatctcaacagcatcgacgagaccgcgtagcctggcctgaagatcaaagtcgaagaagatgatgtggcccgcgcgggcccaagcg

SEQ ID NO: 32331 - protein, 73 aa, Zea mays
  misc_feature: Ceres CLONE 1409459-F
PRGGGRSRTSGSPGLQEFARDHYLEHPNRKKNQRFKLHRRQAPSSSTPSLRLENHRSELCKPLPPSSTPYVLD

SEQ ID NO: 32332 - DNA, 676 bp, Zea mays
  misc_feature: Ceres CLONE 1409460-F
  misc_feature: Encodes the peptide sequence at SEQ ID NO. 32333
  misc_feature (622)..(622): n is a, c, t, g, unknown, or other
  misc_feature (623)..(623): n is a, c, t, g, unknown, or other
aaagctggagctccccgcggtggcggccgctctagaactagtggatcccccgggctgcaggaattcgcacgagaccattacctagaacatcctaatcaaaaaacatgcaataagctttacggcgaactatcgtctattgcgcataatacttgctgtgttcgcctgcgcccacctctccttcctctcgaccctgactgccagggagatggaaatgtcgaggcgcgtgaagcaccagagcccacactggagagcccttggacatgtgcctgactgctacctctctcaccaacccctcgacatcatcgacccggactatggcgaccatcccctctaccacgaacaacatccggtggacgctcgcgtcgacgaccttatctacgacgaactgcacctgaaaactcgcctccgcggagaacgtgaccatttcgggatcgacaaggactgaggagatgtcgcgcacctgatcgaccacatgaagcaagagatctcggacatgctgcacgtccgcctctccttcgtggtgctgctgaatcagcatgtgggacagcaagagcaagatatacttcatcgtgtgatacgaccggcatcggtgagatcttcctccacatcggcatggggaggnntatagggaaggacgtccattatcaaggtacttccaccagcttggtccgagcag

SEQ ID NO: 32333 - protein, 79 aa, Zea mays
  misc_feature: Ceres CLONE 1409460-F
  misc_feature: SWISSPROT Homolog: EC 6.3.5.4 Asparagine synthase (glutamine-hydrolyzing)
MEMSRRVKHQSPHWRALGHVPDCYLSHQPLDIIDPDYGDHPLYHEQHPVDARVDDLIYDELHLKTRLRGERDHFGIDKD

SEQ ID NO: 32334 - DNA, 812 bp, Zea mays
  misc_feature: Ceres CLONE 1409460-R
  misc_feature (276)..(276): n is a, c, t, g, unknown, or other
gggtttttcgattgggtccgggccccccctcgagtcgacggtatcgataagcttttttttttttttttttcattcccctttttttttttttttttttttttttttttttttcccagcgctgatcattgctgcttctcttggcgaaaggaacaggagttccatgcccaacaatttctgctacaagaagaaaactggcaaaagatgatcacaaagagccctacgccctgatgctcatgcaaacaaggtcctagctctttgacaaggacaaagaaaganaggatggattgtaattgcctctcctaagaggctgccttaaatacaatcgactaacagggggagaccatatggataaagtgctggacacggtctaacaggatggcttcaattatgatggctgaaccactgaaggagccatgttctcctcacatcggctgctccaacagatggtcgctgagttgaaggtacctaagccccttgctgcaaaaaaatcccatacccccagcttgggtcgcctgccctaagttctttcacctttaaacaacgggaaaaggcccagttgtccccctccaaaaaaacctccggggaataaaatgcccaaggtggcccccttttccccccccttttggttggggaacccccctggtaaagttttttaccaaaaaccccaaacccttttgttttttgttcaacccacaaaaaaaagcgccctcttgtgttcctaaaaaaagaatattttgggcctccccaaaaactttttttaaaaaaacttatattttggcacaaaaaacaccccgcggggggtttttttttta

SEQ ID NO: 32335 - DNA, 694 bp, Zea mays
  misc_feature: Ceres CLONE 1409463-F
  misc_feature (357)..(357): n is a, c, t, g, unknown, or other
  misc_feature (363)..(363): n is a, c, t, g, unknown, or other
  misc_feature (418)..(418): n is a, c, t, g, unknown, or other
  misc_feature (486)..(486): n is a, c, t, g, unknown, or other
  misc_feature (577)..(577): n is a, c, t, g, unknown, or other
  misc_feature (584)..(584): n is a, c, t, g, unknown, or other
  misc_feature (612)..(612): n is a, c, t, g, unknown, or other
  misc_feature (694)..(694): n is a, c, t, g, unknown, or other
tggcggccgctctagaactagtggatcccccgggctgcaggaattcgcacgagaccattacctagaacatcctaatcgaaaagcaagaggtaacactcgcgtctcattctcccgttcttgaggggcaatcgcgaatcgcgctcctcgcggtagcggtcgattacccggctccgcccagatccgccgcggctgcgctccagttccctgtcgcgtgcgtagggctcctcgtccctccctctatccccggctgtgtacggactggggatcggggatccctccggaccgggataggattttcgttttgctggcgaggaagggagcttcccccgatagatgtctcacctccgataccctggnatttcngtccgtggcgagtggctaccgcttctggctccttttgtgacagtgaaatctttgntggttcgaaggcgatttgacttgggtccacctggacgcggtgacgcccaatgagctcccacgctccancatttcgcggggtcttcatcccccaggcaggctttgggggacgttggactcacccccggtggcgtggcagccgccagcacctatggctcancccgagncaaggcccgcggtgatgaccaagaaggnccaggctggtttgtccggttgcttggaaatccgggactggtggatggtttccctgccgggtaccagtaaggggatttcaggn

SEQ ID NO: 32336 - DNA, 665 bp, Zea mays
  misc_feature: Ceres CLONE 1409465-F
  misc_feature (434)..(434): n is a, c, t, g, unknown, or other
  misc_feature (493)..(493): n is a, c, t, g, unknown, or other
tggagctccccgcggtggcggccgctctagaactagtggatcccccgggctgcaggaattcgcacgagaccattacctagaacatcctaatcgaaaaaaactagctgttagcctacctttcccctcccagccgtgggacgcaccaccctcagcctcccagctgccgcacacgtggaggctccacgcgaccacgcggcagcggcacgccggcacgcgcgccgcccggcgcccctcagcctcgcgccctcgccggccacgcgcctcagtcttgcgctctcgccgcgttaagccggtcagccttgcgggttgcggtctcgccgccgacgccgggcgccgggattgccggctgcccgccttgccggagacgggagacgccatgtccttgctgctcctgcccctctgtcgaacctccgcggaccgcgccgttccctggntggcggaagacgtcggaagaagtccctccgccggcacccgtcagacgcgccaccgcggngcccgctccccaggttcccctggtctggtccacaggttcagtgctcggggttgcgaaacacctggccatggtgaagcaggagttgaaaactcctccaggaatcaggggggatggggccccttctcgtgggggcggccaaccggggggggaacaaaaaacagaaagggccggc

SEQ ID NO: 32337 - DNA, 678 bp, Zea mays
  misc_feature: Ceres CLONE 1409468-F
  misc_feature: Encodes the peptide sequence at SEQ ID NO. 32338
  misc_feature (331)..(331): n is a, c, t, g, unknown, or other
  misc_feature (336)..(336): n is a, c, t, g, unknown, or other
  misc_feature (343)..(343): n is a, c, t, g, unknown, or other
  misc_feature (350)..(350): n is a, c, t, g, unknown, or other
  misc_feature (351)..(351): n is a, c, t, g, unknown, or other
  misc_feature (426)..(426): n is a, c, t, g, unknown, or other
  misc_feature (432)..(432): n is a, c, t, g, unknown, or other
aaagctggagctccccgcggtggcggccgctctagaactagtggatcccccgggctgcaggaattcgcacgagaccattacctagaacatcctaatcgaaaaagacaggaaaatcccaagttacgacgacttccccgagacgacggcgtaacaaggggggaaaaaaggaaaggggatcgccatggcagcgtcgccgcagcagcaaggccagggcggccctggcagcggcgggtggactcccgagcagttctggtcgctgctggacaaggcggaccgccggttcgcccgggtgcgagacctgccctcccttcggcgccaggagcccgacgangtcgncaagggnctccgcnngctacaccagctctggcggatgcagcaggagcaccgtcaccgtcttctcgacgcgggcctcgcccgctgggcagncccgcnagatcgccgcccgcatcgccccactctactacgtccagtaccagggaacccggcgacaacgcggtttctctccgagggggtgggctttctaccaagccggccttggaccggggctacttccaggagggcgaacaacaacctcggccccggcaaaaaacttccgtttcctggccaggttccctcctcggggaaatcctgggttgggggggggttgcacacccggcccggggtttccgcctgggaata

SEQ ID NO: 32338 - protein, 165 aa, Zea mays
  misc_feature: Ceres CLONE 1409468-F
  misc_feature (50)..(50): Xaa is any aa, unknown, or other
  misc_feature (52)..(52): Xaa is any aa, unknown, or other
  misc_feature (57)..(57): Xaa is any aa, unknown, or other
  misc_feature (82)..(82): Xaa is any aa, unknown, or other
  misc_feature (84)..(84): Xaa is any aa, unknown, or other
MAASPQQQGQGGPGSGGWTPEQFWSLLDKADRRFARVRDLPSLRRQEPDXVXKGLRXLHQLWRMQQEHRHRLLDAGLARWAXPXDRRPHRPTLLRPVPGNPATTRFLSEGVGFLPSRPWTGATSRRANNNLGPGKKLPFPGQVPSSGKSWVGGGLHTRPGVSAWE

SEQ ID NO: 32339 - DNA, 673 bp, Zea mays
  misc_feature: Ceres CLONE 1409469-F
  misc_feature: Encodes the peptide sequence at SEQ ID NO. 32340
  misc_feature (444)..(444): n is a, c, t, g, unknown, or other
  misc_feature (476)..(476): n is a, c, t, g, unknown, or other
acccgcggtggcggccgctctagaactagtggatcccccgggctgcaggaattcgcacgagaccattacctagaacatcctaatcgaaaagaagacgcttcccgagcttctccttcgttcctcctcttccccgcggctctcctctgccccgcaccggcaccgctagggttttgccgccgacctctcgctcgcttccgggctccgcgaggcaaccgtccggaccggccggtcgaaatggtggatggtggaggaggtcgggaacaagatgcaatcgcagatgcgcctgcacgcggagccggatgacgccgccgccgacctccccctcccggcgctcttcgacaggggcgtcgcggcttcacgccctggcctccagctccgccctcgaccaggatggatccggcacccggggttgagctgctgcggcgctgcgacgagattgtcggncagggctcggtcttttctcccccaagagaccnaagggacgacgtctccaccgcaaacctcaagtacctactcgtcccaatttacctttgcggaatgaccgaaaagatggcgcagggaagatccggatcccggtttctaagggcgcgcaaaccttttggaaggaagttcatgctctatgcgagtactagagttattccagaggtggagctagattgtcaaggcaaaagag

SEQ ID NO: 32340 - protein, 94 aa, Zea mays
  misc_feature: Ceres CLONE 1409469-F
  misc_feature (29)..(29): Xaa is any aa, unknown, or other
MDPAPGVELLRRCDEIVGQGSVFSPPRDXRDDVSTANLKYLLVPIYLCGMTEKMAQGRSGSRFLRARKPFGRKFMLYASTRVIPEVELDCQGKR

SEQ ID NO: 32341 - DNA, 686 bp, Zea mays
  misc_feature: Ceres CLONE 1409470-F
  misc_feature: Encodes the peptide sequence at SEQ ID NO. 32342
  misc_feature (488)..(488): n is a, c, t, g, unknown, or other
  misc_feature (490)..(490): n is a, c, t, g, unknown, or other
  misc_feature (493)..(493): n is a, c, t, g, unknown, or other
  misc_feature (494)..(494): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (588)..(588): n is a, c, t, g, unknown, or other
tccccgcggtggcggccgctctagaactagtggatcccccgggctgcaggaattcgcacgagaccattacctagaacatcctaatcgaaaaagatccattgttcacgacctcaccctattcagatcccaagcggccacgcccaagcccaaaccctacccacccatctcaaccagcgatgatggcagcggagccctcgccgtcggttccctccaccgccgctgaagacatggaaaccctcgccctcgactcatcctcttcgtccgccgccgctacggcctccgcctccgaccccctccttcggccacctacctccccgaccgccgccgcgagcgacgaccccttcgtcatcgacgacttcctcgacgaggacgacttcaccgccccggcgcccagcgtcgccggcccgccgcccgccgggcttggcgatgcggcgtccccagtgttccccaagatcaccgtatccgatcccaagaagcacgcgagctancnggnngggggtggctggccggtgtggattcccggggatccgggcagctacttttcttacctcatcaccaccccgttttgcggggcggggnnnnnggggnaaaaatcagggggggggggggcgcctcccgggggaaggggggggggccccccccgcggaagggcccttggccgacagcttccccgcggggttttaatt

SEQ ID NO: 32342 - protein, 170 aa, Zea mays
  misc_feature: Ceres CLONE 1409470-F
  misc_feature (104)..(104): Xaa is any aa, unknown, or other
  misc_feature (105)..(105): Xaa is any aa, unknown, or other
  misc_feature (106)..(106): Xaa is any aa, unknown, or other
  misc_feature (135)..(135): Xaa is any aa, unknown, or other
  misc_feature (136)..(136): Xaa is any aa, unknown, or other
  misc_feature (138)..(138): Xaa is any aa, unknown, or other
MMAAEPSPSVPSTAAEDMETLALDSSSSSAAATASASDPLLRPPTSPTAAASDDPFVIDDFLDEDDFTAPAPSVAGPPPAGLGDAASPVFPKITVSDPKKHASXXXGGGWPVWIPGDPGSYFSYLITTPFCGAGXXGXKSGGGGAPPGGRGGGPPRGRALGRQLPRGVLI

SEQ ID NO: 32343 - DNA, 671 bp, Zea mays
  misc_feature: Ceres CLONE 1409474-F
  misc_feature: Encodes the peptide sequence at SEQ ID NO. 32344
tggcggccgctctagaactagtggatcccccgggctgcaggaattcgcacgagaccattacctagaacatcctaatcgaaaagtgtcgtcttcctctccgccgcttctcctgtccaccctcgactgcttgcgcgtgacctgagccgccgccgcctacatccgctcatccccgcgcccgcctcaaccacgccgccaccgaccacgtataatcctgcctccccttcgcgcggtttcgaggctcgtttcctttgggatcgttcgtctgccccgaccgcgtgggcgcttcttcttcgggatctcgctggaccgagcggcccagggctagggattcaggcccatggcgtggcggcgcgtcctcacccagattgcaaggcatcgaccagcaaaagcaatctacaatgaactagttgcttcctcccccctttggggggttcttcgaagtgacatcacttcaggtgccaggattagacatttacaagagaggaaccagtcaagttacattggtagcttggcacgcccgggtccgagacttagattcaccaagcggaactctctgccttaagaaattttacagaaggaccccagagcgtgcatacaaaatatttgaaagccaaccttcattacttctatcctgagcaacttttcggaggatgaaagctctttgggaaggg

SEQ ID NO: 32344 - protein, 74 aa, Zea mays
  misc_feature: Ceres CLONE 1409474-F
MAWRRVLTQIARHRPAKAIYNELVASSPLWGVLRSDITSGARIRHLQERNQSSYIGSLARPGPRLRFTKRNSLP

SEQ ID NO: 32345 - DNA, 666 bp, Zea mays
  misc_feature: Ceres CLONE 1409475-F
  misc_feature: Encodes the peptide sequence at SEQ ID NO. 32346
  misc_feature (471)..(471): n is a, c, t, g, unknown, or other
  misc_feature (520)..(520): n is a, c, t, g, unknown, or other
  misc_feature (603)..(603): n is a, c, t, g, unknown, or other
gctctagaactagtggatcccccgggctgcaggaattcgcacgagaccattacctagaacatcctaatcgaaaactcgtctcgtctcgcacgcacccctcactttccttgtcaatcgactcgcgatcgaatccgccccgaggttccaaaccctagctttctctcatcctccacgaaccctagatccaaaatctaacacacgtcatcctcttattatcgccgtgcttgacgcttctctctgcagtcgattccgccgcggaccgaccggttcacttcccttttctcccgagatctcgactctcgagcaagtatgggtgaggcgaaggacaacgaggtgtacgaggaggacctagtcgactatgaggaggaggtggagaatgtcattgatggcgcccccaccaacggctcctcagatgtcgtcaagaaagggtacgtagggatcacccagctcgggttcagagacttcctgctncagccagagcttcttcgcgccatcagggattggcgggtttgagcatccnttctgaaagtgcacatgagtgcatcccctcagctatctttgggaatggatgtcatctgtcagcaaatctggaatggtgtagancgggcagtttttggtctgtcacttttcagaagattgagatcctggtgctgggcagtaactggt

SEQ ID NO: 32346 - protein, 67 aa, Zea mays
  misc_feature: Ceres CLONE 1409475-F
MGEAKDNEVYEEDLVDYEEEVENVIDGAPTNGSSDVVKKGYVGITQLGFRDFLLQPELLRAIRDWRV

SEQ ID NO: 32347 - DNA, 696 bp, Zea mays
  misc_feature: Ceres CLONE 1409476-R
  misc_feature (1)..(1): n is a, c, t, g, unknown, or other
  misc_feature (676)..(676): n is a, c, t, g, unknown, or other
ncgattgggtaccgggccccccctcgaggtcgacggtatcgataagcttttttttttttttttttggtctcaagaggaaatcatttaacatcgttctttttgaccgtgatatgacgaccaatatattggccacatcgatcatgcaatagctagcacggatgtacacttttggatgaaattgatcagaggaaagagaaattgaatgctgacaaacagcacttctactgttaaagttaatagcgcttcggaccactacagaaaaaaaatatgatatgacgacggcatcgcgggttgcattcccatgaaccccatccatccgcctggcggcgcgtgtccatccagccatccgtcgaccaaccaacaggtaggatgaaccgatcaatccatccatacagtatatgatgatcacgcaccttccccgtggactaattcattaatcactgtactttataccgcacagtgcggaaccgaattaaccccgcacgactcgctcgttgcagcaacttacccacccagccagaacccagtgaaacagtaacttgtactactaacttctctctctctccatttttttttacattccgtcgtcactcgtcacgcggatgtcgccgtctccgtcgtggcacgctccaccaaggctgtccgagagcggttcttcatgacgacggtgaatgcnaaggtctcgctgccgtcggg

SEQ ID NO: 32348 - DNA, 763 bp, Zea mays
  misc_feature: Ceres CLONE 1409481-F
  misc_feature: Encodes the peptide sequence at SEQ ID NO. 32349
  misc_feature (51)..(51): n is a, c, t, g, unknown, or other
  misc_feature (337)..(337): n is a, c, t, g, unknown, or other
  misc_feature (338)..(338): n is a, c, t, g, unknown, or other
  misc_feature (717)..(717): n is a, c, t, g, unknown, or other
  misc_feature (718)..(718): n is a, c, t, g, unknown, or other
aaactggagctccccgcggtggcggccgctctagaactagtggatcccccngggctgcaggaattcgcacgagaccattacctagaacatcctaatcgaaaaaagactccagtctcctctagccgtctcgcgcgcttcaccttccccaccccgccgccgccatcgcacgcccgcagccgcatccgctatgggtgcgtacaagtacgtctcggagctatggcggaggaagcagtccgatgtgatgcggttcgtgcagcgcgtgcgctgctgggagtacaggcagcagccggccatcgtccgcctcacaaggcccactcgcccctgggaccaaaggggnngggcgggcccggcccctccgggggtttaaccaagggccccaaagccaagggggttttattggtttggtttttacccggttggtcccccggggtataggggcggggggtgcgcaaaggaaaaaagggcctggggcccctaaaaggggtatttgggcccaattgggccaagcccaaaagcgcccccggggggttttcccccccccctttttcaagggtttcccaaagggagaaaaaaaaaagggccttttttttttttttaaaagaaaagagggtctttaaaaaaaaaaaaaagtttgtggggggagaacccacagggggtcccccacacaccccccccaggggggggggggagggggggggggacccccccccccccaannttttggggggaaaatttctcttgggggggggggtgtgggcccccc

SEQ ID NO: 32349 - protein, 59 aa, Zea mays
  misc_feature: Ceres CLONE 1409481-F
  misc_feature (51)..(51): Xaa is any aa, unknown, or other
MGAYKYVSELWRRKQSDVMRFVQRVRCWEYRQQPAIVRLTRPTRPWDQRGXAGPAPPGV

SEQ ID NO: 32350 - DNA, 681 bp, Zea mays
  misc_feature: Ceres CLONE 1409482-F
  misc_feature: Encodes the peptide sequence at SEQ ID NO. 32351
  misc_feature (417)..(417): n is a, c, t, g, unknown, or other
  misc_feature (518)..(518): n is a, c, t, g, unknown, or other
  misc_feature (519)..(519): n is a, c, t, g, unknown, or other
  misc_feature (569)..(569): n is a, c, t, g, unknown, or other
  misc_feature (570)..(570): n is a, c, t, g, unknown, or other
tccccgcggtggcggccgctctagaactagtggatcccccgggctgcaggaattcgcacgagaccattacctagaacatcctaatcaaaaaaccagagtcatcgcggcgtgttcaaatcccacaatcttcttgtagcacaccactgtcttcgtccaactcggcggcgatgtctgggcgcggcaagggcggcaaggggctgggcaagggtggtgcgaaacgccaccgtaaggttctccgcgacaacatccagggtatcacgaagccggcaatccggaggctggcgaggaggggcggcgtgaagcgtatctccgggcttatctacgaggagacccgcggcgtgctcaagatcttcctcgagaatgcatccgggcgacgcggtcacctacaccgagcacgctcgccgcaagacgccccgncccttgggaatggttggtgtacgcccctcaaagcgccaggggcgactctatagggattttttgggggggttgagcgcagctctttcctcgtttgcaggggnntgctggggggggctttcttcgtttcctcttgcgggttttggtttttgggnnaaaaaatttatcggataaaaaccccccaagggggtttcccaaatggggggggaaaatgggggccccccaggggtggagagctccgaaaaaaaaggggtttttttttttggg

SEQ ID NO: 32351 - protein, 100 aa, Zea mays
  misc_feature: Ceres CLONE 1409482-F
  misc_feature (84)..(84): Xaa is any aa, unknown, or other
MSGRGKGGKGLGKGGAKRHRKVLRDNIQGITKPAIRRLARRGGVKRISGLIYEETRGVLKIFLENASGRRGHLHRARSPQDAPXLGNGWCTPLKAPGATL

SEQ ID NO: 32352 - DNA, 602 bp, Zea mays
  misc_feature: Ceres CLONE 1409483-F
  misc_feature: Encodes the peptide sequence at SEQ ID NO. 32353
  misc_feature (289)..(289): n is a, c, t, g, unknown, or other
  misc_feature (330)..(330): n is a, c, t, g, unknown, or other
  misc_feature (473)..(473): n is a, c, t, g, unknown, or other
gctctagaactagtggatcccccgggctgcaggaattcgcacgagaccattacctagaacatcctaatcaaaaatatacagagcgagccagcacacagtttttttcataaggctggtctgcaattaggtgcctcgactgcttgctagccgccggattaatctttccctaccctaaggctcaggttttagtgggatatgatgaagctaaaaagtggacgacgaccgttctataaggatgttaagcctgtagactgccgttcaggctcaagtcttccacatttggctgctncagcaaagtttgcagccatgaacatgcagaatggagatgtncagcctcgtcgacccagttcagtcagacgaagtagatggggtcttggtgatgtaaccgaggtgttggatcataattcgtggaggcttggggaagaatacggaagttcttgagaatgggctattttggcatcccggtagggggntgcattccaacaggagaatccccctatccttggtttggggattcccctgattgcaagcattttcctgggtggggcgggacctttggaactgaaaaacgcccaccccatttgggggacgggcccctcccc

SEQ ID NO: 32353 - protein, 81 aa, Zea mays
  misc_feature: Ceres CLONE 1409483-F
  misc_feature (32)..(32): Xaa is any aa, unknown, or other
MMKLKSGRRPFYKDVKPVDCRSGSSLPHLAAXAKFAAMNMQNGDVQPRRPSSVRRSRWGLGDVTEVLDHNSWRLGEEYGSS

SEQ ID NO: 32354 - DNA, 655 bp, Zea mays
  misc_feature: Ceres CLONE 1409486-F
aaagctggagctccccgcggtggcggccgctctagaactagtggatcccccgggctgcaggaattcgcacgagaccattacctagaacatcctaatcgaaaaattcttttctgctgctgcgaccgtatgatcggcgtccagcagcctcggcgcgtcggtatggttttcccttggcccacacatcctagctcttccgcattcttgaatttcgtgtccgaggattagggtgtttctcgtgtgctggatcaatttcgcgctaatcgtactagtactgactcggattactcgccttgctgcgaggccgtctggtcttggaaggtagcagattgacgtgcgtcgtcgggggctgcatgacactaccgcttcgagttcatcatgtgaacgcctttctcaaacttactggcaactatggctttttccgggtgtatgaccggaaccccctcaggaagtcagcttggaaagaaacttcggccttttggatgggggggtggtattcttcccggccccccggttatttgtgcctttttaatggggcaaccccccgacccagggggaccttccccggcccgtttccaccccgggaaaaggggattatttttcggccccgcaaaagggggatcccgggcgaaggcccctgttcattgggggctctccc

SEQ ID NO: 32355 - DNA, 657 bp, Zea mays
  misc_feature: Ceres CLONE 1409489-F
  misc_feature: Encodes the peptide sequence at SEQ ID NO. 32356
  misc_feature (289)..(289): n is a, c, t, g, unknown, or other
  misc_feature (355)..(355): n is a, c, t, g, unknown, or other
  misc_feature (460)..(460): n is a, c, t, g, unknown, or other
  misc_feature (482)..(482): n is a, c, t, g, unknown, or other
  misc_feature (558)..(558): n is a, c, t, g, unknown, or other
  misc_feature (606)..(606): n is a, c, t, g, unknown, or other
  misc_feature (623)..(623): n is a, c, t, g, unknown, or other
tggagctccccgcggtggcggccgctctagaactagtggatcccccgggctgcaggaattcgcacgagaccattacctagaacatcctaatcgaaaagctggtgcttctacggggcctggcgatttgaattcgagtggtgcgtgtatagagcgtgagagagagaaaagagagtggctcttgcgctctgcagtccagttcttgaatccagagctgcgattcgtgctcgcctgacgccgatgggccggagcctgagcccgctgctacggcaggagctggacaacctggacnaggacgctgacagccgccgcgcccgcatgaaggcgctcaagtcgtacgccagacacctggactccnagtccatcccgcacttcctcgccgaggtctccgacaccaccgcggccggcgccggcgccggcagcggcatgcccaccggcggcgagttcaccatctcgctctacnagggtgctgcgcgggtgcacgncccgcacatcgtgccgcagatcggcacatcatggccaccatcatgtgcacgctctcctccagcgggggctcctttncccgctcacaggctggtccaaggtggtgccggcatcgcgcggaacggnatcgaccctccgcgccngacggggagaagccggcatcatcgcctcctctgg

SEQ ID NO: 32356 - protein, 140 aa, Zea mays
  misc_feature: Ceres CLONE 1409489-F
  misc_feature (18)..(18): Xaa is any aa, unknown, or other
  misc_feature (40)..(40): Xaa is any aa, unknown, or other
  misc_feature (75)..(75): Xaa is any aa, unknown, or other
  misc_feature (82)..(82): Xaa is any aa, unknown, or other
  misc_feature (107)..(107): Xaa is any aa, unknown, or other
  misc_feature (129)..(129): Xaa is any aa, unknown, or other
MGRSLSPLLRQELDNLDXDADSRRARMKALKSYARHLDSXSIPHFLAEVSDTTAAGAGAGSGMPTGGEFTISLYXGAARVHXPHIVPQIGTSWPPSCARSPPAGAPXPAHRLVQGGAGIARNGIDPPRXTGRSRHHRLLW

SEQ ID NO: 32357 - DNA, 659 bp, Zea mays
  misc_feature: Ceres CLONE 1409491-F
  misc_feature: Encodes the peptide sequence at SEQ ID NO. 32358
  misc_feature (433)..(433): n is a, c, t, g, unknown, or other
tggagctccccgcggtggcggccgctctagaactagtggatcccccgggctgcaggaattcgcacgagaccattacctagaacatcctaatcgaaaaagctaggttcctatgcccaaagtcacacagcttcttctccttctacttctccttcctcctctcctcaccggcaccttgatctaatctcttccatcctagcttgctcgccgctgccagtctctcctccgcctgcaacgactcccatgtctcagtcttctcctctcttctccgtcgcccgagcgcacgccggagcaggagggcgagccgtggcagccgctctcctgctccgtcgtcgccccattgcacagctgccgcacagcatccatgggctacggtgtctctctccagccagagcgacaccttccaagacgctcctcagcctcccccgcgccacgntgtcctccttcgccgaccccgacggcgacggcggctccagcgcgaaagccagcgacggcggcccaaggcccgcgccggcggggaggagcaggtcgggaaatgcagactgtcgagatggcccaggcgttcacatctcggcaggggtggcgacgtcatctccgtgacgatcgcgttcgcgccctcaccgtgccgctggagatgccctcgctgttctgcacgggacctt

SEQ ID NO: 32358 - protein, 118 aa, Zea mays
  misc_feature: Ceres CLONE 1409491-F
  misc_feature (65)..(65): Xaa is any aa, unknown, or other
MSQSSPLFSVARAHAGAGGRAVAAALLLRRRPIAQLPHSIHGLRCLSPARATPSKTLLSLPRATXSSFADPDGDGGSSAKASDGGPRPAPAGRSRSGNADCRDGPGVHISAGVATSSP

SEQ ID NO: 32359 - DNA, 672 bp, Zea mays
  misc_feature: Ceres CLONE 1409494-F
  misc_feature: Translation starting site: 173
  misc_feature: Pfam Name: ANTH Pfam Description: ANTH domain
  misc_feature (364)..(364): n is a, c, t, g, unknown, or other
  misc_feature (472)..(472): n is a, c, t, g, unknown, or other
tggcggccgctctagaactagtggatcccccgggctgcaggaattcgcacgagaccattacctagaacatcctaatctaaaaaaaaaaaacccgaatcatacggccagaaatattaaacagacagaaaggaagaggagaatagcggcgaggacgaagtggcccgcccaggaaatggcgtcgatgcagagctggcgcaaggcctacggcgccatcaaggacaccacaaccgttagcctcgccaacctcaactcggacttcaaggatctggatgtggcgatcgtgaaggcgactaatcacgtggagtgcccacccaaggagcgacacctgcgaaaggttgttgcggcgacatccatcgccaggccntagggcggatgtcgcctactgcatccacgcgcttgcccgccgtcttgccaagaacccgcaactggattgttgctctgaaagcacttgtagtaatccatagacttcttncgtgagggtgatcctacatttcgagaagagcttcttaactttacacaaagggggcgtattctgcaactttcaaactttaaggatgactccagtccattgggcttgggattgttctgcctgggcgaccaaatattgggtttgtttttgaagaaaagggtgaaggggtccttcaaggatttcaaaaaattggatgttaaacc

SEQ ID NO: 32360 - DNA, 701 bp, Zea mays
  misc_feature: Ceres CLONE 1409498-F
  misc_feature: Encodes the peptide sequence at SEQ ID NO. 32361
  misc_feature (414)..(414): n is a, c, t, g, unknown, or other
  misc_feature (453)..(453): n is a, c, t, g, unknown, or other
  misc_feature (462)..(462): n is a, c, t, g, unknown, or other
aagctggagctcaccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggccccggccacatccaagccgccgcctccggccccggccacacccaagccgccgcctccggccccggncacacccaaagcgccgccagcgggggaggaaaagggcgntggcgccgntggtggacctcacgggcgtcccggggagggtaaacgggaaggccccgcggtttgcggaaaaaaggggggcacggaagggggccccaatgacgggggcccaggggggggccaaaattcacgtggttttaaatcccccgggaaaagcgccccgaaccctcggcaaaaggaaaaaaaaattcttttttggggaggttgtgggccccccccccaaagggggacccttggggggtggtgtatat

SEQ ID NO: 32361 - protein, 157 aa, Zea mays
  misc_feature: Ceres CLONE 1409498-F
  misc_feature (62)..(62): Xaa is any aa, unknown, or other
  misc_feature (75)..(75): Xaa is any aa, unknown, or other
  misc_feature (78)..(78): Xaa is any aa, unknown, or other
MGAVTSTVAARFAFFPPSPPSYGFEQPAPLPAPATPEPPAPATSKPPPPAPATPKPPPPAPXTPKAPPAGEEKGXGAXGGPHGRPGEGKREGPAVCGKKGGTEGGPNDGGPGGGQNSRGFKSPGKSAPNPRQKEKKILFWGGCGPPPQRGTLGGWCI

SEQ ID NO: 32362 - DNA, 725 bp, Zea mays
  misc_feature: Ceres CLONE 1409499-F
  misc_feature: SWISSPROT Homolog: EC 2.7.11.1 Non-specific serine/threonine protein kinase
  misc_feature (579)..(579): n is a, c, t, g, unknown, or other
tccccgcggtggcggccgctctagaactagtggatcccccgggctgcaggaattcgcacgagaccattacctagaacatcctaatcgaaaaatccgctcgtccttcagccgctcccaaccctagccacgcaggaactcacagccccgccgctcctcgcctccatcccaccctcttgttccccactttgcgttgtgccacgacgctccgggcatgcatggaggccgcaatagatccaggagatcgcttgggggcggcgggcaggcaaaggaggtcactcgctgggtttgctagcgtgggggacactagtgcgacagcttgtacaaggcgacgagactgcacggcgtgctcctggaggtggcgcatgtgcccttcctcaaggaccgctatgcactgtgcctgcagctcgagtgcatccagttcggcatcattcgctcctgctccgacctcgtcacgggcaaggcgctggcctgcaagtccatcgccaagcccaacatcgtcgcctcaaagccgtgtacgaggaccgcgattccgtgcactcatcatggagctctgcggctggtggggagctcttccatcgnctgcgagagcgcgacggcttctcccaggggaggaaaatccctcatgggggagggaaaaacgagcaggggaaatgtgaccatatctagcattgatggaaaaaataataaattatgctagggcagagcaccacctaaaaaaagggcgt

SEQ ID NO: 32363 - DNA, 709 bp, Zea mays
  misc_feature: Ceres CLONE 1409501-F
  misc_feature: Encodes the peptide sequence at SEQ ID NO. 32364
  misc_feature (479)..(479): n is a, c, t, g, unknown, or other
  misc_feature (483)..(483): n is a, c, t, g, unknown, or other
aaagctggagctccccgcggtggcggccgctctagaactagtggatcccccgggctgcaggaattcgcacgagaccattacctagaacatcctaatcaaaaaacaactcccccaatccgtcccgtcggccggacgaggagggcccaagggcccaccttaccatggcgaccgccactgccgcccccgtccccgccggcggccacccgtaccgcctcgcccgcactcgctgcggcccaccgcgcctgcaccgcctgcgcttcccggccgcagcagcagccgcttcgtcttccctgcccgccccgtcgtccatgctgccaccgctgccagatggaggcgggcggctggtggcggagctggtgtgcgcgttcaacgagctcacggagcggatgggggaggacctggcgacgtcctcctcgtcgagcctgctcttccgtgtgctgaagctggcgctccccgccctccgcgacgtggagggcggncggncactcgcacgcgcgctcgccgtcgccgcgaccctcgctgacctccagatggatgctgaaggcatatcagccggcatactaagagaaggattagatgcaggagcttaagaatggggatgaaaaaacccagatggggaatcagacagctcatttggtggatggccggttaaggattaagcatggtccctccaagcttgacgaattggaaggacgaagggggcaaccct

SEQ ID NO: 32364 - protein, 142 aa, Zea mays
  misc_feature: Ceres CLONE 1409501-F
  misc_feature (108)..(108): Xaa is any aa, unknown, or other
MATATAAPVPAGGHPYRLARTRCGPPRLHRLRFPAAAAAASSSLPAPSSMLPPLPDGGGRLVAELVCAFNELTERMGEDLATSSSSSLLFRVLKLALPALRDVEGGRXLARALAVAATLADLQMDAEGISAGILREGLDAGA

SEQ ID NO: 32365 - DNA, 709 bp, Zea mays
  misc_feature: Ceres CLONE 1409502-F
  misc_feature: Encodes the peptide sequence at SEQ ID NO. 32366
  misc_feature (583)..(583): n is a, c, t, g, unknown, or other
  misc_feature (589)..(589): n is a, c, t, g, unknown, or other
  misc_feature (605)..(605): n is a, c, t, g, unknown, or other
agagctggagctccccgcggtggcggccgctctagaactagtggatcccccgggctgcaggaattcgcacgagaccattacctagaacatcctaatcgaaaaacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcctgcgtccgagcgagcgggtcgaggtacggcggaaccgctacaaggtggcggttcacgcgtaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggttagtggggtttattcggatgataataaccttcagcttgaggccaccacacagttccgcaaattgctctctatagagaggagtccccccatcgaagaagntatcanaacaggtgtagttccnagatttgtgcagtctctcaccagagaggatttcccccagctgcagtttgaagctgcatgggctctcacaaatattgcttctggcacttcaaaaaaaacaaaggg

SEQ ID NO: 32366 - protein, 117 aa, Zea mays
  misc_feature: Ceres CLONE 1409502-F
  misc_feature (69)..(110): Pfam Name: Arm Pfam Description: Armadillo/beta-catenin-like repeat
  misc_feature (1)..(60): Pfam Name: IBB Pfam Description: Importin beta binding domain
  misc_feature (76)..(76): Xaa is any aa, unknown, or other
  misc_feature (78)..(78): Xaa is any aa, unknown, or other
MVEIRKSRREESLLKRRREGLQAQVPAPPSGVEKKLESLPAMVSGVYSDDNNLQLEATTQFRKLLSIERSPPIEEXIXTGVVPRFVQSLTREDFPQLQFEAAWALTNIASGTSKKTK

SEQ ID NO: 32367 - DNA, 676 bp, Zea mays
  misc_feature: Ceres CLONE 1409503-F
aagctggagctccccgcggtggcggccgctctagaactagtggatcccccgggctgcaggaattcgcacgagaccattacctagaacatcctaatcgaaaagttttctccccgtttggactgccctcctatctctatgtcatcgcctgacaataagaatcttcatcgccgtctcctctttctccgtgctaccaaaagcctccccgcattgagagccaaagaagaaaaaaaaaaaaggcaggaggccgtgaaactacgcgaggaaaaattttctttcccgggaggctcgggagtcaggcacgccacatgctttggtcaaaatcgtttccggtggctagcgcggctgctgctgctgctgctgtcgggggccaccaggaaggagagctaacgcaattgtacagctcataaataggatacgcatgagagagcctgagtgaaggcacctgagtacgtgtgtaagagaccgtgcgacatcagcgaacaactcatatcgagatgactgcactcaggactctggatatcgaccctgtccgcacgcttacgttactacgcggcgcatgtcagattgagtcaacaatagtactgggatgccgagacgaacagctggagatgccctcttacgtatgagcggacatggaaacgtcagttgtagatggcgcctatgctcggaatactcg

SEQ ID NO: 32368 - DNA, 659 bp, Zea mays
  misc_feature: Ceres CLONE 1409504-F
  misc_feature: Encodes the peptide sequence at SEQ ID NO. 32369
ggagctccccgcggtggcggccgctctagaactagtggatcccccgggctgcaggaattcgcacgagaccattacctagaacatcctaatcgaaaaaaaccctacccacagccaccgccgccgccgccgctccctgacccctagtgtccggatttaacttcaaacatggcggacgtcgatgtcgagccggaggtcgccgccggtgctcccaagaagaggacgttccgcaagtacagctaccgcggcgtcgacctcgatgcgctgcttgacatgtccaccgacgacctcgttcagctcttcccagcgcgcgccaggagaaagttccagaggggtttgaagaggaagcccatggcgctcatcaagaagctgcgcaaggcgaaaaaggatgctcctgtcggcgagaagccagagccagtgaagacccatctcccgcacatgatcattgtccccgagatgatgggcagcattgttggtgtctacaatggcaagacctttcacccagttgagatcaagcctgagatgattggccactatcttgcagagttctccatttcctacaagccggtcaagcacggtaggccccggtattggtgccctcacctcctcgcggtttatccctctgaaatgaggtgttacccagatctgtagcggtccaaggg

SEQ ID NO: 32369 - protein, 160 aa, Zea mays
  misc_feature: Ceres CLONE 1409504-F
  misc_feature (55)..(136): Pfam Name: Ribosomal_S19 Pfam Description: Ribosomal protein S19
MADVDVEPEVAAGAPKKRTFRKYSYRGVDLDALLDMSTDDLVQLFPARARRKFQRGLKRKPMALIKKLRKAKKDAPVGEKPEPVKTHLPHMIIVPEMMGSIVGVYNGKTFHPVEIKPEMIGHYLAEFSISYKPVKHGRPRYWCPHLLAVYPSEMRCYPDL

SEQ ID NO: 32370 - DNA, 496 bp, Zea mays
  misc_feature: Ceres CLONE 1409506-F
  misc_feature: Encodes the peptide sequence at SEQ ID NO. 32371
ccccgcggtggcggcgctctagaactagtggatcccccgggctgcaggaattccacgagaccattacctagaacatcctaaaaaaaaaggattctgccttcttctctcatcttcctgctcaacatcagtagcagctttagctgtagcagcgccaccggccaccgccacgccatggccaccacggtggacaagcccctgggggcgatcaccgttgacgacctccccgggggggggcctggggtcggaagcccacgggttccaggaaggttccgggggggtttaattcgagggcccccccaaaggggggggggtttttggggccccgggttttttccccttggcccccttcccccccccgggggggctaaaaaagggggttttcccgggggtttcccttttccccagcgcggggtgggggcccccacccccagggggggggttgtttaaaaaaaggggggggcggggctcccagaggggggggggggagagatatttc

SEQ ID NO: 32371 - protein, 91 aa, Zea mays
  misc_feature: Ceres CLONE 1409506-F
MATTVDKPLGAITVDDLPGGGPGVGSPRVPGRFRGGLIRGPPQRGGGFWGPGFFPLGPLPPPGGAKKGGFPGGFPFPQRGVGAPTPRGGVV

SEQ ID NO: 32372 - DNA, 767 bp, Zea mays
  misc_feature: Ceres CLONE 1409515-F
  misc_feature: Encodes the peptide sequence at SEQ ID NO. 32373
gtcacgcccacccccccttctccatctagcccacccccgccccatctccaaagtggcagctcacgcggtggcggccgctctagaactagtggatcccccgggctgcaggaattcgcacgagaccattacctagaacatcctaatcgaaaagccacctctaccactggcctcaatctgcaaaccctagccctcgtcgccggcggccatggccgagaccgtcgacgacaaggtcagctactttcaggccgtcaccggcatctccaacacggacctctgcacggagatcctcgccgcgcacaactgggacctgcagctcgcggtgtccaccatcaccgccaacccctcctcgccctccgcttcggcctccacctcctcgcgtgacccggccccttccgctccgttggcggtagatgcggagtacgtcgcgcccccgccgccgctgccgctgccgctgccgccccagcagcagccggggatcgcgtggaagctggtgacgctccccttccacgtggtctcgggtggggtcggcctcgtcgccggcacgttccgccttggcgcctgggtagccgggggcgtgctgtcccgctccctctccctcctcggcctcgcggggcaagccggcagcggtgaccgcctgctaaagttgccgccgtcagctgacgaggcggccgacttcctccctggagtccaacgcgagttcggcgctggccgcggcccgcgcttcatgggccgaggggttcgctgaaggcctgaaaccgaacgcaacg

SEQ ID NO: 32373 - protein, 179 aa, Zea mays
  misc_feature: Ceres CLONE 1409515-F
MAETVDDKVSYFQAVTGISNTDLCTEILAAHNWDLQLAVSTITANPSSPSASASTSSRDPAPSAPLAVDAEYVAPPPPLPLPLPPQQQPGIAWKLVTLPFHVVSGGVGLVAGTFRLGAWVAGGVLSRSLSLLGLAGQAGSGDRLLKLPPSADEAADFLPGVQREFGAGRGPRFMGRGVR

SEQ ID NO: 32374 - DNA, 720 bp, Zea mays
  misc_feature: Ceres CLONE 1409517-F
  misc_feature: Encodes the peptide sequence at SEQ ID NO. 32375
  misc_feature (480)..(480): n is a, c, t, g, unknown, or other
  misc_feature (504)..(504): n is a, c, t, g, unknown, or other
  misc_feature (505)..(505): n is a, c, t, g, unknown, or other
  misc_feature (520)..(520): n is a, c, t, g, unknown, or other
  misc_feature (628)..(628): n is a, c, t, g, unknown, or other
caaagctggagctccccgcggtggcggccgctctacaactagtggatcccccgggctgcaggaattcgcacgagaccattacctagaacatcctaatcaaaaaaagtcccaatccaccgacgaattccaaaccctgcctaggacctcggcgccactcgccgcacgtcgtccacgtccgcctccaccccaatccgatgggctatgaagagagcaaaaaacatctcctcagtctcagctaccctgagctgcaatgtttgtgcaaaaggtataaccttcctgctaagaagacccactctcagttagcaagttcgctcgcctcgctgcttgaggcatctccatctcctgctcctcctcctgtccaattagcaaatatgaaagaagcatccacatgcaatcatgctaacaacaaaagaggcccatacaatgggcagggatgatggtaaaccacttgtgcatgcgaaacatcaaaaaggagatcangacacctgttgatgaacatctaannaaggggattgacacntggtacgagtatacctccagtttctagaaaccatggaagaccagaatatcatggccatctatcttctgacctgagaactgctcataattacagccccaaatggaacgntgggaattgcaactaatacacaaatcctagaatttgttggcaaaacatgattgttcacctgctaacgtaatttgatcaaatctgtcccccta

SEQ ID NO: 32375 - protein, 80 aa, Zea mays
  misc_feature: Ceres CLONE 1409517-F
MGYEESKKHLLSLSYPELQCLCKRYNLPAKKTHSQLASSLASLLEASPSPAPPPVQLANMKEASTCNHANNKRGPYNGQG

SEQ ID NO: 32376 - DNA, 703 bp, Zea mays
  misc_feature: Ceres CLONE 1409518-F
  misc_feature: Encodes the peptide sequence at SEQ ID NO. 32377
  misc_feature (607)..(607): n is a, c, t, g, unknown, or other
tggagctccccgcggtggcggccgctctagaactagtggatcccccgggctgcaggaattcgcacgagaccattacctagaacatcctaatcgaaaaattcctgtctcggttccctcttcccggcgcaccagcctacctcgccgacgccaggccgccaggccgccggagacatgaaccagcccgtgcagaagaacaccctctacgtcggtgggctggcggaggaggtggacgagaaaatcctgcacgccgcgttcgtgcccttcggtgaggtcaaggacgtcaagacgccgctcgaccagtccacgcagaagcaccgctccttcggtttcgtcaccttcctggagcgcgaggacgccgccgctgccatggacaacatggacggcgccgagctcttcggccgcgtgcttaccgtcaactacgccttcccgagcgcaatcaaagggagggaaccaaggaatgggctgcccagccaatctgggccgatgcggacactttgggttcgagaggagcagcaggaaagaggagatgcagcggctgcaggcagagcaccgcgccagcgaggcaggcaagcagagaagctgcacaggggagaaactggccgtttgnaaagggaaggcgaaaaaagaaagagattccctgggctggcgcagagggctcaggtgtgggaaacaaaagttcctaaggaacccggatattacttcc

SEQ ID NO: 32377 - protein, 177 aa, Zea mays
  misc_feature: Ceres CLONE 1409518-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (146)..(146): Xaa is any aa, unknown, or other
MNQPVQKNTLYVGGLAEEVDEKILHAAFVPFGEVKDVKTPLDQSTQKHRSFGFVTFLEREDAAAAMDNMDGAELFGRVLTVNYAFPSAIKGREPRNGLPSQSGPMRTLWVREEQQERGDAAAAGRAPRQRGRQAEKLHRGETGRLXREGEKRKRFPGLAQRAQVWETKVPKEPGYYF

SEQ ID NO: 32378 - DNA, 2381 bp, Zea mays
  misc_feature: Ceres CLONE 1409519
  misc_feature: Encodes the peptide sequence at SEQ ID NO. 32379
accgaaattcccgttcttctcgcctcccctgcagccgacgaccgcggcggcggcggcggtccgagaagaatcagccgccgtgcaggcgcattaccctctcctcgtccatctaggtccagcggaaggggaggaaaaggcgaaggcgggggcaagtcaatcgaccctcctcgccgcctgatcgcgcgccttcgccaccgccgatgctgcggcgccgtccatggcgtcggcgctgctctcgtacctgcaggccctgtggccgttctctgccctcctgagggaggaggacgacctacgcgcgtcagcgcggctggtcgggtcgctctctgtgccggaggagacgaagcagttcgtgctcgcgctccgggagcccggcgggtcgccgcacgaccggcaccgggacggcgctggcgtgatctacatcctcgccgcgcagaatctgtcggagcagtccgcctcggacgccgagcgcctgatcagggaggtgcgaccgagggccgtggtcacccaggtcgcgcgtccggccctcgaagacgtccggatcgaagaggattgcctggcaggcaatggaggcgggggcgtgccggtaccggcgtcgccgtttcaggtgatcaagcggtgcgtcaccgagaagaggagcagggaccagtacgtgaaggctgccgcgtgccaggtcctgcaggagattttcggggtcggtttctatggccatctgctcgctgccaagagagccgccgaggagacggggtcgtgttttctattgcttgagtctccctatgagaggaattgtggcggcggtggatcggccagccagaatagtactgcagacgataactcagctcagtcattacaggctagctgctcgctagctcacatcaccatggatgatgcctcaggtttgcaattgcaggctaactgcttgacccccaggagcgccacttcaattgtgagctcccatggtaggagtatatgccttatggatgataatggaggacaactcttgaagtcactggcaccaactcttaatttcttgatgtcccaagcagccccctccaatgctgccactgagtgcaggccatctgaatgcaagttgattgacagatatgaagctccaccatttgctcagtctgtctaccctttacttgctgatctttatcatatatttgctgatattccatcgattggtagggctatggtttctgctcagaagttgcttacacaagttcacaagggggagccaatcagcagtgatatgttgtctgatgtgtatgtatttagaattgcaatagaagccctcaggatgggcttaaacagtgcagccaggtcccaaattgataccggagataaacatggctcaaatgatctggatttttcaaaactccaatctgatgagaagtgccacattcttcttgtgcaagctctcaggagtcaactaagagagtttggttctgtggtggctatagttgacgcgagctgcttagctggaataaggagacattggaacacccctgttccttcagaaatcactcaattagctagcagatgcttcaatcactatggtgctgaaaatgatgataaaattgaggtaccttcagcagacgacactgacaaaaaaagttggatatctgagaaacctgtggttgctgttggtgcaggagggacagcactcctgggcttttcatcattatcgaaatctcttcaggcttctgccttccttaagatggccccttacaaaagtccagcggttctgaagtatggattaatgcagctccaaagacatgctgctattgtattaagcaagatactccctcacggggttgttaccgctggctcgaaggcttctgctttgcagttcacggcttcagcagagaagattcgagcggtcacgcataccgtaatatcatcggccgagagaacaagcttattggttatgcggacttcattctacgaaataatgcagaagaggcacaggcagcctttcagaatatttccttgggcaacatttggctgcagcatggctgcatgtgctggccttgtgatgcatggagatgggatcgagtgcgcagccgaggcagcaccttctgttcccatgattgcttctctgggccgcggcctcgagagcttacgtctgacatcccaggaggtcagacaaacgaagggccaaaacgtgaaagaagctttgcgagcattaatgagcagcttgaagaaatcagcaaaataaagggccagcacttcacaactggagctgtatggatttttgtcttgcgatttgggggcaagactagaattatcgtaactgtaaagtgcactttccttgtttgccgcgatagtgaaattatgtgattatgcttgttagcgtggctagctcaaaaaaaaaaaaaaaa

SEQ ID NO: 32379 - protein, 666 aa, Zea mays
  misc_feature: Ceres CLONE 1409519
MASALLSYLQALWPFSALLREEDDLRASARLVGSLSVPEETKQFVLALREPGGSPHDRHRDGAGVIYILAAQNLSEQSASDAERLIREVRPRAVVTQVARPALEDVRIEEDCLAGNGGGGVPVPASPFQVIKRCVTEKRSRDQYVKAAACQVLQEIFGVGFYGHLLAAKRAAEETGSCFLLLESPYERNCGGGGSASQNSTADDNSAQSLQASCSLAHITMDDASGLQLQANCLTPRSATSIVSSHGRSICLMDDNGGQLLKSLAPTLNFLMSQAAPSNAATECRPSECKLIDRYEAPPFAQSVYPLLADLYHIFADIPSIGRAMVSAQKLLTQVHKGEPISSDMLSDVYVFRIAIEALRMGLNSAARSQIDTGDKHGSNDLDFSKLQSDEKCHILLVQALRSQLREFGSVVAIVDASCLAGIRRHWNTPVPSEITQLASRCFNHYGAENDDKIEVPSADDTDKKSWISEKPVVAVGAGGTALLGFSSLSKSLQASAFLKMAPYKSPAVLKYGLMQLQRHAAIVLSKILPHGVVTAGSKASALQFTASAEKIRAVTHTVISSAERTSLLVMRTSFYEIMQKRHRQPFRIFPWATFGCSMAACAGLVMHGDGIECAAEAAPSVPMIASLGRGLESLRLTSQEVRQTKGQNVKEALRALMSSLKKSAK

SEQ ID NO: 32380 - DNA, 730 bp, Zea mays
  misc_feature: Ceres CLONE 1409521-F
  misc_feature: Encodes the peptide sequence at SEQ ID NO. 32381
  misc_feature (534)..(534): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (645)..(645): n is a, c, t, g, unknown, or other
  misc_feature (662)..(662): n is a, c, t, g, unknown, or other
ggtggcggccgctctagaactagtggatcccccgggctgcaggaattcgcacgagaccattacctagaacatcctaatcgaaaaacaatccacccgcgtcggcacgagcacccacagcagttggcgcgcaccaaaaccctaccctccctctgctctcagccgccaacgccatgggctccaccgccgctgcctccgtgctcccggtgtccgccggctccggcgagaacctcgtcctcatcctcgactacggctcgcagtacacgcacctcatcacccgccgcgtgcgccagctcggcgtcctctccctctgcgtgtccggcacggcgccgctcgcctccctggagggcctccgcccacgcgccgtcatcctctccggcgggccccactcagtccacgcccccggggcgcccgccttccccgagggattcctgggcttcgcggctgccgcgggcgcgcacgtgctcggcgtctgctatgggatgcagctcctcgtgcagtccctcggagggcgcgttgtgtccggggagcgccagnagtacgggaaaatggacgtnnngagtgacgcggcctcctccgcgctctacgggcagggcgaagaccgggaagcgccagaacggtgtggatgagccatggcgacgagttggntaagctggcggaaaggntcgagggtgttgctcgcagcgtgcaaggagccgtcgccgccattgagaacgggagaaatcgctttatg

SEQ ID NO: 32381 - protein, 151 aa, Zea mays
  misc_feature: Ceres CLONE 1409521-F
  misc_feature: SWISSPROT Homolog: EC 6.3.5.2 GMP synthase (glutamine-hydrolyzing)
  misc_feature (122)..(122): Xaa is any aa, unknown, or other
  misc_feature (129)..(129): Xaa is any aa, unknown, or other
MGSTAAASVLPVSAGSGENLVLILDYGSQYTHLITRRVRQLGVLSLCVSGTAPLASLEGLRPRAVILSGGPHSVHAPGAPAFPEGFLGFAAAAGAHVLGVCYGMQLLVQSLGGRVVSGERQXYGKMDVXSDAASSALYGQGEDREAPERCG

SEQ ID NO: 32382 - DNA, 674 bp, Zea mays
  misc_feature: Ceres CLONE 1409522-F
  misc_feature: Encodes the peptide sequence at SEQ ID NO. 32383
  misc_feature (637)..(637): n is a, c, t, g, unknown, or other
aagctggagctccccgcggtggcggccgctctagaactagtggatcccccgggctgcaggaattcgcacgagaccattacctagaacatcctaatcgaaaaaaccccaccagaccttcaaccgctacatttccgtcactaccggagccgccactccgacgaacgcgggcggcggagcggaagcgaaccagagcaccggtgaaaagaataggatgaggcttgggagtataaacggcttgcggttcacgcagcttaaacttgtcatccttgcgttcttcatgttgtttgttctctggaaatgggagaagggctcgtcatactacgattccgaaatcctccagccagatgcgttggttctgactcatcccgctaactcgaagtttgtagaccagcacacatccccagaagaagactttccaagtgcagatcgatcacaccggtcagtaggtaaagtagaacagccggttactagtgcgctgccaccattgtctacgataggctattctgttgatgttgcagatgggaatgaagtgccacctcctgagaagaaagaatgcgagtacaggaatgtgaagtgtgtttctgacaatcgtagacactatactcagggtttggttgtaagcatggctttcagagangtgtactgcagactatccagcgaaagatttcgcgtag

SEQ ID NO: 32383 - protein, 154 aa, Zea mays
  misc_feature: Ceres CLONE 1409522-F
  misc_feature (142)..(142): Xaa is any aa, unknown, or other
MRLGSINGLRFTQLKLVILAFFMLFVLWKWEKGSSYYDSEILQPDALVLTHPANSKFVDQHTSPEEDFPSADRSHRSVGKVEQPVTSALPPLSTIGYSVDVADGNEVPPPEKKECEYRNVKCVSDNRRHYTQGLVVSMAFRXVYCRLSSERFRV

SEQ ID NO: 32384 - DNA, 693 bp, Zea mays
  misc_feature: Ceres CLONE 1409526-F
  misc_feature: Encodes the peptide sequence at SEQ ID NO. 32385
  misc_feature (677)..(677): n is a, c, t, g, unknown, or other
  misc_feature (679)..(679): n is a, c, t, g, unknown, or other
tccccgcggtggcggccgctctagaactagtggatcccccgggctgcaggaattcgcacgagaccattacctagaacatcctaatcgaaaaaggtcgacgcatcttcgcctccgctcaacgctcgcccacgcccgccgcccccccaccgatccacgagaaaccttctcgcctccgcgggacgattcgccagggagagcaaaggtagcagaggcgccatggacgctgccaagtcggtgacgccgggcgccgtgtcctacatcctggcgcacccgtctacgggctccaatggcgccgtgtcggatctcgtcgttcaggtcctcgatctcaagtccatcggcatgggcagccggttcagtttcacggcaaccgatgggaacgacaaaatcaaggcgatgctccccacttactttgccgtcggaggtccactccggcaatctgaaagaatttcggtctcatccgcatcctcgactacacttgcaactccgtcaaaggcaacggctgaaaaagtccctgattgtcgtcaaatggcgggactgtgtgcgaagcgtccgacgccgagatccaacggcgaggccaaagaaagaggatccctcccattgtgctgaagcttaaagacgaagggttcagtccgggggtggaggaaacaaattctcccccccttcgtgatgagcctaancngaggaaggggaagt

SEQ ID NO: 32385 - protein, 129 aa, Zea mays
  misc_feature: Ceres CLONE 1409526-F
  misc_feature (6)..(89): Pfam Name: Rep-A_N Pfam Description: Replication factor-A protein 1, N-terminal domain
MDAAKSVTPGAVSYILAHPSTGSNGAVSDLVVQVLDLKSIGMGSRFSFTATDGNDKIKAMLPTYFAVGGPLRQSERISVSSASSTTLATPSKATAEKVPDCRQMAGLCAKRPTPRSNGEAKERGSLPLC

SEQ ID NO: 32386 - DNA, 680 bp, Zea mays
  misc_feature: Ceres CLONE 1409527-F
  misc_feature: Encodes the peptide sequence at SEQ ID NO. 32387
  misc_feature (255)..(255): n is a, c, t, g, unknown, or other
cgcggtggcggccgctctagaactagtggatcccccgggctgcaggaattcgcacgagaccattacctagaacatcctaatcgaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgcgnggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatccgtggctggtgtggcggcgccgagctgggcagcctcagccgcgacgagctgtggcgcaagggtggggggggggagggcacctacgacctcgccaccgtgctcgctttcctcgccgtcctcgccttcaccatctccgtctacatcatgtccagccccaggcccgtgtacctcatcgacttcgcatgctacaagccggccgacgagctcaaggtggccaagggcggagttcatcgacttggcgcgcaaggccgccaagttcgaccgagacagcctggggt

SEQ ID NO: 32387 - protein, 162 aa, Zea mays
  misc_feature: Ceres CLONE 1409527-F
  misc_feature: SWISSPROT Homolog: EC 2.3.1.119 Icosanoyl-CoA synthase
MAREEQALLSTEIVNRGVEPRGPDAGSPAFSVRVRRRLPDFLQSVNLKYVRLGYHYLISHGVYLATIPVIRGWCGGAELGSLSRDELWRKGGGGEGTYDLATVLAFLAVLAFTISVYIMSSPRPVYLIDFACYKPADELKVAKGGVHRLGAQGRQVRPRQPG

SEQ ID NO: 32388 - DNA, 685 bp, Zea mays
  misc_feature: Ceres CLONE 1409529-F
  misc_feature: Translation starting site: 216
  misc_feature: SWISSPROT Homolog: EC 2.7.1.20 Adenosine kinase
  misc_feature (589)..(589): n is a, c, t, g, unknown, or other
  misc_feature (597)..(597): n is a, c, t, g, unknown, or other
  misc_feature (600)..(600): n is a, c, t, g, unknown, or other
aaagctggagctccccgcggtggcggccgctctagaactagtggatcccccgggctgcaggaattcgcacgagaccattacctagaacatcctaatcgaaaaacttcacacccagcgcactcgagctcgagccctcgccctctcctcaaacacaagcctcagatctcagtcacctgcgccgccgcttcgttcgtgtggaggggagaagagaggaaatggcggcgaccgagggcgtgctcctggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctggtatggnggtgtggnggntgaaagggcattgattgcaaatctgtcagcggcaaactgttacaaatctgagcatctaaagagaccagagaactggggactaagt

SEQ ID NO: 32389 - DNA, 717 bp, Zea mays
  misc_feature: Ceres CLONE 1409531-F
tcaccgcggtggcggccgctctagaactagtggatcccccgggctgcaggaattcgcacgagaccattacctagaacatcctaatcgaaaaaaaaaccagctctgagcctctgacagcggtacactcgtgttcctctcccccacgccctccctcccatcgcgccatgcctcctcccccagacctctcccctccccgcgatccttctttggccaggcggtctgtcggtgcttgcgcccgggcccctcgcgcgctcgcccggcgtcccacggacagcaggggcggcggcggcaagccggtgcgtcagcttctgtcgcacgtcgcccgcacgatgcgacccgcgcccgcggcccgccccctttccctcgctgccacacgatggtcgacaccgggcggagcttcgtggtcaatcaccggggcccgtccgagaagtcccctccgtcaccgccaccgacgcaggcggaggccacgacttccctaacgaaggcaagcgcgccggtggagcccgcgtcggccccacccgccgtcctagagcccatcgggcaagcccaccaaggttgtgcgggcggaggaccccggtgcgccgcgcgtaaaggcggtgggcccagccgcggccgacgtcctccaaggttccgtccgagataaacctgaaggcatggccaagccgtcctgacggtaaaatggccttttttttccgccggtggtcaattcggaggggg

SEQ ID NO: 32390 - DNA, 612 bp, Zea mays
  misc_feature: Ceres CLONE 1409535-F
  misc_feature: Encodes the peptide sequence at SEQ ID NO. 32391
  misc_feature (329)..(329): n is a, c, t, g, unknown, or other
  misc_feature (399)..(399): n is a, c, t, g, unknown, or other
caaagctggagctccccgcggtggcggccgctctagaactagtggatcccccgggctgcaggaattcgcacgagaccattacctagaacatcctaatcgaaaaactgattccgagtccatctttccccgccgccggccgtgatccctcctcgccgttgaccgccccgcctgccccggcattctcccgctcctgatccagggccctcatagagcctccgctcgatctgccccccggatcggattggccgccgcatatctcatgggtgaggaagctgtccacttcagcgtcgtcgacgtctaccactgctaacagagtgcctttgcagtcngcgatgagacccatgtctatttgtagatcacatgatgattttgaaacatctgctggttaccatcacgacnagctgactccgactttggtctcagccataatactgggggaacagcccctttctaaccaagtacaggctggggattccgggccgggaagatcaaaaatttagtttccggaaaggggggtcccctgaaagaggccccctgggtccctttggaaaaacccccccctttttaagcgaacacggttatcccggggacccaaattggttcctgggaaca

SEQ ID NO: 32391 - protein, 52 aa, Zea mays
  misc_feature: Ceres CLONE 1409535-F
  misc_feature (20)..(20): Xaa is any aa, unknown, or other
MSICRSHDDFETSAGYHHDXLTPTLVSAIILGEQPLSNQVQAGDSGPGRSKI

SEQ ID NO: 32392 - DNA, 701 bp, Zea mays
  misc_feature: Ceres CLONE 1409549-F
  misc_feature: Translation starting site: 160
  misc_feature (597)..(597): n is a, c, t, g, unknown, or other
  misc_feature (598)..(598): n is a, c, t, g, unknown, or other
  misc_feature (611)..(611): n is a, c, t, g, unknown, or other
  misc_feature (695)..(695): n is a, c, t, g, unknown, or other
tacccgcggtggcggccgctctagaactagtggatcccccgggctgcaggaattcgcacgagaccattacctagaacatcctaatcgaaaaaatccactccactccatcatcccgtgcctcacgagtcacgagtcactccaggtccaggctgagcagcaatggcgccgcgaacgctcggcttcaacgcggccccgctcctccagattctgcggtccctgtgcctcctggccctcgccgcggcggcggcggtgtccgggcggcgccacggggcctccccggcgcgcggcagcgggcagagcatgtacctggcgccggcctgccgggcgcacacggcgtcggtggcggacttcggcggcgtgggcgacggcaccacttccaacaccgcggcgttccggtccgcggtggaccacctgtcgcagtactcgggcgagggcggcggcggtggcatgctgtacgtgcccggggcaagtggctgacgggccccttcacctgaccagccacttcaccctctacctccaccaagacgccgtcatcctcggctcccaggacgtaggcgagtggccaatcgtggatcccctgccttcttacggaagagnngaggacagtccgnagggaggttcgctaagctcatcggcggatcgaccctgaccgacgtagtcatcactggcagcaacgggacgatcgatgggcaggncgccat

SEQ ID NO: 32393 - DNA, 682 bp, Zea mays
  misc_feature: Ceres CLONE 1409553-F
  misc_feature: Encodes the peptide sequence at SEQ ID NO. 32394
  misc_feature (399)..(399): n is a, c, t, g, unknown, or other
  misc_feature (400)..(400): n is a, c, t, g, unknown, or other
  misc_feature (402)..(402): n is a, c, t, g, unknown, or other
  misc_feature (484)..(484): n is a, c, t, g, unknown, or other
  misc_feature (579)..(579): n is a, c, t, g, unknown, or other
tccccgcggtggcggccgctctagaactagtggatcccccgggctgcaggaattcgcacgagaccattacctagaacatcctaatcgaaaaaagctcagtctgcagtttacaaatgctttgagtcctgcgctcctgtcctgctgttcttgtctagcagtaaacaagtcatttcctttgttgtcacatggtggctcgccgagtgctggtgcacacattctctcctcgttccaccttgctgctgctgctgcagttcttggcacggccttgtattgtataatatgattgtatcacatgccatgtgactatgtgagtagctgaccacggctcaccgcgaggcgcacaggacagcagcgcaggcgcggcggcagcccgccgctggatctctcccgaggctccgnngnatggagcggtcctgctacttcccgctgcggtgggagagcacggcgaccagtggtggtacgcgtcccatagacctggggcggncgggcgacggccactacgacatcgtccgccagctgctgcacctcgaccccaacctgctcatcaagctcactcccccccgccggatcgccgcttcnaagggggcttttggggacgacgacgcccgcttcgccgacgcggccggaaaacccggggggccgtcgccgcaacttgtttgtttgttgaagggccaagtccaaa

SEQ ID NO: 32394 - protein, 93 aa, Zea mays
  misc_feature: Ceres CLONE 1409553-F
  misc_feature (28)..(28): Xaa is any aa, unknown, or other
MERSCYFPLRWESTATSGGTRPIDLGRXGDGHYDIVRQLLHLDPNLLIKLTPPRRIAASKGAFGDDDARFADAAGKPGGPSPQLVCLLKGQVQ

SEQ ID NO: 32395 - DNA, 665 bp, Zea mays
  misc_feature: Ceres CLONE 1409558-F
  misc_feature (364)..(364): n is a, c, t, g, unknown, or other
  misc_feature (587)..(587): n is a, c, t, g, unknown, or other
aagctggagctccccgcggtggcggccgctctagaactagtggatcccccgggctgcaggaattcgcacgagaccattacctagaacatcctaatcgaaaaccaaaaagcccaatcttttactcgtgctcttttcttcctttctttgtcccggtgcggcgtgtgctcgcgtggcgtcaagagcggcggcagctcggcggtgttcacggccgagtgctcccacgccttccacttcccctgcatcgcagcccacgcgcgctcctcctccgccaacggcgttctgtcctgccccgtctgcgcctcgccgtggcgccaggcgcccttcctcgcctccctccgcctccactgctccttccacgacgacnagcaccgaggaggaggcgacggccgcaagacgccgccgcccgccaagctatacgacgacgacgagccgctgctggcgcccaaggccgcggccaacggtggcggcttcaacccgatcccggaggccgacgaggacgacgagtaggagcagggcgccgccgagttcaggggctttctcccatgccccaggagtaggaccacctcgggcctgggcatcaccgtggncgcccgagccgcgctcgtgtcgtcgggcccgcgccacgcaagtacttggtggccgtcaagggccaggcgcccgggctg

SEQ ID NO: 32396 - DNA, 702 bp, Zea mays
  misc_feature: Ceres CLONE 1409563-F
  misc_feature: Translation starting site: 315
  misc_feature (340)..(340): n is a, c, t, g, unknown, or other
  misc_feature (389)..(389): n is a, c, t, g, unknown, or other
  misc_feature (576)..(576): n is a, c, t, g, unknown, or other
  misc_feature (577)..(577): n is a, c, t, g, unknown, or other
agagctggagctccccgcggtggcggccgctctagaactagtggatcccccgggctgcaggaattcgcacgagaccattacctagaacatcctaatcgaaaaagcacaccactcgtagccgccggcaaggcgactgacctctttcctgctgccgagcgccatcgtctcctcggaccatctcacctcagagctgctgcgaccgccggccaacccgtctaggtcttgtccctgccgcttcctgagcctagaacatctttgcattttggagagtctccactcggagctattgtacagtctccatccctttcaacgagatggcacgtcagtctgctctctcgcnttgtgagggatcgagcaaagacgggagcgctgaagcgtctgactctganttcatcgaagaccggctgggaggaaaactcgtctgggcgcatcacctcttttccaccgtgggtggagggggccaagagggtgcagaggaaaggtcgatgtgaaacgcgacgctgttcccacgggtattggtggaagcggatcgagtacgacccgaatcgctcctcgagccttgctcttgtgcgaggnntgcaaagggtgcatttccgccgccccaagagtccccagaactcagtgccatgtctcaaatcaacatctgctacagctgatgtcccccggccggtttcccttgctgcatatctagtagagtgataa

SEQ ID NO: 32397 - DNA, 663 bp, Zea mays
  misc_feature: Ceres CLONE 1409568-F
  misc_feature: Encodes the peptide sequence at SEQ ID NO. 32398
  misc_feature (164)..(164): n is a, c, t, g, unknown, or other
  misc_feature (166)..(166): n is a, c, t, g, unknown, or other
  misc_feature (654)..(654): n is a, c, t, g, unknown, or other
ggccgctctagaactagtggatcccccaggctgcaggaattcgcacgagaccattacctagaacatcctaatcgaaaagggagtcggcactcgggtctcgacgtctcgtctcgtctcgtctcgcctgcccgcagccccttggcttcgttccatccggctctccngncggcggcggagaggagggggatggcgcaccggctgctgcgggacgcgcaggcggacgggtgggagcggtcggacttccccatcatctgcgagtcatgcctcggcgacaacccctacgtccggatgttaagagctgaatatgacgaagaatgcaaaatttgtgcacgtccttttactgtatttccggtggcgtcctgggcgagatgcaaggtacaagaaagactgagatctgccagacatgttgcaagctaaagaatgtctgccaggtctgcctgctggatcttggaaatgggctggcctggtcaggtccgagatacagcactctctatcaattccaatgatgcaattcaaagggagtgatgtcaatcgcgaatattttgcagaaagcattgataggagggccagagctggcatagactatgattctccctatgggaaggctcgcccaatgataccattctgaagcttcaaaggacagcacatattacnagaggacag

SEQ ID NO: 32398 - protein, 76 aa, Zea mays
  misc_feature: Ceres CLONE 1409568-F
MAHRLLRDAQADGWERSDFPIICESCLGDNPYVRMLRAEYDEECKICARPFTVFPVASWARCKVQERLRSARHVAS

SEQ ID NO: 32399 - DNA, 665 bp, Zea mays
  misc_feature: Ceres CLONE 1409570-F
  misc_feature: Encodes the peptide sequence at SEQ ID NO. 32400
  misc_feature (290)..(290): n is a, c, t, g, unknown, or other
  misc_feature (416)..(416): n is a, c, t, g, unknown, or other
  misc_feature (475)..(475): n is a, c, t, g, unknown, or other
  misc_feature (496)..(496): n is a, c, t, g, unknown, or other
  misc_feature (520)..(520): n is a, c, t, g, unknown, or other
  misc_feature (522)..(522): n is a, c, t, g, unknown, or other
  misc_feature (523)..(523): n is a, c, t, g, unknown, or other
  misc_feature (526)..(526): n is a, c, t, g, unknown, or other
  misc_feature (568)..(568): n is a, c, t, g, unknown, or other
  misc_feature (591)..(591): n is a, c, t, g, unknown, or other
  misc_feature (609)..(609): n is a, c, t, g, unknown, or other
tggagctccccgcggtggcggccgctctagaactagtggatcccccgggctgcaggaattcgcacgagaccattacctagaacatcctaatcgaaaatttccagccgccaagccttctagaagcttcaagagctcgattcgatcggaaccctcgccatggccgacgaggcgaaggcgaagggtaacgcggcgttctcggccggccgcttcgaggaggcggcgcggcacttcacggacgccatcgcgcttgccccagacaaccacgtcctctactccaaccggtcggcggngctcgcctcgctccaccgctactccgatgctctcgccgacgcgcagaagaccgtcgagctcaagcccgactgggccaagggctactcccgcctcggcgcggcgcacctcggcctcggcgacgcggncagcgccgtcgccgcctacgagaagggcctcgagctcgaccccagcaacgagggcctcnaagcggggctccaggacgccnagaaaagcgccgccgcccctccgngnncgngggtcgtccgggccccgacgcatcggccagatggtccagggnccccgagctgtggagcaagatcngcgtcgacccctccacgncgcgcctactttaaggaggcggattttatgcatatgatgcgcgaagtgcaaaagaa

SEQ ID NO: 32400 - protein, 169 aa, Zea mays
  misc_feature: Ceres CLONE 1409570-F
  misc_feature (2)..(35): Pfam Name: TPR_2 Pfam Description: Tetratricopeptide repeat
  misc_feature (70)..(103): Pfam Name: TPR_2 Pfam Description: Tetratricopeptide repeat
  misc_feature: SWISSPROT Homolog: EC 3.1.3.16 Phosphoprotein phosphatase
  misc_feature (45)..(45): Xaa is any aa, unknown, or other
  misc_feature (87)..(87): Xaa is any aa, unknown, or other
  misc_feature (107)..(107): Xaa is any aa, unknown, or other
  misc_feature (114)..(114): Xaa is any aa, unknown, or other
  misc_feature (122)..(122): Xaa is any aa, unknown, or other
  misc_feature (123)..(123): Xaa is any aa, unknown, or other
  misc_feature (124)..(124): Xaa is any aa, unknown, or other
  misc_feature (138)..(138): Xaa is any aa, unknown, or other
MADEAKAKGNAAFSAGRFEEAARHFTDAIALAPDNHVLYSNRSAXLASLHRYSDALADAQKTVELKPDWAKGYSRLGAAHLGLGDAXSAVAAYEKGLELDPSNEGLXAGLQDAXKSAAAPPXXXVVRAPTHRPDGPGXPSCGARSASTPPRRAYFKEADFMHMMREVQK

SEQ ID NO: 32401 - DNA, 707 bp, Zea mays
  misc_feature: Ceres CLONE 1409572-F
  misc_feature: Encodes the peptide sequence at SEQ ID NO. 32402
  misc_feature (423)..(423): n is a, c, t, g, unknown, or other
aaagctggagctccccgcggtggcggccgctctagaactagtggatcccccgggctgcaggaattcgcacgagaccattacctagaacatcctaatcgaaaaaccctcccccaccgtctttgatcatcagtagcatcatggccacgcctgtaaagatcgctggttcatttctggctgctgccttgctggtggtacccctcgcggcagacaggctacaacagaaagagcgagatgaatgtgaaacgacagcctgctacagctgctgtctgcgtctttggttgccaggcgaggtggcctgtgcgcccataatggaggagacgaccagcccgcagctctagccgccgtcaatctcgtctcgtatcggagtcgaaggaagtaagaggcgggatggcatgaagcgacctaccaagaatgagaggctgngcaacccccggcacaagtaggaggaagaacccgagcaaccgagccacagggaggagggaggagatgggcaactgcggcacacgggaggagaatgtcgtcgtcgctgcgcacgcgcaaggtcagcaactccacttggtaacacagccttccaagaacggccaggcaaataggaaagacaccctgcatgccatccagaaataggggacccctcccacaccaaagaaaggttgaagaagcccacaaccatttccctaaacaaagatggggattgccttcccaattgc

SEQ ID NO: 32402 - protein, 45 aa, Zea mays
  misc_feature: Ceres CLONE 1409572-F
MGNCGTREENVVVAAHAQGQQLHLVTQPSKNGQANRKDTLHAIQK

SEQ ID NO: 32403 - DNA, 694 bp, Zea mays
  misc_feature: Ceres CLONE 1409574-F
  misc_feature: Translation starting site: 479
  misc_feature (530)..(530): n is a, c, t, g, unknown, or other
  misc_feature (533)..(533): n is a, c, t, g, unknown, or other
  misc_feature (537)..(537): n is a, c, t, g, unknown, or other
  misc_feature (600)..(600): n is a, c, t, g, unknown, or other
gctctagaactagtggatcccccgggctgcaggaattcgcacgagaccattacctagaacatcctaatcaaaaaaaaggaaacagctcgtccagtccgtagtccatagtactccatttgcaaattgcattgcattgcctcacctcaaccccacctcacctctcctctcctcggcctcacttcacaagtccacatcacgaaacaggagcgtcataaagacatgggcgtcgcagggtagcctcagaccagtgacgcagcggcagcggcagcggcagcgggcatggggtcctgactgactaactgcgaaggagatggctggagcgcgacggccccggagccattaatggggtgctcatcctcctcgtcctcgcctcctccccgccgggtcgcggacgcggtcggctccgccttttaaccggcctgtccggtagcggagcgccggaaccctagtgctgtgctggtggcacgcggcgcgccacatgggcatcgatctcaacatggtggacggcaagagccacgagcgccgcccgncgnccgntggcgtgccgggagctgtggcacgcgtgcccggggcccgtggtcgcgctaccgcgggggagcnccctggtcaggtacctgccgcagggccacctggttgcgggggagggggggaaactccctgcggaactgcccccaaaggggtgggcccgttccgg

SEQ ID NO: 32404 - DNA, 704 bp, Zea mays
  misc_feature: Ceres CLONE 1409577-F
  misc_feature: Translation starting site: 480
  misc_feature: SWISSPROT Homolog: EC 3.7.1.2 Fumarylacetoacetase
  misc_feature (337)..(337): n is a, c, t, g, unknown, or other
  misc_feature (513)..(513): n is a, c, t, g, unknown, or other
  misc_feature (525)..(525): n is a, c, t, g, unknown, or other
  misc_feature (631)..(631): n is a, c, t, g, unknown, or other
  misc_feature (680)..(680): n is a, c, t, g, unknown, or other
agagctggagctccccgcggtggcggccgctctagaactagtggatcccccgggctgcaggaattcgcacgagaccattacctagaacatcctaatcgaaaacgaaaaagtcttcacggcggggttgttgtcgcttgtggccagccgccagcaccagcacaaggcgatcgagagtggtgaccaccagtaaactgcaaagtgcaaaccaaacaccacccacgagaaagcggaggagggagcaatggcggagccgagccagcagctgcggtcgttcgtggaggtgccggcgggctcccacttccccatccagaacctgcccttcggggtcttccgccgngcggggggtgcaggcgcaggcgccgcgccccgcgggggccatcggggacttcgcgctcgacctcgccgccgtcgccgacgcggggctcttcgacgggcccgcgctctccggctccccgtgcttccaccaggagacgctcaacatgttcttggggatgggccggccggcgtggaggnaggcgcgcgccncgctacagaaaatcctatcagccgacgagcccgtcttgggtgacaacgaagcactgaggaacaacggtctgggaccaatgagtgatatagagaaggctctaccaancacggggtgggaggtacccggcacttcttttggtctgtgccacatcgcncgaattggggcattatctttccgt

SEQ ID NO: 32405 - DNA, 680 bp, Zea mays
  misc_feature: Ceres CLONE 1409578-F
  misc_feature: Encodes the peptide sequence at SEQ ID NO. 32406
  misc_feature (360)..(360): n is a, c, t, g, unknown, or other
  misc_feature (474)..(474): n is a, c, t, g, unknown, or other
  misc_feature (492)..(492): n is a, c, t, g, unknown, or other
  misc_feature (493)..(493): n is a, c, t, g, unknown, or other
  misc_feature (521)..(521): n is a, c, t, g, unknown, or other
  misc_feature (531)..(531): n is a, c, t, g, unknown, or other
  misc_feature (566)..(566): n is a, c, t, g, unknown, or other
tccccgcggtggcggccgctctagaactagtggatcccccgggctgcaggaattcgcacgagaccattacctagaacatcctaatcgaaaaatcacaattcacagcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatnctcgccgccgtgcttgagaccccgcccgccgaggtggctggagctggccgggaaccgcggcgaaggacaacaagaagacgcgcatcgtcccgcgaacttgctcctggcattccnaaaacgacgttgagctcnncaggctgcttgtctggcgccctgcgccnacaggggggnggtcctcccacaattcaacccggtctctgggccanaaaaggggggggggaaaaaggggtcccagcgccgccagaaagggagagcagcccccccctaagaaaggccgcccagccccccaaagaaggcagcaagttccccccgaagaaggg

SEQ ID NO: 32406 - protein, 67 aa, Zea mays
  misc_feature: Ceres CLONE 1409578-F
  misc_feature (63)..(63): Xaa is any aa, unknown, or other
MDASGAGSKAKKGAAGRKAGGPRKKSVSRSVKAGLQFPVGRIGRYLKKGRYAQRVGTGAPVYXRRRA

SEQ ID NO: 32407 - DNA, 653 bp, Zea mays
  misc_feature: Ceres CLONE 1409581-F
  misc_feature: SWISSPROT Homolog: EC 3.2.1.4 Cellulase
  misc_feature (434)..(434): n is a, c, t, g, unknown, or other
tggagctccccgcggtggcggccgctctagaactagtggatcccccgggctgcaggaattcgcacgagaccattacctagaacatcctaatcgaaaaagtttcgacagtcgtcgtcccctctactctcccggcttccgcagaatcccagcttctctggccctctcactccaaacatcgggctccaggccgtctcccgccaacccaaattcgcttcccgccgctccccattaaacccgcttgaaaggtcgcgccctcgagcagagcaacccctgaccacaaatccgatccgtagccgccgtgcctcgatttcgtctcttcccctctgctcgagtacgagcggctactcccggcggcggcggcggcggcggcgatgagcgcggtgagctcgaccatatcaaggagctgatcaagtggggaacagactacatcctcnaaaacccttcattcatctgctgacacgatagaacagattgtcgctccagggggggggtagggtgacacctctaaaggcagcagtcagcctaatgaccattactggctggatgagaccagaggacatcgactaaccaaaggcagtccaccgaggggcactccggctcaaaactagcgtcttgaaaaggctgcggccctggctggagttttcaaaaggggc

SEQ ID NO: 32408 - DNA, 774 bp, Zea mays
  misc_feature: Ceres CLONE 1409582-F
  misc_feature: Encodes the peptide sequence at SEQ ID NO. 32409
  misc_feature (424)..(424): n is a, c, t, g, unknown, or other
  misc_feature (451)..(451): n is a, c, t, g, unknown, or other
  misc_feature (463)..(463): n is a, c, t, g, unknown, or other
aagctggagctcaccgcggtggcggccgctctagaactagtggatcccccgggctgcaggaattcgcacgagaccattacctagaacatcctaatcaaaagaagcagactccacccggcgcgtcctcgtctcgtctcgtctcgcacgcacccctcactttccttgtcaatcgactcgcgatcgaatccgccccgagtcgattccgccgcggaccgaccggttcacttcccttttctcccgagatctcgactctcgagcaagtatgggtgaggcgaaggacaacgaggtgtacgaggaggacctagtcgactatgaggaggaggtggagaatgtcattgatggcgcccccaccaacggctcctcagatgtcgtcaagaaggggtacgtagggatccacagctcggggttcagagactccctgctncagccagagcttctttcgcgcattcanggatggcggttngagcatcccttctgaagggcaacatgaaggcatccctcaagctattcctgggaatggatgccatctgtcagcaaaatctggaagggtaaaaactgccagttttttgcctggcactttttcaaaaaattgaccctggtgcggggcaaaaaattggcctttggggttgcccccccaaaaaaatactttccccaattggcccgaattttgaggggttaaccaaaaccggccgaaataaaagaaagtgttttcttttggggggggggcccaaaaaaaaccccagggggtgggggaaaaaggggcccccccatttt

SEQ ID NO: 32409 - protein, 71 aa, Zea mays
  misc_feature: Ceres CLONE 1409582-F
  misc_feature (63)..(63): Xaa is any aa, unknown, or other
  misc_feature (67)..(67): Xaa is any aa, unknown, or other
MGEAKDNEVYEEDLVDYEEEVENVIDGAPTNGSSDVVKKGYVGIHSSGFRDSLLQPELLSRIXGWRXEHPF

SEQ ID NO: 32410 - DNA, 703 bp, Zea mays
  misc_feature: Ceres CLONE 1409583-F
  misc_feature: Encodes the peptide sequence at SEQ ID NO. 32411
  misc_feature (530)..(530): n is a, c, t, g, unknown, or other
  misc_feature (641)..(641): n is a, c, t, g, unknown, or other
  misc_feature (652)..(652): n is a, c, t, g, unknown, or other
tccccgcggtggcggccgctctagaactagtggatcccccgggctgcaggaattcgcacgagaccattacctagaacatcctaatcgaaaaaaggcttcgttctgctctccggctctcccgcatccaccccgtctcatccccaatccgaccacctcatccctcgcctccatggccctacccctcgcgtcaccggcgggggcatgagccggtgactgctcacgcggcctcgtctgtctgcgcacgcgcgcggggtcggcgagtgagcattgcggcggtccgcgatcgcccgtgggggagcatggcgtcggcggcggggtcggccggcggggccggcgcggggtctggcgggctgaagacctacttcaagacccccgaggggcggcacaagctgcagtatgagaagacgcactcccccgccgtcgtgcactacagccacagcggcaagaccgtctcccagatgacagtggcatatttgaaggagaagccagcaggccagggttccacgccttcaacaccaagtgctggtagntgggatgcggtctgcagctgcaagacttctcggcactgggaaatgggagccgggcacttagcttcgggagcatgggacccagcagggctgtctcaggagcagccgcatggntggaggggaantgtgtgtcgactagtgcaagtggatcgcaagcatggcaactatgatggaaa

SEQ ID NO: 32411 - protein, 134 aa, Zea mays
  misc_feature: Ceres CLONE 1409583-F
  misc_feature (77)..(77): Xaa is any aa, unknown, or other
  misc_feature (118)..(118): Xaa is any aa, unknown, or other
MASAAGSAGGAGAGSGGLKTYFKTPEGRHKLQYEKTHSPAVVHYSHSGKTVSQMTVAYLKEKPAGQGSTPSTPSAGXWDAVCSCKTSRHWEMGAGHLASGAWDPAGLSQEQPHGWRGXVCRLVQVDRKHGNYDG

SEQ ID NO: 32412 - DNA, 660 bp, Zea mays
  misc_feature: Ceres CLONE 1409584-F
  misc_feature (349)..(349): n is a, c, t, g, unknown, or other
  misc_feature (389)..(389): n is a, c, t, g, unknown, or other
  misc_feature (396)..(396): n is a, c, t, g, unknown, or other
tggagctccccgcggtggcggccgctctagaactagtggatcccccgggctgcaggaattcgcacgagaccattacctagaacatcctaatcaaaaaaaacaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgcgttctccgggtcggtgaacctcaagcacgtcaagctggggtaccagtacctgggtgaacacttnctgacgctgctgctggtgcccggtgatggccgcaaccgcncctgaanctggcgcgcctccggccccggggagctggttctcgctggggggctcccttggagctggacctgggcccaatcctcctgctcgggggttcctgggctttccttgtcggaaccggggtaacgggattgccgggggcccacgccgggggtaacctggggggaataacccttggttaaaaacccccccgccgggtgccgggggggcccttgccaacccttttggggggaaacccgggccccctaaagggggaaaacacgaaagggggg

SEQ ID NO: 32413 - DNA, 693 bp, Zea mays
  misc_feature: Ceres CLONE 1409588-F
  misc_feature (373)..(373): n is a, c, t, g, unknown, or other
aaagctggagctccccgcggtggcggccgctctagaactagtggatcccccgggctgcaggaattcgcacgagaccattacctagaacatcctaatcgaaaaaaaatcaaatgattccttgcttgcccccctttccctccaaaattctcgctgcggccctcgtcttcctcctcttcttcttctgtaaagtgccaagtgccaactgcattctggcttacttggaacaccactccttgattccttcccattccaccagtctcatcttgcatagtgctagaacttatccatttgcttgctactgctcttgcccagcatgagcaaacggccgatgatgacaacgccggcgggcggagaagacggtgagccatccagncggcgctcgcggagccggtgcgccgccgccgtctcagccggtcggtaccggccgctacgcaagactgcagagcgccggcaccgggaccagtgccgccgacggcgaccggcccagacgtcatgtgacctatatggaaggccgttttgaagcggcggagcagccgccaaccgatgacggttacggtgccggggacactgccccgccccagacgcgcacgcaacgccccaggccgacctaaccgcctgtgtcggcaaagagaagagaggcgccgaatgatgagcaccctacgtttgtacggaagattaccccgcccccaaata

SEQ ID NO: 32414 - DNA, 669 bp, Zea mays
  misc_feature: Ceres CLONE 1409589-F
  misc_feature: Encodes the peptide sequence at SEQ ID NO. 32415
  misc_feature (548)..(548): n is a, c, t, g, unknown, or other
aaagctggagctccccgcggtggcggccgctctagaactagtggatcccccgggctgcaggaattcgcacgagaccattacctagaacatcctaatcgaaaagtcccacccgcttcggcctctccctcctcctcgctcgctcgatcgctcccacgtcctcgcctccctccacaaaccaccaccaccatccaggatcgcagcgcggcgcgcgagagaggggtgagcaggtcgggcaagatgagggagatcctgcacatccagggcggccagtgcggcaaccagatcggcgccaagttctgggaggtgatctgcggcgagcactgcgttgactccacgggccgctactcggggacctcctcgcagcagctcgagctcgagcggatcaacgtctactacaacgaggctgggggtggccgctatgtgccccgcgccgtgctcatggacctggagcccggcaccatggaatccatcccgcgcggccccttcggaggcatcttccgccccgacaactttgtctacggccagtccggcgccgggaaacactgggncaagggccactacaccgaggggcgcgaggtcatcgactccgtccttgacgtcgtgcgcaaggaggcccgagactgcgactgccctcaagggtccaagtatgccactccctgggtggcggaa

SEQ ID NO: 32415 - protein, 144 aa, Zea mays
  misc_feature: Ceres CLONE 1409589-F
  misc_feature (47)..(143): Pfam Name: Tubulin Pfam Description: Tubulin/FtsZ family, GTPase domain
  misc_feature (104)..(104): Xaa is any aa, unknown, or other
MREILHIQGGQCGNQIGAKFWEVICGEHCVDSTGRYSGTSSQQLELERINVYYNEAGGGRYVPRAVLMDLEPGTMESIPRGPFGGIFRPDNFVYGQSGAGKHWXKGHYTEGREVIDSVLDVVRKEARDCDCPQGSKYATPWVAE

SEQ ID NO: 32416 - DNA, 697 bp, Zea mays
  misc_feature: Ceres CLONE 1409590-F
  misc_feature: Encodes the peptide sequence at SEQ ID NO. 32417
  misc_feature (430)..(430): n is a, c, t, g, unknown, or other
  misc_feature (480)..(480): n is a, c, t, g, unknown, or other
  misc_feature (572)..(572): n is a, c, t, g, unknown, or other
  misc_feature (612)..(612): n is a, c, t, g, unknown, or other
aaagctggagctccccgcggtggcggccgctctagaactagtggatcccccgggctgcaggaattcgcacgagaccattacctagaacatcctaatcgaaaaagatttggatgtggactagatgcttaaggtgtgaacgtgaaagtggggtccccagatcatcacgaagggtgataatgtcagctgaagcacactacctttcatttgggaagttccttgaacttagtttttcaagccactcaaccgctagaaggctgccaatatgcgggcattcactcaatacggattgtctgcgctttttttgggttgggctccaaagttgcaatgttccagtattcctcagtcgaaatttacaatgcctgcaaaccacagcctactcttgagattcacaaccccgatatgcacaaagatgccccaaggttgctgcccntcgtgtttcgtgctctgattgttgagtcttcaatgagagctgattccagntatatagaggtgaacaagcttttgattatttcttttgttaatttggtgaaacatatagaggtgaacaagcttattaaaggaagatccttgancaatcaagagttcatacaatagatgaaaacgatattgtgnattctctcaatggtggcttcatgagcaagcaatcattcaccttgttcactaaaatttcaaactgaagctcagataaggctttgag

SEQ ID NO: 32417 - protein, 90 aa, Zea mays; identical to SEQ ID NO: 11994
  misc_feature: Ceres CLONE 1409590-F

SEQ ID NO: 32418 - DNA, 696 bp, Zea mays
  misc_feature: Ceres CLONE 1409598-F
  misc_feature: Encodes the peptide sequence at SEQ ID NO. 32419
aaagctggagctccccgcggtggcggccgctctagaactagtggatcccccgggctgcaggaattcgcacgagaccattacctagaacatcctaatcgaaaaaaaaccacagcactggatagaacacgccaaaagcaagagatatttctgcttcgctcttgtctcagctcagctcctgccagtcgcaactcgcgtcctctccaaaaacagcccacagctgaagcgagaacacgaatgctcagtgatatttctctcgaggtctgcacactcgtctcctaccgagaccgtcggcggccatcgtcgcacacgctgtgctcatgctaagtgtcgaggctcacacgtactactactacccgaccgcgaggccgagacggaagctatgcgcctgcagaaacgtcttgcaggaaaccgccccgcgtgacgcagaggcaaatccctgccgtcacggcgagaggaagagcaggagaaggggcgacggtgcttattacatcgacaaggacggcggcggcgtagccaggaccttcgaccggaagaaaatatccagaaagagggggggtgctatcaaagggcgcggatggaagtacggctcccgggtcgtcgacggagtgttcccagggctggagccgatggagaaggatgggctccaactcgtcaaaacgggggggactggggcgagccagcgccgcgggagccctg

SEQ ID NO: 32419 - protein, 126 aa, Zea mays
  misc_feature: Ceres CLONE 1409598-F
MLSVEAHTYYYYPTARPRRKLCACRNVLQETAPRDAEANPCRHGERKSRRRGDGAYYIDKDGGGVARTFDRKKISRKRGGAIKGRGWKYGSRVVDGVFPGLEPMEKDGLQLVKTGGTGASQRRGSP

SEQ ID NO: 32420 - DNA, 696 bp, Zea mays
  misc_feature: Ceres CLONE 1409602-F
  misc_feature: Translation starting site: 173
  misc_feature: SWISSPROT Homolog: EC 2.7.7.27 Glucose-1-phosphate adenylyltransferase
  misc_feature (448)..(448): n is a, c, t, g, unknown, or other
  misc_feature (452)..(452): n is a, c, t, g, unknown, or other
gctctagaactagtggatcccccgggctgcaggaattcgcacgagaccattacctagaacatcctaatcaaaaaccgtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagaggatgaggatcaactgctgcagcatcaggcgcaacaaggcactgaggaggatgtgtttcagtgcaagggatgctgtgagcagcacgcagtgtgtgctcacatcagatgctggcccagacactcttgtcgtccgaacatcctttcggaggaattatgctgatcctaatggagtcgctgccgtcattttgggntggntggtaccgggactcagctttttccctctcacaagcacaagggccaccccctggctgtcctattgggaggatggtacaggcttattgatatccccatgagcaactggtttcacaggggaataaacccagaaatttggtatgactcagttcaaatcagtttccctaaacgggaaatttctcggacctatttgtgggggggggaccacttcccggggggaatttggggggggggggggttgcaacca

SEQ ID NO: 32421 - DNA, 683 bp, Zea mays
  misc_feature: Ceres CLONE 1409603-F
  misc_feature: Encodes the peptide sequence at SEQ ID NO. 32422
  misc_feature (537)..(537): n is a, c, t, g, unknown, or other
  misc_feature (616)..(616): n is a, c, t, g, unknown, or other
acagctggagctccccgcggtggcggccgctctagaactagtggatcccccgggctgcaggaattcgcacgagaccattacctagaacatcctaatcgaaaacactactctggtcgtcctcgcgccgccgcagcagcagcagcgacgcgaccgccggtaatggcttccaccgttgtgctccggaacgccggctcccgccgactcttctgctactccactctccgcgccgccgcaatattgggacccgccgcgccacctgatgcgcccgcggcggcgtcggcccagccgccaccgatggcaggaaccctctgggcgaggtccatggccactttcacgcgcacgaagccacatgtgaacgtcggcaccattgggcacgtcgatcacggcaaaaccacactcactgctgccattaccaaggttctggcagaggcagggaaggccaaagcaattgcttttgacgagatcgacaaggccccggaagagagagccagaggaatcaccattgcaacagctcatgtcgagtatgagacggctaanaggcattatgctcatgttgattgtcaggtcacgcagatatgtccagacctgatcactgagctgctcaatgcatgggggnattcttgtcgggtcactcctgatggcccatgccacaacaagggacacttcctctgcccgtccaggtg

SEQ ID NO: 32422 - protein, 174 aa, Zea mays
  misc_feature: Ceres CLONE 1409603-F
  misc_feature (62)..(160): Pfam Name: GTP_EFTU Pfam Description: Elongation factor Tu GTP binding domain
  misc_feature (126)..(126): Xaa is any aa, unknown, or other
  misc_feature (153)..(153): Xaa is any aa, unknown, or other
MASTVVLRNAGSRRLFCYSTLRAAAILGPAAPPDAPAAASAQPPPMAGTLWARSMATFTRTKPHVNVGTIGHVDHGKTTLTAAITKVLAEAGKAKAIAFDEIDKAPEERARGITIATAHVEYETAXRHYAHVDCQVTQICPDLITELLNAWGXSCRVTPDGPCHNKGHFLCPSR

SEQ ID NO: 32423 - DNA, 723 bp, Zea mays
  misc_feature: Ceres CLONE 1409604-F
  misc_feature: Translation starting site: 167
  misc_feature (515)..(515): n is a, c, t, g, unknown, or other
  misc_feature (533)..(533): n is a, c, t, g, unknown, or other
  misc_feature (534)..(534): n is a, c, t, g, unknown, or other
  misc_feature (575)..(575): n is a, c, t, g, unknown, or other
  misc_feature (576)..(576): n is a, c, t, g, unknown, or other
  misc_feature (607)..(607): n is a, c, t, g, unknown, or other
  misc_feature (723)..(723): n is a, c, t, g, unknown, or other
gctctagaactagtggatcccccgggctgcaggaattcgcacgagaccattacctagaacatcctaatcgaaaattccctccctccactcgcgtccaaattctctcctcaccacaccacctctccctccgacgcacgggtgcatcgcagtgctagatagagtgaccatgcaggcggcggcggtgacggtgaatggcgcgggcgacgtgcagaagccccagcagcagccgatggtggtgggggcgccgccgccggcggccatggtgccgccccattgggttgccataccgatgccgccgcacccgatggcgccgccccagttcgcggcggctcaattcgtgccgttccacgccgtcgtgcagtcgccgcagctggcggcacctgtgccagcggtcgtcctgggatcgccggcgccgcatcaggccgggcaggaggagaacaagaccatctggggttggtgatctccatttctggatggacgagaattatctgcacaactgcttcggctacaccggncgaggttgtggcaattannagtatccggaataagcagaccggacagtctgaaggatacgnnatttgtgagttctacagccatgctgcagctngaagggttctttgaaggggtttctgttcatattatgccaaacactgaccagcccttttaggttaactgggcatcgtttagcatgggagatggccgctcggatggtgctttcgatcn

SEQ ID NO: 32424 - DNA, 609 bp, Zea mays
  misc_feature: Ceres CLONE 1409605-F
  misc_feature: Encodes the peptide sequence at SEQ ID NO. 32425
  misc_feature (51)..(51): n is a, c, t, g, unknown, or other
  misc_feature (300)..(300): n is a, c, t, g, unknown, or other
aaactggagctccccgcggtggcggccgctctagaactagtggatcccccngggctgcaggaattcgcacgagaccattacctagaacatcctaatcgaaaaccccttgccctccgtccagctcgccgtctctcgcagagggaagcagggcgcagcagtgaccagttaccagtcatggttcgctgcgttgccggcagctgccctcccgtcaccttcgcgtgttgcccccgccggactggacgaagtgctgttgttcagtgtggcactgcatcgagcacaccagcaatatctgggactggnacttcatcatctgaatcctcggggcttgttcaagaatggactgcccctctgggtctgggcactgcaattaactggcaaaacaaagggtttcctggtttcccttcccgggaaccaaacaaggaaaaaggtgtccatctttctttggcaaaatctattgggttcgggggattttctggaggggtttgcccaaatttcccgaattgggggggttcctttcccccaaaggggggggttttttaaggccccagggggggaggccccccgggggggggggacaaaaaaaattggggtccttttggaaaaggaaag

SEQ ID NO: 32425 - protein, 121 aa, Zea mays
  misc_feature: Ceres CLONE 1409605-F
MVRCVAGSCPPVTFACCPRRTGRSAVVQCGTASSTPAISGTGTSSSESSGLVQEWTAPLGLGTAINWQNKGFPGFPSREPNKEKGVHLSLAKSIGFGGFSGGVCPNFPNWGGSFPPKGGVF

SEQ ID NO: 32426 - DNA, 718 bp, Zea mays
  misc_feature: Ceres CLONE 1409607-F
  misc_feature: Encodes the peptide sequence at SEQ ID NO. 32427
  misc_feature (338)..(338): n is a, c, t, g, unknown, or other
  misc_feature (392)..(392): n is a, c, t, g, unknown, or other
aaagctggagctccccgcggtggcggccgctctagaactagtggatcccccgggctgcaggaattcgcacgagaccattacctagaacatcctaatcgaaaaaggtcgacgcatcttcgcctccgctcaacgctcgcccacgcccgccgcccccccaccgatccacgagaaaccttctcgcctccgcgggacgattcgccagggagagcaaaggtagcagaggcgccatggacgctgccaagtcggtgacgccgggcgccgtgtcctacatcctggcgcacccgtctacgggctccaatggcgccgtgtcggatctcgtcgttcaggtcctcgatctncagtccatcggcatgggcagccggttcagtttcacggcaaccgatggaacgacnaaatcaaggcgatggctccccacttactttggcgtcggagggtcacctccgggaatctggagaaatttcgggttcaatccgattcctcgatttaactttggaaactccgggaaagggaaacgttgaacaaaggcctgggttggccctaaaagggcaaactggtgggaaaaggctctccacccccagaattaccgggggggggccaaaaaaaggggaccctccatttggggggagaaccccaaaaacaaggggtcaactgggggggggagaaaacaaaattcccccccccccgggggggaacccacacaaaaagggaggaccccccc

SEQ ID NO: 32427 - protein, 96 aa, Zea mays
  misc_feature: Ceres CLONE 1409607-F
MDAAKSVTPGAVSYILAHPSTGSNGAVSDLVVQVLDLQSIGMGSRFSFTATDGTTKSRRWLPTYFGVGGSPPGIWRNFGFNPIPRFNFGNSGKGKR

SEQ ID NO: 32428 - DNA, 712 bp, Zea mays
  misc_feature: Ceres CLONE 1409608-F
  misc_feature: Encodes the peptide sequence at SEQ ID NO. 32429
tccccgcggtggcggccgctctccaactagtggatcccccgggctgcaggaattcgcacgagaccattacctagaacatcctaatcaaaaatcggatccatggtctcttttctcagccctctcagtctcacacaccacaccagagcagcgcagccgagcatgcactcatcacatcagctcctcgtctcctagctttcctattcctgccttgataattggccaattgttcgatctccttctttactaccccctttgctttcgttgctgctactactactgttccatctcctaggtttcgttgttgtccctgcaggccgccactgagtgatttgttagcagataagatttagatctcccagataaaaaaaagaggttgagaggagagctagcactaggcactagcaatcctgctgtgaggtgaatatggatccagtcgcagcatccatacacggtcatcatcttcctccaccgttcaacacccgggacttccatcaccatctccagcaacagcagcagcagctcaagaccgaggacgaccacggcagcggcgcgcgaaggccgtgatgctctcggagatgtcgcagccgctggccacctccatgacgtgcgtccggagcgtgttggcgctgtccctcgtgatgatgatgggcggcttcggcttgttcttggggctagctctttctggcccgcgccaccggaggctcgggcacac

SEQ ID NO: 32429 - protein, 46 aa, Zea mays
  misc_feature: Ceres CLONE 1409608-F
  misc_feature: The sequence is a functional homolog of SEQ ID NO 1408 in the 10/374,780 US patent application
  misc_feature: The sequence is a functional homolog of SEQ ID NO 28 in the 10/669,824 US patent application
  misc_feature: The sequence is a functional homolog of SEQ ID NO 28 in the 10/870,198 US patent application
  misc_feature: The sequence is a functional homolog of SEQ ID NO 350 in the 11/435,388 US patent application
  misc_feature: The sequence is a functional homolog of SEQ ID NO 352 in the 10/714,887 US patent application
MDPVAASIHGHHLPPPFNTRDFHHHLQQQQQQLKTEDDHGSGARRP

SEQ ID NO: 32430 - DNA, 702 bp, Zea mays
  misc_feature: Ceres CLONE 1409609-F
  misc_feature: Encodes the peptide sequence at SEQ ID NO. 32431
  misc_feature (286)..(286): n is a, c, t, g, unknown, or other
  misc_feature (615)..(615): n is a, c, t, g, unknown, or other
tccccgcggtggcggccgctctagaactagtggatcccccgggctgcaggaattcgcacgagaccattacctaaaacatcctaatcgaaaaatccaattcacaggctcaccacaccaaccaacaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggngcggcgtgaagcgcatctcggggctcatctacgaggagacccgcggcgtgctcaagatcttcctggagaacgtcatccgcgacgccgccccaccacgcccgatggccgccgtaaggtcgctgctccgctcgtcggcctcccttcttcgcgccgcccccgccctcgcgagatcctcggctaccacgcgtccgtctcttcggcgcgcattggctgctcctcctcgcctcctcaggtcgcccgtcgagtcgagcttctgcgtggagtcgcttctgcctctgcacaccgccaccgccggtgcacgcatgacgtccatgctcgccgctcctggncaaggcctcggctggctcacccaagctgaaaatgacggagtaaacgccccctgtgggtggtttaggaccaggaccctccttgcccca

SEQ ID NO: 32431 - protein, 180 aa, Zea mays
  misc_feature: Ceres CLONE 1409609-F
  misc_feature (42)..(42): Xaa is any aa, unknown, or other
MSGRGKGGKGLGKGGAKRHRKVLRDNIQGITKPAIRRLARRXGVKRISGLIYEETRGVLKIFLENVIRDAAPPRPMAAVRSLLRSSASLLRAAPALARSSATTRPSLRRALAAPPRLLRSPVESSFCVESLLPLHTATAGARMTSMLAAPGQGLGWLTQAENDGVNAPCGWFRTRTLLAP

SEQ ID NO: 32432 - DNA, 743 bp, Zea mays
  misc_feature: Ceres CLONE 1409612-F
  misc_feature: Encodes the peptide sequence at SEQ ID NO. 32433
  misc_feature (544)..(544): n is a, c, t, g, unknown, or other
  misc_feature (677)..(677): n is a, c, t, g, unknown, or other
  misc_feature (688)..(688): n is a, c, t, g, unknown, or other
  misc_feature (695)..(695): n is a, c, t, g, unknown, or other
  misc_feature (712)..(712): n is a, c, t, g, unknown, or other
  misc_feature (713)..(713): n is a, c, t, g, unknown, or other
  misc_feature (735)..(735): n is a, c, t, g, unknown, or other
tccccgcggtggcggccgctctagaactagtggatcccccgggctgcaggaattcgcacgagaccattacctagaacatcctaatcgaaaaagcaaatcactacacacaccttgtctctaatcagatatcaaagaagtagccattaagttaacgatggcttccgccgacctcgcagaggccatcgagcccagcaggaagaagaagagcaacgtcaagtatgcctccatctgcgccatcctcgcctccatggcctccgtcatccttggctacgatattggggtgatgagcggagcggccatgtacatcaagaaggacctgaagatcacggacgtgcagctggagatcctgatagggatcctcagcctctactcgctcatcgggtccttcgcgggcgcgcggacgtccgacaggatcggccgccgcctgactgtcgtcttcgccgccgtcatcttcttcgcgggcgcgctgctcatgggtttcgccgtcaactactccatgctcatggtgggccgcttcgtggccggagttggcgtgggctacggnggcatgatcgcgcccgtgtacacggccgagatctcgccggcggcgtcccgcggcttcctcacgtccttccccggaagtgttcatcaacgtcggcatcctgctcggctacctgtcgaactttgcgtttgcgcgnctaccgctccngctcggntggcgcgtcatgctcgnncatcggcgcggcgccggccggnctgctcgc

SEQ ID NO: 32433 - protein, 196 aa, Zea mays
  misc_feature: Ceres CLONE 1409612-F
  misc_feature (175)..(175): Xaa is any aa, unknown, or other
  misc_feature (181)..(181): Xaa is any aa, unknown, or other
  misc_feature (187)..(187): Xaa is any aa, unknown, or other
  misc_feature (194)..(194): Xaa is any aa, unknown, or other
MASADLAEAIEPSRKKKSNVKYASICAILASMASVILGYDIGVMSGAAMYIKKDLKITDVQLEILIGILSLYSLIGSFAGARTSDRIGRRLTVVFAAVIFFAGALLMGFAVNYSMLMVGRFVAGVGVGYGGMIAPVYTAEISPAASRGFLTSFPGSVHQRRHPARLPVELCVCAXTAPARXARHARXSARRRPXCS

SEQ ID NO: 32434 - DNA, 716 bp, Zea mays
  misc_feature: Ceres CLONE 1409614-F
  misc_feature: Encodes the peptide sequence at SEQ ID NO. 32435
agagctggagctccccgcggtggcggccgctctagaactagtggatcccccgggctgcaggaattcgcacgagaccattacctagaacatcctaatcgaaaaagcacctccattcccagccacgagacgacgaaaccctagcctccctccccctctctcaccaggccaccacctcgccggaacccggcgcctcgaaggagcacgggatcatcggccgccgtcggccgcggctgcggaggagcggtgtaagatgttgaacggcggcggcggcggccagaagaagcggaacacgaagatcgagccctatcggcaccgcgtagagaccgaccccaagttcttcgacaagtcgtggcggaagctccatgacgccatccgcgagatctacaaccacaacgccagcggtctctccttcgaggagctctacagggctgcttataccatggtattgaacacggttggctcctccgccttatgcgaaactccccgaaagtattgaaggagcatcttgaaaaaatgggccaaaggcatagagggcggtcccgggggcattgctcatcgaaacacgcgggctcaaaacggggagggcccaaacgggcggcgtgtggggattatcgggataggcccccccgtgccccgtctatacacaatatggtattgcggcccctgcccacggtcggcgcccagattgcttattgctccgggccccttcccccttg

SEQ ID NO: 32435 - protein, 81 aa, Zea mays
  misc_feature: Ceres CLONE 1409614-F
MLNGGGGGQKKRNTKIEPYRHRVETDPKFFDKSWRKLHDAIREIYNHNASGLSFEELYRAAYTMVLNTVGSSALCETPRKY

SEQ ID NO: 32436 - DNA, 451 bp, Zea mays
  misc_feature: Ceres CLONE 1409618-F
  misc_feature (156)..(156): n is a, c, t, g, unknown, or other
  misc_feature (157)..(157): n is a, c, t, g, unknown, or other
  misc_feature (222)..(222): n is a, c, t, g, unknown, or other
  misc_feature (223)..(223): n is a, c, t, g, unknown, or other
  misc_feature (260)..(260): n is a, c, t, g, unknown, or other
  misc_feature (264)..(264): n is a, c, t, g, unknown, or other
  misc_feature (268)..(268): n is a, c, t, g, unknown, or other
  misc_feature (269)..(269): n is a, c, t, g, unknown, or other
  misc_feature (275)..(275): n is a, c, t, g, unknown, or other
  misc_feature (285)..(285): n is a, c, t, g, unknown, or other
aaagctggagctccccgcggtggcggccgctctagaactagtggatcccccgggctgcaggaattcgcacgagaccattacctagaacatcctaatcgaaaagttcctccgcgacccagcgacgcctccgcggccgtccgatcgccctatccgccnngccgcgcgattctcggcagggggagtagacgggttccagcaaatttggtcccacattctttgttnnggcgctgggctccggtctctcgattctcgtagctggntggnaggnncgcggnatccagcggncattcttggttgtccgaaaacggggttcaggggggggggccccctccaaaaaagccccccccccgttttcaaccccaggggccccggggaaaaccgggggttttccccacccccccctcccccgccgggggggattccagggggggggggccgggggcccgccccc

SEQ ID NO: 32437 - DNA, 693 bp, Zea mays
  misc_feature: Ceres CLONE 1409631-F
  misc_feature: Translation starting site: 253
  misc_feature: SWISSPROT Homolog: EC 3.5.1.14 Aminoacylase
  misc_feature (553)..(553): n is a, c, t, g, unknown, or other
  misc_feature (589)..(589): n is a, c, t, g, unknown, or other
aaagctggagctccccgcggtggcggccgctctagaactagtggatcccccgggctgcaggaattcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatggcggcggcgccagcgctcgcgcgggagctgctggacgcggcgcgggagccggagttcgcggagtggcagcgcggcgtgcggcgccggatccaccagcacccggagctggccttccaggagcaccgcaccagcgcgctcgtgcgcgccgagctcgacgcgatcggcgtcccgtacgcctggcccgtcgcgcagaacgggcgtcgtggccaccatcaccggccccgccgcgggccccgtgttcgcgctccgcgccgacatggacgcgctccccatccaggaaatggtagaatgggagttncagagcaaggaagacgggaagatgcatgcgtgcggncatgacgcccacgtggcgatgcttcttggagcagctaggttgcttcagtctcggagggacgatttaaagtactgatagtttttttggctgcctatttttgcaga

SEQ ID NO: 32438 - DNA, 714 bp, Zea mays
  misc_feature: Ceres CLONE 1409633-F
  misc_feature: Translation starting site: 123
  misc_feature (675)..(675): n is a, c, t, g, unknown, or other
  misc_feature (689)..(689): n is a, c, t, g, unknown, or other
aaagctggagctcaccgcggtggcggccgctctagaactagtggatcccccgggctgcaggaattcgcacgagaccattacctagaacatcctaatcgaaaaattcgtccatcccacctaccatggccaccgcctccggcactgacgccggtgcccagccgcgcgacgaccccagcctcctccccttcgcgtccttctcgctcggcctctccatccgcgcgccggccacccccacactcgcctccgtcccctccaccctccacctccccactcaaatctctacactcgccgtctgcctccacccctccgccgcgcagccctcctcccgccgcaccacccgcctcaattccgccacctcctccgtcatcgccccgctgccctcctcaacgcccggcctctcccgctccttcccttcgggcgcgcccgccgcagcagggcgccgccgcacgctcgtctggttccgcgccgacctccgcctccacgaccatgagccgtttcacgccgcagcggggggcgtcgtcctccctcctccccgttttcgtcttcgatccgcgggacttcggcaagcccccctcggggttcgaccggacgggcccgtaccgcgcccacttctggctcgattcggtcgcgaccctggcgcgagctccgcggccccggggtggggaaactggtggntgcccgtgggtagnccccgaagtggtcattcccgagctc

SEQ ID NO: 32439 - DNA, 724 bp, Zea mays
  misc_feature: Ceres CLONE 1409635-F
  misc_feature: Encodes the peptide sequence at SEQ ID NO. 32440
  misc_feature (438)..(438): n is a, c, t, g, unknown, or other
  misc_feature (469)..(469): n is a, c, t, g, unknown, or other
aaagctggagctccccgcggtggcggccgctctagaactagtggatcccccgggctgcaggaattcgcacgagaccattacctagaacatcctaatcgaaaactggatttttcttcacaggtgcttatctcctccccggagctccctgctcctctcttccccagccgtgcccagctcctctgctcgccggccgcgagcccctgtccatggccgcgcgtcttcctccgtctccctgttgtcgtgccctggagttccctacgcgcttctctgctcggtgccctgcttgctcccgatgccgcactcggtcgccatggcgtgcccaggctccagctcccctgcgcgtggctcgccggcgggagctctctggcgcgctcgcccatgccgcgcgcagccgagctcgccctgcgcaccccatctcccaggtgctcggccagctcngcccatggtcgcgcccttgacttcgccccancgcccgaccgtcacttccatggcgcgcccatcccctgcgtcctccccctgcatcgtgccctccattcctccctgttgtcgcgcctggctcgcccccctgcgcgtgtgtcctcgccgcgcccgagcgctctggctcactggtgccgcaaccccagccggaggctcctggcttgcccctggcttcatgactgaccgcgcggttcctctgcgccgtcattctttgcgcccattgcgtggagcttcctccctcgctggc

SEQ ID NO: 32440 - protein, 83 aa, Zea mays
  misc_feature: Ceres CLONE 1409635-F
  misc_feature (78)..(78): Xaa is any aa, unknown, or other
MAARLPPSPCCRALEFPTRFSARCPACSRCRTRSPWRAQAPAPLRVARRRELSGALAHAARSRARPAHPISQVLGQLXPWSRP

SEQ ID NO: 32441 - DNA, 681 bp, Zea mays
  misc_feature: Ceres CLONE 1409636-F
  misc_feature: Encodes the peptide sequence at SEQ ID NO. 32442
  misc_feature (404)..(404): n is a, c, t, g, unknown, or other
  misc_feature (487)..(487): n is a, c, t, g, unknown, or other
  misc_feature (560)..(560): n is a, c, t, g, unknown, or other
  misc_feature (575)..(575): n is a, c, t, g, unknown, or other
  misc_feature (579)..(579): n is a, c, t, g, unknown, or other
  misc_feature (580)..(580): n is a, c, t, g, unknown, or other
  misc_feature (598)..(598): n is a, c, t, g, unknown, or other
  misc_feature (601)..(601): n is a, c, t, g, unknown, or other
  misc_feature (652)..(652): n is a, c, t, g, unknown, or other
aaagctggagctccccgcggtggcggccgctctagaactagtggatcccccgggctgcaggaattcgcacgagaccattacctagaacatcctaattgaaaacttccaatttttctcccaaataaaaaccagccgcagcgggaggtggcgcgacgcgaacccacccaccctgcgaacccggccgcaaaattctcctctcggattccgccgccgcgaaccgtcccctcgacgaggctgctgcgatagatttttcttaccattcgaatagttgatgagcgagaatacagagcaagaatcttgatggtgcgtgtggtacaacttggttaaggaaagctgactgcttgaagtgaccatgttggaccatcttgctatcattgcgtctgagttaggggacgacgcacggnattttggaggttgatggcatcgacaacctcagcgagaacgatgtcagcgactaggagatcgatgctgacgagctcgcccgacnaaatgtggaaggacaaggtcaagctaaagaggatcagggagaggcagcagaagcttgccctgcaggggctggnagctggagaagacangacnnagaagatttcagaccagnccntccggaaaaagatgacgagggccccagacgggatcctcaagaatgctcagnctggatggagtggcaaaggcccggaggtt

SEQ ID NO: 32442 - protein, 79 aa, Zea mays
  misc_feature: Ceres CLONE 1409636-F
  misc_feature (15)..(15): Xaa is any aa, unknown, or other
  misc_feature (39)..(39): Xaa is any aa, unknown, or other
  misc_feature (44)..(44): Xaa is any aa, unknown, or other
  misc_feature (46)..(46): Xaa is any aa, unknown, or other
  misc_feature (52)..(52): Xaa is any aa, unknown, or other
  misc_feature (53)..(53): Xaa is any aa, unknown, or other
  misc_feature (70)..(70): Xaa is any aa, unknown, or other
MSATRRSMLTSSPDXMWKDKVKLKRIRERQQKLALQGLXAGEDXTXKISDQXXRKKMTRAPDGILKNAQXGWSGKGPEV

SEQ ID NO: 32443 - DNA, 702 bp, Zea mays
  misc_feature: Ceres CLONE 1409637-F
  misc_feature: Pfam Name: Invertase_neut Pfam Description: Plant neutral invertase
  misc_feature (560)..(560): n is a, c, t, g, unknown, or other
  misc_feature (639)..(639): n is a, c, t, g, unknown, or other
aaagctggagctccccgcggtggcggccgctctagaactagtggatcccccgggctgcaggaattcgcacgagaccattacctagaacatcctaatcaaaaagattcacagagtcggccagctgcctaggcaccggcgtccggatctcctgctccgctgctcgccgtctcgaggctctccggcgttgactcggcgcggcagcgccccccggtagcctagttccggatcccccaccgcccacgccccacagattgccccacccgcaccacccaccgtacggccggtgcctccccttcctcgtctccgcggcgtcgcagtcgcaggccggcccgggcactcctcccacccttataccagtccccgtcccctccgacccccgcgctgctgtttctggtaacctccctttcttcgaccgtgtcctctatccggactcgttcccgcttgagaccccgccctctaaggaggaggacgcggcagcgcgacagactgatgaggcggtggcaccggctgtccccttgagggaggagacggagacagagagggaggcgtggcgactgctngcggagggcggtcgtcagctactgcggcgagcccgtggggacggtggcggcggagaaccccgagtgcatggagatgctncactacgaccaggtcttcatcagggacttcgtgccctccgtgctcgccttcctcatgcgcggg

SEQ ID NO: 32444 - DNA, 734 bp, Zea mays
  misc_feature: Ceres CLONE 1409639-F
  misc_feature: Encodes the peptide sequence at SEQ ID NO. 32445
  misc_feature (490)..(490): n is a, c, t, g, unknown, or other
  misc_feature (569)..(569): n is a, c, t, g, unknown, or other
  misc_feature (570)..(570): n is a, c, t, g, unknown, or other
  misc_feature (577)..(577): n is a, c, t, g, unknown, or other
  misc_feature (605)..(605): n is a, c, t, g, unknown, or other
  misc_feature (608)..(608): n is a, c, t, g, unknown, or other
  misc_feature (613)..(613): n is a, c, t, g, unknown, or other
  misc_feature (626)..(626): n is a, c, t, g, unknown, or other
  misc_feature (679)..(679): n is a, c, t, g, unknown, or other
aaagctggagctccccgcggtggcggccgctctagaactagtggatcccccgggctgcaggaattcgcacgagaccattacctagaacatcctaatcgaaaactcccaaatcaaatccccaaaccccgggccactgctccgctcctcctccttgccgccgtgcggttgagcgccgacgagcaagcccgacgccaccctatggctatggaggtccgccgcagggttccgccgccgcacgggagcgccccacggcgccagcaggcgaccggcggcgaggggcagcgggtgcgtgtgcaggcgggggacgcgctgccgctgccgatccggcacacgaacctcatcttctcggcgctgttcgccgcgtcgctggtgtacctgatgcggcggtggcgggagaagatccgctcctccacgccgctccacgtggtctccctcgccgagatcttcgccatctgcggcctcgtggcgtcgctcatctacctcctcagcnttcttcgggatcgccttcgtgcagtccgtcgtctccaacagcgacgacgaggaggacttcatcatcgactcccgcccgnnacagggncgcgggcgccgccgccgcccgcgccggnggncccgntggtgctgctggnagccccgccgccgcgccggagaaaatggcggaggaggacgagggagatcgggntcgcggtcgtggcagggaaatcccgtcctacgtgctggagactaggctgggagat

SEQ ID NO: 32445 - protein, 176 aa, Zea mays
  misc_feature: Ceres CLONE 1409639-F
  misc_feature: SWISSPROT Homolog: EC 1.1.1.34 Hydroxymethylglutaryl-CoA reductase (NADPH)
  misc_feature (96)..(96): Xaa is any aa, unknown, or other
  misc_feature (122)..(122): Xaa is any aa, unknown, or other
  misc_feature (125)..(125): Xaa is any aa, unknown, or other
  misc_feature (134)..(134): Xaa is any aa, unknown, or other
  misc_feature (135)..(135): Xaa is any aa, unknown, or other
  misc_feature (137)..(137): Xaa is any aa, unknown, or other
  misc_feature (141)..(141): Xaa is any aa, unknown, or other
  misc_feature (159)..(159): Xaa is any aa, unknown, or other
MEVRRRVPPPHGSAPRRQQATGGEGQRVRVQAGDALPLPIRHTNLIFSALFAASLVYLMRRWREKIRSSTPLHVVSLAEIFAICGLVASLIYLLSXLRDRLRAVRRLQQRRRGGLHHRLPPXTGXRAPPPPAPXXPXVLLXAPPPRRRKWRRRTREIGXAVVAGKSRPTCWRLGWE

SEQ ID NO: 32446 - DNA, 712 bp, Zea mays
  misc_feature: Ceres CLONE 1409640-F
  misc_feature (380)..(380): n is a, c, t, g, unknown, or other
  misc_feature (471)..(471): n is a, c, t, g, unknown, or other
  misc_feature (592)..(592): n is a, c, t, g, unknown, or other
  misc_feature (593)..(593): n is a, c, t, g, unknown, or other
  misc_feature (677)..(677): n is a, c, t, g, unknown, or other
aaagctggagctccccgcggtggcggccgctctagaactagtggatcccccgggctgcaggaattcgcacgagaccattacctagaacatcctaatcgaaaagttcggttgttcctcttcccacttcccctctctctctcgtgcgtgtgtactacttctgaggccgaaaggtcagaagagagtgtccacctttcagttcgattttcgatgatttgagtccttccgccgcggggaatttgagcgttttccttgagaaatttgagtttcttcgagagtaatttgtgtgttttctcttgagagattcgtgcaaggatgtcgccttcgatccatttattgggtagtcaaattgttcctatatagcgtcaaagcatccaactttngacttctccgtggtggctttcttctatcgtgtgtcatccagacaatttgatcttttatttaattgggttggatgcttgttcaggttaggtnagttggaaagggtagcataagacaccatcaattttgggtgatttttggtttttctctgaataattgcgggtcaaattagtcaccttcagttatcagtttttcacttctcatttttattggnnaggattttggtggattttaggtggcgggcagagctttctttcgatcatcggtcctcatttttatggattttggatggttggggnaattggggggtatctttacctttatccctgggtga

SEQ ID NO: 32447 - DNA, 729 bp, Zea mays
  misc_feature: Ceres CLONE 1409641-F
  misc_feature: Encodes the peptide sequence at SEQ ID NO. 32448
aaagctggagctccccgcggtggcggccgctctagaactagtggatcccccgggctgcaggaattcgcacgagaccattacctagaacatcctaatcgaaaaacttccaccccggaccgacaaagcagagcacgcgctggcagccaagtgcacacagacacgtctctctgttcgttctcagcttgctatagcaacctctagtaggtagccatggagatggtcctggactggcgctcgctgggctccctgctggcgaccgtcgtggtgttccgcaccgcgctgcgtaacttcctgccgccggaggccgagatgctcctgcgccgcttcctcgcgtgggtcgccgccgcgttccgcccgcccagcgacaccatcctcatcgacgaggcggacgggcccacggggagcgccaacgacctctacgagtcggcgcagctctacctcagcgcgcgctgcctcgccaccgcgcccgccgtgcgcctgcacaagccgcgccagtcgccgcgccccgtggcgtcgctcccggactccgcaaccaccgacgacaccttccgcggggcccgcgtttagtggactccccccatgtggaccgttctaccgcaccgccattggcggccgagttaacccccactacctattccgtccgggggggcgaccgtttgtgtctccactttctgttctctgtccagcaccgctacctcgatccgctggccctacctctcgcaccctcat

SEQ ID NO: 32448 - protein, 118 aa, Zea mays
  misc_feature: Ceres CLONE 1409641-F
MEMVLDWRSLGSLLATVVVFRTALRNFLPPEAEMLLRRFLAWVAAAFRPPSDTILIDEADGPTGSANDLYESAQLYLSARCLATAPAVRLHKPRQSPRPVASLPDSATTDDTFRGARV

SEQ ID NO: 32449 - DNA, 719 bp, Zea mays
  misc_feature: Ceres CLONE 1409642-F
  misc_feature: Encodes the peptide sequence at SEQ ID NO. 32450
  misc_feature (522)..(522): n is a, c, t, g, unknown, or other
  misc_feature (547)..(547): n is a, c, t, g, unknown, or other
  misc_feature (620)..(620): n is a, c, t, g, unknown, or other
  misc_feature (655)..(655): n is a, c, t, g, unknown, or other
aaagctggagctccccgcggtggcggccgctctagaactagtggatcccccgggctgcaggaattcgcacgagaccattacctagaacatcctaatcgaaaaataaataccactcctgcgattccaccttgcagttggaccggccgttgttgctttgcttcttcgcaaaaaaaaaacaaaaaaacaaaataggcctgtcttgctccgatcaggcgtgttcttaggcttcgctgcccctaccgcgtcttcgccgggatcggtccatggccggcgccgagcgcgcggaggcggtcgcgctggaacaagggctcctcgatccggaggaatccaaccaagtagtatacactggagatggatcagtcgacttttctggaaatcctgttgtcaaggaaagaacgggtagatggaaggcatgtccattcatataaggtaatgaatgctgtgaacgactggcctactatggcatctccacaaaccttgttacttacttgacaaaaaaactgcatgctggcaatgcctcgnctgctagcagtgtgactaacatggntcgggaacttgctacctaactccacttattggagcaatcctggctgagcaaacctgggggggaaggtactggnacaatcgcaacattttccacagtatactttcatcngggatgacactgctgactcttttcagcaatcagtcctatgctcatgcctccattctttgtgaag

SEQ ID NO: 32450 - protein, 54 aa, Zea mays
  misc_feature: Ceres CLONE 1409642-F
MAGAERAEAVALEQGLLDPEESNQVVYTGDGSVDFSGNPVVKERTGRWKACPFI

SEQ ID NO: 32451 - DNA, 597 bp, Zea mays
  misc_feature: Ceres CLONE 1409644-F
  misc_feature: Encodes the peptide sequence at SEQ ID NO. 32452
  misc_feature (247)..(247): n is a, c, t, g, unknown, or other
  misc_feature (296)..(296): n is a, c, t, g, unknown, or other
  misc_feature (301)..(301): n is a, c, t, g, unknown, or other
  misc_feature (305)..(305): n is a, c, t, g, unknown, or other
  misc_feature (306)..(306): n is a, c, t, g, unknown, or other
  misc_feature (309)..(309): n is a, c, t, g, unknown, or other
  misc_feature (326)..(326): n is a, c, t, g, unknown, or other
  misc_feature (338)..(338): n is a, c, t, g, unknown, or other
agagctggagctccccgcggtggcggccgctctagaactagtggatcccccgggctgcaggaattcgcacgagaccattacctagaacatccctaatcaaaaaagcaaccacttctgctctgcatcccgtctgggcctctgcatttgcttggctgctgctcccttctcccaccgaccaactcgatcccgcgccatggatcgcgccgaccccgcgcggggccgccttgccgtgctctcctcccacctnccgtggtgcaggggccgaggaggcggcggggctggagaaggtcgccggnatccngcgnncgngcccgggccccgcgcgngcgcttgccgtntgggacggagaccggaagcgcacgaggtcaaggcttcgaagacggaccggggcggcaacgacttcagaaattacccctggaaaggacaaaagggcctaaaaaattaggagcccggggaacctaaaaacgggcccctggggtccccctccccactttgtgaaaaaaggggggggggaaaggggaaaaccctctcatagggggggttcacaccacaaaaaaaatttgggaaaaaaacccctctttgttggggggggggccc

SEQ ID NO: 32452 - protein, 83 aa, Zea mays
  misc_feature: Ceres CLONE 1409644-F
  misc_feature (35)..(35): Xaa is any aa, unknown, or other
  misc_feature (38)..(38): Xaa is any aa, unknown, or other
  misc_feature (39)..(39): Xaa is any aa, unknown, or other
  misc_feature (45)..(45): Xaa is any aa, unknown, or other
  misc_feature (49)..(49): Xaa is any aa, unknown, or other
MDRADPARGRLAVLSSHLPWCRGRGGGGAGEGRRXPAXXPGPRAXACRXGRRPEAHEVKASKTDRGGNDFRNYPWKGQKGLKN

SEQ ID NO: 32453 - DNA, 651 bp, Zea mays
  misc_feature: Ceres CLONE 1409646-F
  misc_feature (388)..(388): n is a, c, t, g, unknown, or other
  misc_feature (404)..(404): n is a, c, t, g, unknown, or other
  misc_feature (405)..(405): n is a, c, t, g, unknown, or other
  misc_feature (411)..(411): n is a, c, t, g, unknown, or other
  misc_feature (436)..(436): n is a, c, t, g, unknown, or other
  misc_feature (443)..(443): n is a, c, t, g, unknown, or other
  misc_feature (458)..(458): n is a, c, t, g, unknown, or other
  misc_feature (459)..(459): n is a, c, t, g, unknown, or other
  misc_feature (585)..(585): n is a, c, t, g, unknown, or other
  misc_feature (591)..(591): n is a, c, t, g, unknown, or other
agagctggagctccccgcggtggcggccgctctagaactagtggatcccccgggctgcaggaattcgcacgagaccattacctagaacatcctaatcgaaaagagcagcagaccacgaccagcacgcccacttgcctgcgattactttgcgccagagggcagaggccttggccctgccatcgttgttcttatccccccttcctctttctttctcctccctcttgcggcttctctctggactcgcccctccctccgtctcgtctcccaggtcatggcaaagctggaacacccgtgaatatagcaagtgggagataaacaggaagagctagggtgaatactaaatacaagtagcagtagaaggaaaagagtcagtccgcccgtgactacnagtgaatttgtgggtnngtgtgnttttgttgaggtcacgatgatgggnaggcggnctggtggtggatcannagcgtggtgttcccctggcgtcaccaacttcgtggatctcctgcagcagaacgggcgacagaacttggggcttcgggtctctgatggccgcagaccgtctctggcgaccaatgggggtaagggggnaaaggnaaatctcggggacccggcctccggaaagttccccggaccccccgggaaggacaaccccaa

SEQ ID NO: 32454 - DNA, 705 bp, Zea mays
  misc_feature: Ceres CLONE 1409647-F
  misc_feature (543)..(543): n is a, c, t, g, unknown, or other
  misc_feature (544)..(544): n is a, c, t, g, unknown, or other
  misc_feature (563)..(563): n is a, c, t, g, unknown, or other
  misc_feature (593)..(593): n is a, c, t, g, unknown, or other
  misc_feature (611)..(611): n is a, c, t, g, unknown, or other
  misc_feature (612)..(612): n is a, c, t, g, unknown, or other
  misc_feature (647)..(647): n is a, c, t, g, unknown, or other
tggagctccccgcggtggcggccgctctagaactagtggatcccccgggctgcaggaattcgcacgagaccattacctagaacatcctaaaaaaaatacgatcaggtctagatcttatcggattatcgttttttgttgcctaggcgtgatgtgatttcgttggattgctgttggaagctattttttctgatctggatcggcctaaaagcaactccaagaacgagttctaaacttgagccttaaaatttgtgttaggaccttatttgatttatttaggatctccaacaaccaggccttaaaatcaggatacccagcttccatcttctctgccaggcaacgcgcttttttctagcatatccttctcgtcagctacgcattcgttcgcaatcggccgcatgaggcccacatcatccttcctcaagggctgcacagttaagcgcgacggctgcacatcacggctgcaaggtacagctcgacggctgctggtaggggcatcagcattaccgcatcatcccctgcacggtaggcccttgacccctgcanncatacgctggacggctacnagacgagtggtgggcgagtctgctcgctgnaggttgggtgcgtggacnnagtgaatagttcatttagaacctgctgcagatttngcacaaaacatgtatgcaactaggagatctatgatccatctcgaagatgaagaattaa

SEQ ID NO: 32455 - DNA, 688 bp, Zea mays
  misc_feature: Ceres CLONE 1409651-F
  misc_feature: Translation starting site: 390
aaagctggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgccccgggagaggcaagcggaggttgccgccgctgcggcgtcgggtggccgacgtggcggagctccaggtcggctgcctcgacagcttcgagccatgcagggacctgcccgtgcttctcgcccagccccgctcgctccccgtcatcgtcacctacagggcgaatttgggagggaggccagtacgcaggcgaagatgagccacggtttgaggcgcttctactggca

SEQ ID NO: 32456 - DNA, 703 bp, Zea mays
  misc_feature: Ceres CLONE 1409652-F
  misc_feature (444)..(444): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (533)..(533): n is a, c, t, g, unknown, or other
  misc_feature (550)..(550): n is a, c, t, g, unknown, or other
aaagctggagctccccgcggtggcggccgctctagaactagtggatcccccgggctgcaggaattcgcacgagaccattacctagaacatcctaatcgaaaaatatgactctctccctagtccctacactttctcccccgtgtcccgttgctaaaagcttagagaaaaacctaatcggacagcactgtggccaagcagggcgcgggagatcgtacgccggcggcgaggtcctgcggtggcgggcctcggcagagtggtggtgctagcggagtgcagctgttgggttggtgggtaagagtgagaaggacatgaaggcgctgcggcgatccagcacctcgtcctcgccgacggccgcgtcctcccctccgtcctcatcgtggatccacatccggtcgctcctcgccgccgccgcgtcctcgtcctcgtcctcctccttcgcagcgnctgcggttgggagcgcggtggcttgtggtgtcnnncttgcgtggccgcctcgtcttcttcctcgccggcgtcgtcctcgccgactcggnagcggggtggtcttaantctccatggtcccggaggaaagaaaacgagcactttctcgtgaacagtgggagagtttgttttcagcaaatggaaaacttcgggatggtggaagggaaatttctcaagaaagttcgcagggggggcattgagcaaggattaggggctgagttt

SEQ ID NO: 32457 - DNA, 681 bp, Zea mays
  misc_feature: Ceres CLONE 1409653-F
  misc_feature (406)..(406): n is a, c, t, g, unknown, or other
  misc_feature (436)..(436): n is a, c, t, g, unknown, or other
  misc_feature (437)..(437): n is a, c, t, g, unknown, or other
  misc_feature (452)..(452): n is a, c, t, g, unknown, or other
  misc_feature (453)..(453): n is a, c, t, g, unknown, or other
  misc_feature (484)..(484): n is a, c, t, g, unknown, or other
  misc_feature (503)..(503): n is a, c, t, g, unknown, or other
gctggagctccccgcggtggcggccgctctagaactagtggatcccccgggctgcaggaattcgcacgagaccattacctagaacatcctaatcgaaaaccccgtccctccactcctcccgtcgagcacttggcactgccaatggcggcagccgcccacaccccttcgatgcgtgcaagccgcctcctttcctcctgagatcgacgcacctcctcctctcgtactccattcccgctccaagtttgtttcttcggcaccgagccatcgcacggccgcccccgcatctcgtcctgctctcaggtccttggcctccgccgttcttcgacaggggcgcgacccggtgcccactccgcgaaatccgagtccctcgtgcagctccgtagggtggaagagatcccatcagcgntgagcggtaggaagcgccccgtacactganngggcgggcaatggcnnggcgtgcaggcccactctgcacgtggctcgntgccgcgtgcttgtctgcngcttgcgacgcaaaagagtacaagcataagcatggctggccccgcggaaagcgccgctgggggcggggtcatgctccggcaggggcggccgcctcggggcggggggtcccggtttggcgggctccggaatgggctatggctggtgccttacaagctggaagaagggcctttgaaaaaa

SEQ ID NO: 32458 - DNA, 706 bp, Zea mays
  misc_feature: Ceres CLONE 1409657-F
  misc_feature: Encodes the peptide sequence at SEQ ID NO. 32459
aaagctggagctccccgcggtggcggccgctctacaactagtggatcccccgggctgcaggaattcgcacgagaccattacctagaacatcctaatcgaaaaaaaatccccacaaaccgctctctccctctcgcctcccgcccctaattcccatcccccacctccaaatcccacatcactcaaaaccctcgccgcgcccctgctgcgcgcccccccgatggcagccgtcgcgtcctcggaggaggccgtcaaggcggcgaaggtgctgatggtcggagcgggtggcatcggctgtgagctgctcaagacgctcgctctctccggattcagcgacatacacatcattgatttggatacaattgaagttagcaatctgaatagacagtttttgtttcgacagagccatgttgggcaatcaaaagctaaagttgctcgggatgccgtgttgaaatttaggccaaatatcaatataacaccataccatgcgaacgtgaaggattctcatttcaatgttgattttttcaagcagtttaatgttgttctgaatggtcttaataacttggatgctagacgccatgttaatcgcctttgccttgctgctgaagttcctttggttgaaagtggaactactgccttttttgcgaagcgtcaccgttcatgccacgggtaacaccgaaaggaaacgagcgcaaccaaaagccgaccc

SEQ ID NO: 32459 - protein, 150 aa, Zea mays
  misc_feature: Ceres CLONE 1409657-F
  misc_feature (12)..(145): Pfam Name: ThiF Pfam Description: ThiF family
MAAVASSEEAVKAAKVLMVGAGGIGCELLKTLALSGFSDIHIIDLDTIEVSNLNRQFLFRQSHVGQSKAKVARDAVLKFRPNINITPYHANVKDSHFNVDFFKQFNVVLNGLNNLDARRHVNRLCLAAEVPLVESGTTAFFAKRHRSCHG

SEQ ID NO: 32460 - DNA, 699 bp, Zea mays
  misc_feature: Ceres CLONE 1409660-F
  misc_feature (292)..(292): n is a, c, t, g, unknown, or other
  misc_feature (417)..(417): n is a, c, t, g, unknown, or other
  misc_feature (510)..(510): n is a, c, t, g, unknown, or other
aaagctggagctccccgcggtggcggccgctctagaactagtggatcccccgggctgcaggaattcgcacgagaccattacctaagaacatcctaaaaataatcacagattcacagagcgctagggaggagagagggctagggtttcgtgctccctcacgcaacgaatccgagccggatcggggggtgcgcggagtcaccggcggcccggcgttgcctgggctgtgatacagttgcaatggcatctgtaactgatgagacagctaagattgagggtttgacatctgctgcangcctttgtggagggtggcattcaggacgcatgtgatgatgcatgcagcatttgccttgaggctttctgtgagagtgacccttctgcattgactggctgcaaacatgagttccatctccaatgcanttcttgaatgggggccagagaagttcacagtgcccaatgtgttggcagcctatttactatgaaggatcctaccagtcaggagctgcttgaggnagtagagcgtgagaggaatataagaactaatcaaactcggaacacaactatatttctcatctgcttccttgggggattttgagctgcagcatctgctggttggtaatgatgctgagctttgaagagcgtatactgcagcatctagctgtgctgtgggcatgggaggcccacaccattcttggaaaggag

SEQ ID NO: 32461 - DNA, 716 bp, Zea mays
  misc_feature: Ceres CLONE 1409662-F
  misc_feature: Encodes the peptide sequence at SEQ ID NO. 32462
  misc_feature (401)..(401): n is a, c, t, g, unknown, or other
  misc_feature (618)..(618): n is a, c, t, g, unknown, or other
  misc_feature (619)..(619): n is a, c, t, g, unknown, or other
  misc_feature (681)..(681): n is a, c, t, g, unknown, or other
  misc_feature (713)..(713): n is a, c, t, g, unknown, or other
aaagctggagctccccgcggtggcggccgctctagaactagtggatcccccgggctgcaggaattcgcacgagaccattacctagaacatcctaattgaaaacttccaatttttctcccaaataaaaaccagccgcagcgggaggtggcgcgacgcgaacccacccaccctgcgaacccggccgcaaaattctcctctcggattccgccgccgcgaaccgtcccctcgacgaggctgctgcgatagatttttcttaccattcgaatagttgatgagcgagaatacagagcaagaatcttgatggtgcgtgtggtacaacttggttaaggaaagctgactgcttgaagtgaccatgttggaccatcttgctatcattgcgtctgagttaggggacgacgcancggattttgaggttgatggcatcgacaacctcagcgagaacgatgtcagcgactaggagatcgatgctgacgagctcgcccgacgaatgtggaaggacaaggtcaagctaaagaggatcagggagaggcagcagaagcttgccctgcagcggctggagctggagaagaccagacaaagaagatttcagaccaagccctccggaaaaagatgacgagnngcccaggacgggatcctcaagtaatgctcagcctggatggaggtggcaatgggcccgaaggnttccgtgtacgggatcatttcctgagaaagtnaag

SEQ ID NO: 32462 - protein, 34 aa, Zea mays
  misc_feature: Ceres CLONE 1409662-F
  misc_feature (17)..(17): Xaa is any aa, unknown, or other
MLDHLAIIASELGDDAXDFEVDGIDNLSENDVSD

SEQ ID NO: 32463 - DNA, 707 bp, Zea mays
  misc_feature: Ceres CLONE 1409666-F
  misc_feature: Translation starting site: 231
  misc_feature (390)..(390): n is a, c, t, g, unknown, or other
  misc_feature (573)..(573): n is a, c, t, g, unknown, or other
  misc_feature (629)..(629): n is a, c, t, g, unknown, or other
  misc_feature (688)..(688): n is a, c, t, g, unknown, or other
  misc_feature (694)..(694): n is a, c, t, g, unknown, or other
  misc_feature (695)..(695): n is a, c, t, g, unknown, or other
aaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaaccggttccaggtgatcctgcagcgacggnccttcatgtacgtggtgcgcgacctcccgggagaagtacgggcccatcttcaccatggcggatggggcagcgcacccctcatcgtggtcacctcggcggagctcatccacgaggcgctgggtgaagcagggccccatgttcgcgagccggcccgaggacagccccacccgcctcctcttcagngtcggcaagtgcaccgtcaactcggcgcctacgccccccctggtgcgtgctctgcngccgcactcgtcgccgagatcgtgtcccgcaccgcgtcagggctcttctgggatccggnattggnncggggaccgcac

SEQ ID NO: 32464 - DNA, 706 bp, Zea mays
  misc_feature: Ceres CLONE 1409668-F
  misc_feature: Encodes the peptide sequence at SEQ ID NO. 32465
  misc_feature (670)..(670): n is a, c, t, g, unknown, or other
aaagctggagctccccgcggtggcggccgctctagaactagtggatcccccgggctgcaggaattcgcacgagaccattacctagaacatcctaatcaaaaactacgagagccaagctggggaagagtccacgactctgacggtcccttctcgtgtcgtgtcctctcctctcctcgggggatccggcaccgacccaccgcccctctgatcgttccttccgtcggaatcgctgctcctctctgtgtgctgtggatttgtgcggcgactgttagtttggatcggtcccatccttctgttgatcaatggctgacggtgaggatatccagccacttgtgtgtgacaatggcactggaatggtcaaggctggctttgctggtgatgatgcgcccagagcagtgttccctagtatagtcggccgcctcggtacacgtgtgtgatgggttgaaatgtcccataaggacgcctatgtaggtgacgaggcacagtcagaaagaggtatcttggaccttgaagtaccccattgagcacggtatcgtgaacaactggatgatatggagaaaatctggcaccacaccttctacaatgaactgcgtgttgctcctgaagagcacccagttctgctgacagaagcacctctgaacccaaggcaaacggagaggagatgacccanattatgttcgagacattcaatgcaccagcaatgtat

SEQ ID NO: 32465 - protein, 44 aa, Zea mays
  misc_feature: Ceres CLONE 1409668-F
  misc_feature: SWISSPROT Homolog: EC 2.7.10.2 Non-specific protein-tyrosine kinase
MADGEDIQPLVCDNGTGMVKAGFAGDDAPRAVFPSIVGRLGTRV

SEQ ID NO: 32466 - DNA, 722 bp, Zea mays
  misc_feature: Ceres CLONE 1409669-F
  misc_feature (460)..(460): n is a, c, t, g, unknown, or other
  misc_feature (541)..(541): n is a, c, t, g, unknown, or other
  misc_feature (545)..(545): n is a, c, t, g, unknown, or other
  misc_feature (546)..(546): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (609)..(609): n is a, c, t, g, unknown, or other
  misc_feature (631)..(631): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
aaagctggagctccccgcggtggcggccgctctagaactagtggatcccccgggctgcaggaattcgcacgagaccattacctagaacatcctaatcaaaaaaaactcggctctttctcgctttctttctcccgttcacgccggctctacctgcgataggttcgtctctctcgtggcaacgactgaccgccgccctcgcccccgcccccgcgcaggttcccaggtcttcgccggtcccttcgccgtcaaagagcacccactaggttaaatctgccagcaggacatctccatcaagtgactggtgctaattatgcgatcttcatgggctgactcagttgcgaacgccgaggaatcggcgcccgcgactgctgctgctaacggctctgttgcaactcatagcaactcgcgccctacgcgcagctcctacgtgcctcctcatctccgtggccgctcagctggntgctgctgttggagctcaagcaggctcagtagcaccagcacaaggtggaccactgccattggctgctgcacaacttctggncagnngcgctggttgttggtgggcctcgctgggctggcatgtgaatgggggggggggggggggnnnancgttggtgctcctcccagggtnatggtggggggggggggggggnnnnnnnnnnnnnnnnnnnnnngggnnngggnnnnnggggggnnngggnnnnnnnnnnnnnggggggggg

SEQ ID NO: 32467 - DNA, 711 bp, Zea mays
  misc_feature: Ceres CLONE 1409670-F
  misc_feature: Encodes the peptide sequence at SEQ ID NO. 32468
  misc_feature (546)..(546): n is a, c, t, g, unknown, or other
  misc_feature (598)..(598): n is a, c, t, g, unknown, or other
  misc_feature (653)..(653): n is a, c, t, g, unknown, or other
  misc_feature (654)..(654): n is a, c, t, g, unknown, or other
aaagctggagctccccgcggtggcggccgctctagaactagtggatcccccgggctgcaggaattcgcacgagaccattacctagaacatcctaatcgaaaaaaaccctaaccccatcccgcactccccccctcccccaacacgcgcgtgctttcttagccgctaagcatatccctccccgccacgatctcgatggtggagatgtctgtggtggagctcaggacgctgccgctcggcttccgcttccaccccaccgacgaggagctcgtcacccactacctcaagggcaagatcaccggcaggatcaactccgagtccgaggtcatccccgagatcgacgtctgcaagtgcgagccgtgggacctcccagataagtccctgatccggtccgacgatcctgagtggttcttcttcgcccccaaggaccgcaagtaccccaacggtagcaggtcgaacagggccaccgaggcgggatactggaaggctactggcaaggacaggataatcaaatccaagggcgacaagcgcaagcagcatactcatcgntatgaagaagaccctcgtcttccacccgtggtcgtgcccccaagggcggcgncacgggggtggattatgcacgagtaccgcacaccgagccttgagttcgagccggnnaacaaggggggggttatgttctttatcgccctcttccgtaagcaagaggagaaaatg

SEQ ID NO: 32468 - protein, 173 aa, Zea mays
  misc_feature: Ceres CLONE 1409670-F
  misc_feature (12)..(147): Pfam Name: NAM Pfam Description: No apical meristem (NAM) protein
  misc_feature (136)..(136): Xaa is any aa, unknown, or other
  misc_feature (154)..(154): Xaa is any aa, unknown, or other
MVEMSVVELRTLPLGFRFHPTDEELVTHYLKGKITGRINSESEVIPEIDVCKCEPWDLPDKSLIRSDDPEWFFFAPKDRKYPNGSRSNRATEAGYWKATGKDRIIKSKGDKRKQHTHRYEEDPRLPPVVVPPRAAXRGWIMHEYRTPSLEFEPXNKGGVMFFIALFRKQEEKM

SEQ ID NO: 32469 - DNA, 767 bp, Zea mays
  misc_feature: Ceres CLONE 1409673-F
aaagctggagctcaccgcggtggcggccgctctagactagtggatcccccgggctgcaggaattcgcacgagaccattacctagaacatcctaatcgaaaaaggctcctctcccccgttgcgcaacgcgctttcccccacttcacccgcctcggcgccatggctaagctcgcgctggcgctcctcctcctgctggccgagccggatcgctcgagggccagcaccggctctgacctggatcccggcgggccctgcctctctgctggggatttctcgagctccggccgcgtccagttccgcatctgcctccgcgaggagtactcccacgtagcccctgccgcgcgtgccctgagggagcatcacttgtccgcgcgcgcctcctccccggtagcccgggcaagccagcccgacgcacttccgctccgcggccgcccctggcggatggcagaagattggctgccgcacgggtgggccacacccctagcgttgcccccccgtgcccgccgcgttgattcttgcccccccccagtggtgccctccctcccaccccgtatgccccccccaccctcgcctccccgctccgcgactccagcacctggtctccaccgcactcccctcccgctctctcctcccacaccgcaagcggtcccatgtcccgcgccccgcctgtactcgcctccgccccgtcaccgtgggtttgtcagccgggcgccccgcgtcgcacctggattaactctgcgcacccgggcgcgactatctccacccatg

SEQ ID NO: 32470 - DNA, 734 bp, Zea mays
  misc_feature: Ceres CLONE 1409675-F
  misc_feature (215)..(215): n is a, c, t, g, unknown, or other
  misc_feature (230)..(230): n is a, c, t, g, unknown, or other
  misc_feature (239)..(239): n is a, c, t, g, unknown, or other
  misc_feature (253)..(253): n is a, c, t, g, unknown, or other
  misc_feature (255)..(255): n is a, c, t, g, unknown, or other
  misc_feature (258)..(258): n is a, c, t, g, unknown, or other
  misc_feature (262)..(262): n is a, c, t, g, unknown, or other
  misc_feature (267)..(267): n is a, c, t, g, unknown, or other
  misc_feature (273)..(273): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (296)..(296): n is a, c, t, g, unknown, or other
  misc_feature (303)..(303): n is a, c, t, g, unknown, or other
  misc_feature (314)..(314): n is a, c, t, g, unknown, or other
  misc_feature (348)..(348): n is a, c, t, g, unknown, or other
  misc_feature (350)..(350): n is a, c, t, g, unknown, or other
  misc_feature (365)..(365): n is a, c, t, g, unknown, or other
  misc_feature (368)..(368): n is a, c, t, g, unknown, or other
  misc_feature (370)..(370): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (450)..(450): n is a, c, t, g, unknown, or other
  misc_feature (451)..(451): n is a, c, t, g, unknown, or other
  misc_feature (471)..(471): n is a, c, t, g, unknown, or other
  misc_feature (478)..(478): n is a, c, t, g, unknown, or other
  misc_feature (503)..(503): n is a, c, t, g, unknown, or other
  misc_feature (662)..(662): n is a, c, t, g, unknown, or other
  misc_feature (703)..(703): n is a, c, t, g, unknown, or other
agagctggagctccccgcggtggcggccgctctagaactagtggatcccccgggctgcaggaattcgcacgagaccattacctagaacatcctaatcgaaaaaacgacttcctgcagtcctgcgctgcgcccctcctttccgcctccacgctgccgacgtccaccacacagcacggtcgagtcacccgatccctccatggcggcggcgtcgccgncgatgctggctgcgncatgagcgnggaggaggaggcgncnccngcgncgggnagaacngcgcccccacggnnnggaccgcngccggcncgcgggcgggnccccccccgggggccccggacgaccaacgcgagnancggcccggcccccgncgnanggggccaggggccggacgcagccgcccccccccccggggagnnnccccgcggccccccccgggggcggggggagcagcannccgccacccgcggggagccncccccgncgaccccccgccgcgccggagcggngaaggggcgcgcgcgcccccccccccggcgaggcgacccggagcgcgcccccccccgagcccaaagaacagaccgggccgggcccaccccaaacgggccccaccacccgcgcaccaacgcggcgcccgaacggccccccagacacgcccagccccgcgnaggacacccccgccgcaccggcgccgacacaccccgggaanaaacccggcgcgccacgccaccacacgccca

SEQ ID NO: 32471 - DNA, 712 bp, Zea mays
  misc_feature: Ceres CLONE 1409676-F
  misc_feature: Encodes the peptide sequence at SEQ ID NO. 32472
  misc_feature (588)..(588): n is a, c, t, g, unknown, or other
  misc_feature (589)..(589): n is a, c, t, g, unknown, or other
  misc_feature (692)..(692): n is a, c, t, g, unknown, or other
ggagctccccgcggtggcggccgctctagaactagtggatcccccgggctgcaggaattcgcacgagaccattacctagaacatcctaatcgaaaaaggaatggcgtacgcggcggggcggaagaagcgggtgggccgctacgaggtgggccggaccatcggccagggcaccttcgccaaggtcaagttcgccgtcgacgccgacaccggcgcgcccgtcgccatgaaggtgctcgacaaggagaccatcttcgcccaccgcatgctccaccagatcaaaagggaaatatcaatcatgaagatcgtaagacatcccaacatagtcaggcttaatgaggtgttggcagggaagacgaagatatacataatcttggaacttgtcaatggaggcgaactgtttgataaaatagcccgatatgggaagctacgtgagaatgaagccaggaagtatttccagcagcttattgatgccattgattattgccacagcaaaggagtttatcatagggatttgaagcctgaaaatatgcttcttgactcacgtgaaaacttaaaagtttctgattttggacttagtacactgtctcnnaaatggagcaggacttcttcacacaacatgtggaacaccaaatatgttggctctgaggtgctaggtagcgatgggatatgacggacctgagcaacattggggncatgtgtgtcattctctagt

SEQ ID NO: 32472 - protein, 189 aa, Zea mays
  misc_feature: Ceres CLONE 1409676-F
  misc_feature (14)..(189): Pfam Name: Pkinase Pfam Description: Protein kinase domain
  misc_feature: SWISSPROT Homolog: EC 2.7.11.1 Non-specific serine/threonine protein kinase
  misc_feature (163)..(163): Xaa is any aa, unknown, or other
MAYAAGRKKRVGRYEVGRTIGQGTFAKVKFAVDADTGAPVAMKVLDKETIFAHRMLHQIKREISIMKIVRHPNIVRLNEVLAGKTKIYIILELVNGGELFDKIARYGKLRENEARKYFQQLIDAIDYCHSKGVYHRDLKPENMLLDSRENLKVSDFGLSTLSXKWSRTSSHNMWNTKYVGSEVLGSDGI

SEQ ID NO: 32473 - DNA, 664 bp, Zea mays
  misc_feature: Ceres CLONE 1409677-F
  misc_feature: Encodes the peptide sequence at SEQ ID NO. 32474
aaagctggagctcaccgcggtggcggccgctctagtaatagtggatcccccgggctgcaggaattcgcacgagaccattacctagaacatcctaatcgaaaacacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagcccaggtccctgcccctcccctcggggtcgagaagaagcttgaaagcctcccagctatgggtagtgggggttattcggaagataataaccttcaacttggaggcaccacacaattccgcaaatttgtccccaaaaaagaagaagtccccccaaccgaagaagttattcaaaacaaggtggaagtcccaagaattggggcaagcctcccacccaaaaaaggattttccccccaactggaa

SEQ ID NO: 32474 - protein, 134 aa, Zea mays
  misc_feature: Ceres CLONE 1409677-F
  misc_feature (4)..(92): Pfam Name: IBB Pfam Description: Importin beta binding domain
MSLRPSERVEVRRNRYKVAVDAEEGRRRREDNMVEIRKSRREESLLKRRREGLQAQVPAPPLGVEKKLESLPAMGSGGYSEDNNLQLGGTTQFRKFVPKKEEVPPTEEVIQNKVEVPRIGASLPPKKGFSPQLE

SEQ ID NO: 32475 - DNA, 625 bp, Zea mays
  misc_feature: Ceres CLONE 1409679-F
  misc_feature: Encodes the peptide sequence at SEQ ID NO. 32476
  misc_feature (424)..(424): n is a, c, t, g, unknown, or other
  misc_feature (625)..(625): n is a, c, t, g, unknown, or other
aaagctggagctccccgcggtggcggccgctctagaactagtggatcccccgggctgcaggaattcgcacgagaccattacctagaacatcctaatcgaaaacttgtcctccgactcttccattccattctattcccgcttccacacgtcggtcggcgcccttcgcgatcgtgtcgtttcttcccgcagcctgcctgcgtgtggggtgatggctaggcacttcaagtacgtcatcctcggcggcggtgtcgcggcggggtacgcggcgagggagttcgccaagcagggcgtcaaccccggcgagctcgccatcatctccaaggaaccagtggccccttatgagcgcccctgcactcagcaagggatacctcttccctcagaacgctgcaagactggccagcttccacacgtgtgtgggcaccgntggagagagactacttccctgatggaactctgagaaaggatttgactgatcctgagtactgagatggtgagggccgacttgcttcaaagattctgaccaggggagttgcggaaaacctcccatttgaaaaccttggttattggtaggggctccccggcaaaaaagctcctgaattttgggggtcaaggagaaaaaatcaan

SEQ ID NO: 32476 - protein, 82 aa, Zea mays
  misc_feature: Ceres CLONE 1409679-F
  misc_feature: SWISSPROT Homolog: EC 1.6.5.4 Monodehydroascorbate reductase (NADH)
MARHFKYVILGGGVAAGYAAREFAKQGVNPGELAIISKEPVAPYERPCTQQGIPLPSERCKTGQLPHVCGHRWRETTSLMEL

SEQ ID NO: 32477 - DNA, 644 bp, Zea mays
  misc_feature: Ceres CLONE 1409683-F
  misc_feature: Encodes the peptide sequence at SEQ ID NO. 32478
  misc_feature (605)..(605): n is a, c, t, g, unknown, or other
  misc_feature (644)..(644): n is a, c, t, g, unknown, or other
tagagctggagctccccgcggtggcggccgctctagaactagtggatcccccgggctgcaggaattcgcacgagaccattacctagaacatcctaatcaaaaaatctcacggctagctagcacaagcatagtgcaggggcttgccacctaagtaaggcccgcctgagagccatggcatccaaggccgtcctcttcttggctctcaacctcctgttcttcacggtggccaacgcctgcggcaactgcccgaccccaacgcccccggtcgagccaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggcggtggaggatcccatgttgatccatttgacatcttctcatcattttttggaccctcttttggnagaggtggtggaagcagcaggggaagaaagcaaaggagn

SEQ ID NO: 32478 - protein, 116 aa, Zea mays
  misc_feature: Ceres CLONE 1409683-F
  misc_feature (13)..(71): Pfam Name: DnaJ Pfam Description: DnaJ domain
MFGRAPKKSDNTKYYEILGVPKSASQDDLKKAYRKAAIKNHPDKGGDPEKFKELAQAYEVLSDPEKREIYDQYGEDALKEGMGGGGSHVDPFDIFSSFFGPSFGRGGGSSRGRKQR

SEQ ID NO: 32479 - DNA, 635 bp, Zea mays
  misc_feature: Ceres CLONE 1409701-F
  misc_feature (355)..(355): n is a, c, t, g, unknown, or other
  misc_feature (360)..(360): n is a, c, t, g, unknown, or other
  misc_feature (368)..(368): n is a, c, t, g, unknown, or other
  misc_feature (372)..(372): n is a, c, t, g, unknown, or other
  misc_feature (375)..(375): n is a, c, t, g, unknown, or other
  misc_feature (377)..(377): n is a, c, t, g, unknown, or other
  misc_feature (379)..(379): n is a, c, t, g, unknown, or other
  misc_feature (381)..(381): n is a, c, t, g, unknown, or other
  misc_feature (382)..(382): n is a, c, t, g, unknown, or other
  misc_feature (387)..(387): n is a, c, t, g, unknown, or other
  misc_feature (415)..(415): n is a, c, t, g, unknown, or other
  misc_feature (424)..(424): n is a, c, t, g, unknown, or other
  misc_feature (438)..(438): n is a, c, t, g, unknown, or other
  misc_feature (439)..(439): n is a, c, t, g, unknown, or other
  misc_feature (442)..(442): n is a, c, t, g, unknown, or other
  misc_feature (443)..(443): n is a, c, t, g, unknown, or other
  misc_feature (456)..(456): n is a, c, t, g, unknown, or other
  misc_feature (458)..(458): n is a, c, t, g, unknown, or other
  misc_feature (477)..(477): n is a, c, t, g, unknown, or other
aaagctggagctccccgcggtggcggccgctctagaactagtggatcccccgggctgcaggaattcgcacgagaccattacctagaacatcctaatcgaaaaagttccccaaattcccaacgccgccgcgacggcgctgctagctagtctttggtgttgtaggtgttcgattcctgattccaaattccagactccaaactcggttcttcaatcgacagattccgatttacatcccaaagctcttcggattgaaatccagccgcgacccaagagataagagtatttgggattagtagataggatagtagaatagaagaggaacactttcgctgatgattacggcggagaaaaaagnccccnaaaaaggnaggnagnangnanngagcnaacccccgcgcgcggaggcttttctggnagatcatcntgccgcgtccccgnncgnngaaggtggaggcngncccttgtccgctttggggnatcgggccccacggccgaggtcgagggactggtgctccagtcccgggaatggtaccagggcccttaagtccgcggcccgtttcttccgttgggggggggaaatcccgggtccaaccccccccacccagggaccccccttgcgcaatcctcggaaaggc

SEQ ID NO: 32480 - DNA, 473 bp, Zea mays
  misc_feature: Ceres CLONE 1409707-F
  misc_feature: Encodes the peptide sequence at SEQ ID NO. 32481
  misc_feature (330)..(330): n is a, c, t, g, unknown, or other
aaagctggagctccccgcggtggcggccgctctagaactagtggatcccccgggctgcaggaattcgcacgagaccattacctagaacatcctaatcaaaaaacatatccccactctagccaagtagtcagtcctctccaatctccactctcctctcgcaccaccaaaaaaccggtcccaccgttcgccatgagctccgaagccggatgctcagctccagccgccgccgcgccggatggggcgggtggcggcagggtggagatcgacacgtccgcgccgttcgagtccgtgcggggagggcgtcgaaccgtttcggtgggcaagcggcgncctggaagctcccgaccctcctccagggggattggttcccgcccccccccccaaaaaaacatagaaaacctttttagcaaaaggttgaaaagggccctcaccccccggagagaaaatgttcccatttaaaaaaaaaaggtggg

SEQ ID NO: 32481 - protein, 89 aa, Zea mays
  misc_feature: Ceres CLONE 1409707-F
MSSEAGCSAPAAAAPDGAGGGRVEIDTSAPFESVRGGRRTVSVGKRRPGSSRPSSRGIGSRPPPQKNIENLFSKRLKRALTPRRENVPI

SEQ ID NO: 32482 - DNA, 638 bp, Zea mays
  misc_feature: Ceres CLONE 1409709-F
  misc_feature: Encodes the peptide sequence at SEQ ID NO. 32483
  misc_feature (638)..(638): n is a, c, t, g, unknown, or other
aaagctggagctccccgcggtggcggccgctctagaactagtggatcccccgggctgcaggaattcgcacgagaccattacctagaacatcctaatcgaaaaaacacgaggagagactgcggcagcggagtgcagagagcggacgcaacgcaacaccgcccactctctatcactgacgatcgaagcgaggagcgcactgaagccagccgccgatgagtcgcctcctctcgcggcagcaccttgccgccgtccgtcgatctgcaccctttgcgtgcgtgtccaggtggctgcacacgccgtcattcgcgacggtgtctccgcaagaggtttcaggttccagcccagcggaagtgcagaattttgtgcagggcagctggacagcatctgctaactggaactggatagtcgatcccctgaacggcgataaattcatcaaagttgctgaggttcagggaacagaaataaagccattcgtggagagtttatctaaatgcccaaagcatggacttcacaacccacttaaagcgtcagagaggtacctcatgtaatggagatatatccggcaaaagctggcgatatgctgggcccacctggcggcctaagattccttggctaaactatcccgaggggatcttccn

SEQ ID NO: 32483 - protein, 111 aa, Zea mays
  misc_feature: Ceres CLONE 1409709-F
  misc_feature: SWISSPROT Homolog: EC 1.5.1.12 1-pyrroline-5-carboxylate dehydrogenase
MSRLLSRQHLAAVRRSAPFACVSRWLHTPSFATVSPQEVSGSSPAEVQNFVQGSWTASANWNWIVDPLNGDKFIKVAEVQGTEIKPFVESLSKCPKHGLHNPLKASERYLM

SEQ ID NO: 32484 - DNA, 631 bp, Zea mays
  misc_feature: Ceres CLONE 1409717-F
  misc_feature: Encodes the peptide sequence at SEQ ID NO. 32485
  misc_feature (404)..(404): n is a, c, t, g, unknown, or other
  misc_feature (421)..(421): n is a, c, t, g, unknown, or other
aaagctggagctccccgcggtggcggccgctctagaactagtggatcccccgggctgcaggaattcgcacgagaccattacctagaacatcctaatcgaaaaacaaggcttcctcccaccacctccagtcctccaccggaccaccacctccaccactccctctctcacgacacgcgcaaaccgcttgaaccctagctggcggcgggaggcggaggtggctccgggatgacgcggcggtgctcgcactgcagccacaacgggcacaactcgcggacgtgccccaacccgcgggtcaagatcttcggggtgcacctcaccgatgggctcggcatccgcaagagcgcgagcatggggaacctcctcctcctctccgcgggatccaccagcgggggggcttcccccgncgacgggccgacctcgncgacgggggggggggtacgcctcgaagacttcgtccaggggtcgtcctccgccaacccggatcgaaaaaaaggggtccttgggactgaaaaaaaaacccggaggtttttggtggaataccaaagtccgggaaaggggattgggaaggaatttccggaaattttgggggcccaaaaaacctacccaggggaaaggcctggccccaaagatt

SEQ ID NO: 32485 - protein, 135 aa, Zea mays
  misc_feature: Ceres CLONE 1409717-F
  misc_feature (60)..(60): Xaa is any aa, unknown, or other
  misc_feature (66)..(66): Xaa is any aa, unknown, or other
MTRRCSHCSHNGHNSRTCPNPRVKIFGVHLTDGLGIRKSASMGNLLLLSAGSTSGGASPXDGPTSXTGGGVRLEDFVQGSSSANPDRKKGVLGTEKKTRRFLVEYQSPGKGIGKEFPEILGAQKTYPGERPGPKD

SEQ ID NO: 32486 - DNA, 826 bp, Zea mays
  misc_feature: Ceres CLONE 1409719-F
  misc_feature (15)..(15): n is a, c, t, g, unknown, or other
  misc_feature (29)..(29): n is a, c, t, g, unknown, or other
  misc_feature (79)..(79): n is a, c, t, g, unknown, or other
  misc_feature (80)..(80): n is a, c, t, g, unknown, or other
  misc_feature (82)..(82): n is a, c, t, g, unknown, or other
  misc_feature (87)..(87): n is a, c, t, g, unknown, or other
  misc_feature (88)..(88): n is a, c, t, g, unknown, or other
  misc_feature (380)..(380): n is a, c, t, g, unknown, or other
  misc_feature (381)..(381): n is a, c, t, g, unknown, or other
  misc_feature (390)..(390): n is a, c, t, g, unknown, or other
  misc_feature (404)..(404): n is a, c, t, g, unknown, or other
  misc_feature (419)..(419): n is a, c, t, g, unknown, or other
  misc_feature (423)..(423): n is a, c, t, g, unknown, or other
  misc_feature (425)..(425): n is a, c, t, g, unknown, or other
  misc_feature (426)..(426): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (478)..(478): n is a, c, t, g, unknown, or other
  misc_feature (487)..(487): n is a, c, t, g, unknown, or other
  misc_feature (516)..(516): n is a, c, t, g, unknown, or other
  misc_feature (518)..(518): n is a, c, t, g, unknown, or other
  misc_feature (525)..(525): n is a, c, t, g, unknown, or other
  misc_feature (550)..(550): n is a, c, t, g, unknown, or other
  misc_feature (555)..(555): n is a, c, t, g, unknown, or other
  misc_feature (569)..(569): n is a, c, t, g, unknown, or other
  misc_feature (577)..(577): n is a, c, t, g, unknown, or other
  misc_feature (592)..(592): n is a, c, t, g, unknown, or other
  misc_feature (606)..(606): n is a, c, t, g, unknown, or other
  misc_feature (607)..(607): n is a, c, t, g, unknown, or other
  misc_feature (631)..(631): n is a, c, t, g, unknown, or other
  misc_feature (632)..(632): n is a, c, t, g, unknown, or other
  misc_feature (634)..(634): n is a, c, t, g, unknown, or other
  misc_feature (642)..(642): n is a, c, t, g, unknown, or other
  misc_feature (663)..(663): n is a, c, t, g, unknown, or other
  misc_feature (694)..(694): n is a, c, t, g, unknown, or other
  misc_feature (721)..(721): n is a, c, t, g, unknown, or other
  misc_feature (779)..(779): n is a, c, t, g, unknown, or other
tgggggggggggggntggggtggggcggngcgagagtcgggctgtgtcgggcggtggtggcgggtttggtgagtggggnnanagtannccaaaactggggctccaccgcggggcgggccgcctctagtaactagtggatcccccgggctgcaggaattcgcatgagaccattacctagaacatcctaatcgaaaagggggtgcgtgccgtctctgcgactccacttgctcttttcgctgggcctggctacttgcggcaagtcccgtctccacccgctctcccatccgagatctcaaccgcctccccggggagcgactgacgcggcggacgggcccgccgcctactgggaactgcctgctccgatgaggtgagacacgccnntgttcattncgtcgggtccgccncccccgaatccggcntcgnannctgcggcgcgggggatcggttttatccggttcgccgccgcgcccnnnggcgnccccccccngatcgagggaatctgctgtgctgctctcnantttgtgncgtcatccatgagtattttttcctnaaaantaaatcccaacgcncgccctgncgaaattccccccgnccgaccaaagttgnnaccgccgccaaagaaagtttcganncncccgtgcncacgaacaggctaaaatcttnttttgaagcccgaattttaggtggtccccgnaagatctaatgggcaccgacaacaggntgggcggggttcgtttataacgaacgtcgcaggtttcaaagggccccgcggggacaanccggcgcagcaggcgttccgacccatgcgcgaaccgacaacacgagg

SEQ ID NO: 32487 - DNA, 829 bp, Zea mays
  misc_feature: Ceres CLONE 1409723-F
  misc_feature: Encodes the peptide sequence at SEQ ID NO. 32488
  misc_feature (73)..(73): n is a, c, t, g, unknown, or other
  misc_feature (74)..(74): n is a, c, t, g, unknown, or other
  misc_feature (82)..(82): n is a, c, t, g, unknown, or other
  misc_feature (84)..(84): n is a, c, t, g, unknown, or other
  misc_feature (85)..(85): n is a, c, t, g, unknown, or other
ataataggggtggaaggaccggggcgccaaagccccgcgcccgcgtaggaggtgaagaaggatccgggggggnntgtgggtntnnccaaagctggagctccaccgcggtggcggccgctctagaactagtggatcccccgggctgcaggaattcgcacgagaccattacctagaacatcctaatcgaaaacaaaattccagactccaaactcggttcttcaatcgacagattccgatttacatcccaaagctcttcggattgaaatccagccgcgacccaagagataagagtatttgggattagcagataggatagtagaatagaagaggaacactttcgctgatgattacggcgggaggagaagagccccgaaaggggggaggacgaggcatcccactggggccgggagcggggtgttcgtggatcaccatcggcccgcccacccccgcgcccaagggtgaaaaacaccccgcgtccccgctgggcggggagcaccccccctcagtggcgggctaccccggcgaccccccccccccaagctttccaccgccgtgccaccgcaccgcgcctccaagtggagggaagacccgggtctcgcccccccatcgggccgggcgggtctccccaggcgaagtggaacaacccataacccgctgggctaacccgcccgctgcgtcaaggccccccaccgggaaacacgcccccccccccccctctccgccaccgcgcggggggaaattgcgccgccgagacctctatcaccccccgccgggggccaccatctccgctgcgcccgcccgaaataagcgcacctacctacgtcggcgg

SEQ ID NO: 32488 - protein, 56 aa, Zea mays
  misc_feature: Ceres CLONE 1409723-F
  misc_feature (24)..(24): Xaa is any aa, unknown, or other
  misc_feature (27)..(27): Xaa is any aa, unknown, or other
  misc_feature (28)..(28): Xaa is any aa, unknown, or other
NRGGRTGAPKPRARVGGEEGSGGXCGXXQSWSSTAVAAALELVDPPGCRNSHETIT

SEQ ID NO: 32489 - DNA, 771 bp, Zea mays
  misc_feature: Ceres CLONE 1409729-F
  misc_feature: Encodes the peptide sequence at SEQ ID NO. 32490
  misc_feature (77)..(77): n is a, c, t, g, unknown, or other
  misc_feature (78)..(78): n is a, c, t, g, unknown, or other
  misc_feature (80)..(80): n is a, c, t, g, unknown, or other
  misc_feature (584)..(584): n is a, c, t, g, unknown, or other
  misc_feature (726)..(726): n is a, c, t, g, unknown, or other
tttggtggggtcccccccccacatcttatagagggggaaggtgggaccggcgaggggtgcgggggggggggacaatnntntcaagctggggctccccgcggtggcggccgctctagatcagtggatcccccgggctgcaggaattttcacgagaccattacctagaacatcctaaaaaaaaagaagacgaaagacgaagcgcagcactcgccgtcccctctcaaccctcccaaccgaaccagaaaagatagacgatgacgctgacgatcccggacgaggtgcgcgccaaggaggaggtgaacgtgggcgacgcgtcggggcaggagaagacggggctgctcctccaggagacgggcctcccgagggggctgctcccgctgcgggacatcatcgagtgcggctacgtggaggagacggccttcgtgtggctccggcagcgccgccaggtggagcactacttcaccaagggcggccgccccgtggtgctacggggccgaggcgcccgcggtggccgacaagggggcggctcaagaagaacacgggggtcaagggcaaggagaggctgctgtgggtccccctccccnaaatctggggcgaacgaccccccccactgggaaagctcccactggaaaggccaatccgggggccttgtccccggagcttcccccggtccaagggccttcgagaggccaaggaaaacccggacgcccggccccggaagaccgngcggaggggccggtttcccccagggacaccccgggaacgaaataa

SEQ ID NO: 32490 - protein, 172 aa, Zea mays
  misc_feature: Ceres CLONE 1409729-F
  misc_feature (158)..(158): Xaa is any aa, unknown, or other
MTLTIPDEVRAKEEVNVGDASGQEKTGLLLQETGLPRGLLPLRDIIECGYVEETAFVWLRQRRQVEHYFTKGGRPVVLRGRGARGGRQGGGSRRTRGSRARRGCCGSPSPKSGANDPPHWESSHWKGQSGGLVPGASPGPRAFERPRKTRTPGPGRPXGGAGFPQGHPGNEI

SEQ ID NO: 32491 - DNA, 594 bp, Zea mays
  misc_feature: Ceres CLONE 1409731-F
  misc_feature (205)..(205): n is a, c, t, g, unknown, or other
  misc_feature (206)..(206): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (307)..(307): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (316)..(316): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (346)..(346): n is a, c, t, g, unknown, or other
  misc_feature (347)..(347): n is a, c, t, g, unknown, or other
  misc_feature (382)..(382): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (395)..(395): n is a, c, t, g, unknown, or other
  misc_feature (408)..(408): n is a, c, t, g, unknown, or other
  misc_feature (411)..(411): n is a, c, t, g, unknown, or other
  misc_feature (412)..(412): n is a, c, t, g, unknown, or other
  misc_feature (415)..(415): n is a, c, t, g, unknown, or other
  misc_feature (417)..(417): n is a, c, t, g, unknown, or other
  misc_feature (420)..(420): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (451)..(451): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (470)..(470): n is a, c, t, g, unknown, or other
  misc_feature (476)..(476): n is a, c, t, g, unknown, or other
  misc_feature (477)..(477): n is a, c, t, g, unknown, or other
  misc_feature (479)..(479): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (492)..(492): n is a, c, t, g, unknown, or other
  misc_feature (493)..(493): n is a, c, t, g, unknown, or other
  misc_feature (508)..(508): n is a, c, t, g, unknown, or other
  misc_feature (525)..(525): n is a, c, t, g, unknown, or other
  misc_feature (531)..(531): n is a, c, t, g, unknown, or other
  misc_feature (532)..(532): n is a, c, t, g, unknown, or other
  misc_feature (541)..(541): n is a, c, t, g, unknown, or other
  misc_feature (547)..(547): n is a, c, t, g, unknown, or other
  misc_feature (553)..(553): n is a, c, t, g, unknown, or other
  misc_feature (555)..(555): n is a, c, t, g, unknown, or other
  misc_feature (556)..(556): n is a, c, t, g, unknown, or other
  misc_feature (559)..(559): n is a, c, t, g, unknown, or other
  misc_feature (574)..(574): n is a, c, t, g, unknown, or other
aaagctggagctccccgcggtggcggccgctctagaactagtggatcccccgggctgcaggaattcgcacgagaccattacctagaacatcctaatcgaaaaacgagtcggatacccgaacctcggcggcgtcggcgcacgggagcaaaaaccctagtgcgagcaagcgagagaggcagagacctcagttggcctcgagcaacgnncgcgcccggcccgaaaannnnngggggggggnnnnnnnnnnnnnnnnnnnnnnnnnnnnntttttttttggggggggggggggggggnnnnnnnnnnnttntnnnnnntnggggggggggggggggggnnnttttttttnntttgttggggggggggggggggggtggtttttttntttccctnnntgnggccccggtgggnccnnggngnttnggtttttttttttttttgnnnnnnngnnngngnnngggggggggggtggngtggtnngngnnnnnnnnnttnntgttttttttttttnttgtttttttttgtttntgtgtnngggggtggntggggngggggngnnggnggggggggggggggngttttgtgtttttttggttt

SEQ ID NO: 32492 - DNA, 604 bp, Zea mays
  misc_feature: Ceres CLONE 1409735-F
  misc_feature: Translation starting site: 224
  misc_feature: SWISSPROT Homolog: EC 3.4.16.6 Carboxypeptidase D
gctctagaactagtggatcccccgggctgcaggaattcgcacgagaccattacctagaacatcctaatcgaaaaataggctgtcagtcacttccagtcctagcccactcctccgatgctccaatcatcaacactctctacctgtgtccgtgtgctcttctcctctgcaccaccaaccaaccagtgctgtcctccgccgatccactgacctaccgcgagcgccaatggcgaccgccgcggtcctcgccgccacattagcgctgttcctcggcgccgccgccgcaacggccgcgacggctgcggcggaggcggaccggatcggcaggctgccgggccagccgccggtcaacttctccatgtactccggctacgtcaccgtggacgcggcggcggggcgggccctcttctacttgttcatcgaggcgggcggcgtgcccgcggagtccgcgccgctcgtgctttggctcaacggcgggccccgggtgctcctccgtcggctacggcgcgtaagaggagctcggcggccttcggatcaacgccgacggaaggacgctctacttgaacccctacccctggaaaaaagtggcgaaaatgttgttcttggg

SEQ ID NO: 32493 - DNA, 623 bp, Zea mays
  misc_feature: Ceres CLONE 1409739-F
  misc_feature: Translation starting site: 204
  misc_feature: Pfam Name: OPT Pfam Description: OPT oligopeptide transporter protein
  misc_feature (354)..(354): n is a, c, t, g, unknown, or other
  misc_feature (381)..(381): n is a, c, t, g, unknown, or other
tggagctccccgcggtggcggccgctctagaactagtggatcccccgggctgcaggaattcgcacgagaccattacctagaacatcctaatcgaaaaaccagtcagtccacacagcctacggcctgctctggctctgcctgtagagggctagacctacaagctacaactctgaaagtctgaacagtgcgccgcccaaccagagatggcgccgcataccaccgcagccgccggcggcggcggcggcgaggaggcgctggaggaggccagcactctccggcaccgccacagcgctgccaaggacggcggcgaggagggccaggccaacaacggggtcgccgccgccgccgacgacngacggggagggggaacgcgctgtcggntggagcgcgcgttcgcgggacagggcgtttccgtcgtggcgggagcagctgacggtgcgcgccttcgtgttcagcttcctcctgggcatcatggtcagcgtcatcgtgatgaagctcaactcaccacggggatcatcccctcgctccacgtctccgcggggctcctcgctttctcttcgtacgcctctggaccgccgcatcgagagggttgggctcctcagggagccttcacgcgccaggag

SEQ ID NO: 32494 - DNA, 647 bp, Zea mays
  misc_feature: Ceres CLONE 1409741-F
  misc_feature: Encodes the peptide sequence at SEQ ID NO. 32495
  misc_feature (394)..(394): n is a, c, t, g, unknown, or other
  misc_feature (552)..(552): n is a, c, t, g, unknown, or other
  misc_feature (615)..(615): n is a, c, t, g, unknown, or other
  misc_feature (616)..(616): n is a, c, t, g, unknown, or other
tggagctccccgcggtggcggccgctctagaactagtggatcccccgggctgcaggaattcgcacgagaccattacctagaacatcctaatcgaaaagcgggggtcgcctgagatcacataaacaatggtgaaggctgttgctgtgcttggtagcagcgatggtgtcaagggcaccatctttttcacccaagagggagatggccctaccgctgtcaccggaagtgtctctggcctcaagcctggcctccatgggttccatgtacatgcacttggtgacaccaccaatggatgcatgtcaactggaccacactacaatcctgcgagcaaggagcatggggcaccagaagatgagaaccgccatggctggtgatcttggaaacgacagctggagcnagatggtgttgctaatatcaatgtcaccgacagccagatcccactgactgggccaaactcaatcatttggcagaagctgttgttgttcacgctgatcctgatgatcttggggaaagggtgggcacgagctcagcaagagactggaaacgcccggtggnccgtgttgccttggtgggatcattggactccagggctgaaaacgatcgcgggaaacttggggnnggccttggaaaggtcccgtctcctgccgtcc

SEQ ID NO: 32495 - protein, 81 aa, Zea mays; identical to SEQ ID NO: 28140
  misc_feature: Ceres CLONE 1409741-F
  misc_feature (1)..(80): Pfam Name: Sod_Cu Pfam Description: Copper/zinc superoxide dismutase (SODC)
  misc_feature: SWISSPROT Homolog: EC 1.15.1.1 Superoxide dismutase

SEQ ID NO: 32496 - DNA, 702 bp, Zea mays
  misc_feature: Ceres CLONE 1409751-F
  misc_feature: Encodes the peptide sequence at SEQ ID NO. 32497
ggagctccccgcggtggcggccgctctagaactagtggatcccccgggctgcaggaattcgcacgagaccattacctagaacatcctaatcaaaaaacatagactttactctggaatcgtaacctcataaagtcaaatctcattactccggcgctcaggcccacccaagtgttgactctcccgatccaatcggaacctcctagttcctcgccgtcggtagcgacgtcggaagaactagccgtgacttgccgaggacgcttggtcgacgacaaacctcctctaggatgtaacgtgacgcaaataccgcggttgcgtcttgtgcctaaccatggggccctctgcagcgctatccccccccccaattatcttctagaacccaggggccccaacaaggacttgttgatactggcggcgccctcccccccgccgcacacgcccaccaacctccgaatccgagacgcaccactcccacagaagcctaattcaaaacaacagccgggagcttccaccaatgaaagcacggcggttcttgattatccagaaaatggagggtctcggaacaaaacggatatggcatccgcataccagagccaaaccttgagcacggcttgtaacacgggccaagtgtacctttccttggaccgttaccaactttgagaaggaatccttggagagttaaaattcaatccgcaagcgcgaccg

SEQ ID NO: 32497 - protein, 29 aa, Zea mays
  misc_feature: Ceres CLONE 1409751-F
MKARRFLIIQKMEGLGTKRIWHPHTRAKP

SEQ ID NO: 32498 - DNA, 754 bp, Zea mays
  misc_feature: Ceres CLONE 1409760-F
  misc_feature: Encodes the peptide sequence at SEQ ID NO. 32499
  misc_feature (624)..(624): n is a, c, t, g, unknown, or other
  misc_feature (691)..(691): n is a, c, t, g, unknown, or other
  misc_feature (693)..(693): n is a, c, t, g, unknown, or other
  misc_feature (720)..(720): n is a, c, t, g, unknown, or other
  misc_feature (721)..(721): n is a, c, t, g, unknown, or other
aagctggagctcaccgcggtggcggccgctctataactagtggatcccccgggctgcaggaattcgcacgagaccattacctagaacatcctaatcgaaaaaaaccctaaccccatcccgaactccccccctcccccaacacgagcgtgctttcttagccgataagcatatccctccccgccacgatctcgatggtggagatgtctgtgggggaagtcaggacgttgacgctcggattccgcttccaccccaccgacgaggagctcgtcacccactacctcaagggcaagatcaccggcaggatcaactccgagtccgaggtcatccccgagatcgacgtctgcaagtgcgagccgtgggacctcccagataagtccctgatccggtccgacgatcctgagtggttcttcttcgcccccaaggaccgcaagtaccccaacggtagcaggtcgaaaagggccaccgagggcggatactggaaggctactggcaaggacaggataatcaaatccaagggcgacaagcgcaagcaggataccatcgggatgaaaaacaccctcggcttccaccggggacgtggccccaaggacgagcgcacaggggggaataatgtgaatagtaccncaccaccgaacctgaatttgtattccgcgcaacagtgggggactggtgtatctcccaacactcccangnggagacaagatcattcaacgcgacccnncatatgcgaacaggagacaaacaacgctcacca

SEQ ID NO: 32499 - protein, 187 aa, Zea mays
  misc_feature: Ceres CLONE 1409760-F
  misc_feature (12)..(145): Pfam Name: NAM Pfam Description: No apical meristem (NAM) protein
  misc_feature (145)..(145): Xaa is any aa, unknown, or other
  misc_feature (167)..(167): Xaa is any aa, unknown, or other
  misc_feature (168)..(168): Xaa is any aa, unknown, or other
  misc_feature (177)..(177): Xaa is any aa, unknown, or other
MVEMSVGEVRTLTLGFRFHPTDEELVTHYLKGKITGRINSESEVIPEIDVCKCEPWDLPDKSLIRSDDPEWFFFAPKDRKYPNGSRSKRATEGGYWKATGKDRIIKSKGDKRKQDTIGMKNTLGFHRGRGPKDERTGGNNVNSTXPPNLNLYSAQQWGTGVSPNTPXXRQDHSTRPXICEQETNNAH

SEQ ID NO: 32500 - DNA, 600 bp, Zea mays
  misc_feature: Ceres CLONE 1409775-F
cagagctggagctcaccgcggtggcggccgctctagaactagtggatcccccgggctgcaggaattcgcacgagaccattacctagaacatcctaatcgaaaaaagcaagcggcgagagcgagcccagcaggcgtctctcctctcgtccatccgtttcctcctccccctgcttcccggctcgcctccctcccctccctgtgcgcctcttttcatgcgcgaggagggaccgtggggaccaccaccaccagcaccaccacctccatccgtgcgcctctcgctctcgctggcggagctcctcgtcctcctcctgctccccgggcgggcggccttcctttttccacctcctgcttggggaccagggccgggaaagggccctccgggagggggggcgccaaggggtttccggaaaagggccggaaccccccccttaaaaaaagaaaagggggaaattttaggaaggggaaccccgggaaaaaaaaccccgggaggtttttttggggaaaaaaacccttttttgggaaaaaaaaaaagggggggggggaaaaaaggggggggggggaccccccccccccttgaattataataaccaccccctttct

SEQ ID NO: 32501 - DNA, 735 bp, Zea mays
  misc_feature: Ceres CLONE 1409776-F
  misc_feature: Encodes the peptide sequence at SEQ ID NO. 32502
  misc_feature (421)..(421): n is a, c, t, g, unknown, or other
  misc_feature (430)..(430): n is a, c, t, g, unknown, or other
  misc_feature (481)..(481): n is a, c, t, g, unknown, or other
  misc_feature (519)..(519): n is a, c, t, g, unknown, or other
  misc_feature (523)..(523): n is a, c, t, g, unknown, or other
  misc_feature (610)..(610): n is a, c, t, g, unknown, or other
  misc_feature (611)..(611): n is a, c, t, g, unknown, or other
tggagctccccgcggtggcggccgctctagaactagtggatcccccgggctgcaggaattcgcacgagaccattacctagaacatcctaatcgaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggccngcttcgcgnacacgctgtcggacacctcccccggctcgcccgcgcagcgcttcgtgtcgnaggacggcgtcatcaactcgcgccccgcggttgctggncggnggaattgaatcaacgccgggttctaaccgggggcaggaacgactactggcggggcgtccgttgaaactttggcccccccgggccggnnaaaacccggtggggggggaagacacggggggggggttcaaccgagtggggccccctggaaaccccccttttagggggcctgttcaaggccggggcccgccaaaaaaggttttccttcgacttta

SEQ ID NO: 32502 - protein, 128 aa, Zea mays
  misc_feature: Ceres CLONE 1409776-F
  misc_feature: SWISSPROT Homolog: EC 4.1.2.10 Mandelonitrile lyase
  misc_feature (93)..(93): Xaa is any aa, unknown, or other
  misc_feature (96)..(96): Xaa is any aa, unknown, or other
  misc_feature (113)..(113): Xaa is any aa, unknown, or other
  misc_feature (127)..(127): Xaa is any aa, unknown, or other
MSGRSRHFTMSTLLATSFFFVLLCSSLQVRGVNYTFVKDAALAPSVSYYDYIIVGGGTAGCPLAATLSERFRVLLLERGASPYDDDRIGDMAXFAXTLSDTSPGSPAQRFVSXDGVINSRPAVAGRXN

SEQ ID NO: 32503 - DNA, 685 bp, Zea mays
  misc_feature: Ceres CLONE 1409778-F
  misc_feature: Encodes the peptide sequence at SEQ ID NO. 32504
  misc_feature (570)..(570): n is a, c, t, g, unknown, or other
  misc_feature (636)..(636): n is a, c, t, g, unknown, or other
  misc_feature (658)..(658): n is a, c, t, g, unknown, or other
cagagctggagctccccgcggtggcggccgctctagaactagtgaatcccccggcgctgcctgaagtcgcactgcatcatcactcgtataacatccaaatggagaagatacatgttagacgtgcctcgcgaaccacgaagggacagctatgggatctctatactctccgggggagcctgccgactgtcgtctctcaactatcagaatacaaaaacataagagcatgtgctgcaagaaaccatacaacggttgtaactgatgatgccaaatccgtatctattcgtcataacaactatgcacagttacggacggcttccttaatgaatgagattgagacatcaccagtgtcctgtatcgttgcggaagcaaccaacgttgcatgtgccgctgattttactgcctgcctgtcatctgtgcaacgctcttctatacttacagcaggtcttcccgatatggacaactcggtcatgtaactgataatgagtacaatgctaaacaatcgtctgtgaaactgacctatgaatcccagccccgtccaagagcactagctgcattttctgggaaaactgntgtcaaagttgcattgcgcactaagcatacagttgcagttgaatacaatggctttgttacacctgnagctttcggtgatatggaaggntgggcatagagaaccgaaggatgatgt

SEQ ID NO: 32504 - protein, 156 aa, Zea mays
  misc_feature: Ceres CLONE 1409778-F
ELELPAVAAALELVNPPALPEVALHHHSYNIQMEKIHVRRASRTTKGQLWDLYTLRGSLPTVVSQLSEYKNIRACAARNHTTVVTDDAKSVSIRHNNYAQLRTASLMNEIETSPVSCIVAEATNVACAADFTACLSSVQRSSILTAGLPDMDNSVM

SEQ ID NO: 32505 - DNA, 722 bp, Zea mays
  misc_feature: Ceres CLONE 1409780-F
  misc_feature: Encodes the peptide sequence at SEQ ID NO. 32506
  misc_feature (454)..(454): n is a, c, t, g, unknown, or other
  misc_feature (458)..(458): n is a, c, t, g, unknown, or other
  misc_feature (477)..(477): n is a, c, t, g, unknown, or other
  misc_feature (478)..(478): n is a, c, t, g, unknown, or other
  misc_feature (518)..(518): n is a, c, t, g, unknown, or other
  misc_feature (526)..(526): n is a, c, t, g, unknown, or other
  misc_feature (544)..(544): n is a, c, t, g, unknown, or other
  misc_feature (583)..(583): n is a, c, t, g, unknown, or other
aagctggagctccccgcggtggcggccgctctagaactagtggatcccccgggctgcaggaattcgcacgagaccattacctagaacatcctaatcaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcatggtcccgcgggcgtggctcgcccgcgcggacttcctgctgacgtgcgacccgggcggcgtccagcactgtctggcgtncaancacgggggctacgacaggnngcgagactttgcggagatgttcgacctcctgggcgacggnctgctggnttgcgatgcccccggtcntggccgcgccaaggggaacgtcgccgccaacggcctcgnaaacccgggggttcccggcccttcgtcctgggaaccatggcgcgccaaaaggggggggttggtccggccctttcctggaattccccccccggaaaatagaaaagagaaacgggggggcccttttatttttcagggaggt

SEQ ID NO: 32506 - protein, 189 aa, Zea mays
  misc_feature: Ceres CLONE 1409780-F
  misc_feature (100)..(100): Xaa is any aa, unknown, or other
  misc_feature (101)..(101): Xaa is any aa, unknown, or other
  misc_feature (108)..(108): Xaa is any aa, unknown, or other
  misc_feature (124)..(124): Xaa is any aa, unknown, or other
  misc_feature (130)..(130): Xaa is any aa, unknown, or other
  misc_feature (143)..(143): Xaa is any aa, unknown, or other
MGALRSLAISYPEFLVAGLCFVSLSALRHAMRERRQRAPLSWPVVGMLPFVLANLGRLYDAITDALHGSGCTLMVPRAWLARADFLLTCDPGGVQHCLAXXHGGYDRXRDFAEMFDLLGDGLLXCDAPGXGRAKGNVAANGLXNPGVPGPSSWEPWRAKRGGLVRPFPGIPPPENRKEKRGGPFIFQGG

SEQ ID NO: 32507 - DNA, 984 bp, Zea mays
  misc_feature: Ceres CLONE 1409784-R
  misc_feature: Encodes the peptide sequence at SEQ ID NO. 32508
taaatacgaattgggtaccgggccccccctcgatgtcgacggtatggataagcccctgaaaaaagttgatggatgagttgagaaagaaaaaactagaggaagctactcaatccggaagcactgacaccggcattaatcctccatctcccatcaaacgacacgtgaagtggaagctagcccgcaccaagaaaattggtgacatgacatctgaggcaacaaaggaaatcgctgacaagattgtaaatcactttcaattcataattgcaattattttttattattgagtgattgagtatagaataaatgtgttcttcacaagaagcgcttgaggaggaggcctcacaaggttactttggtacccatggacgtcatgataaaatgaacgctgccattgggcctaccagaacacacccggttcgaggttcctgcccgaacgatgccgggtattaaccttcaagcgagaacctttggattcaggtttacaaagacctgccgccccatgggttccccgaaataaaatgccaacgctttgtaccaccatgcaaaattgaaggggaccgtggttgtgtaaaggttttcaaatccatcatagaaaaaaaagttccccttcctgacgcgaacgtgcaatagtttttatctccccatgttaagtctaatatataggcctaatttctcccgagaggggaaaactctgtcatattgtggccttttcctgtgtaaaacctctggatggtgttattggtacacctttacacaactgggccctatgtagagaaaaggttccgcaatatggacttaagtctgtggtcctgttaaacacaccccctagagggaaaacatgatcctaagagcaccgggggtgggacccgagtaacccaaaaggaggtgggtgggttttattttgtaataaaatttagtctgattttattatcctgggttatccccctgaaggaatagagttttaggagggtggttccccacacc

SEQ ID NO: 32508 - protein, 71 aa, Zea mays
  misc_feature: Ceres CLONE 1409784-R
MDELRKKKLEEATQSGSTDTGINPPSPIKRHVKWKLARTKKIGDMTSEATKEIADKIVNHFQFIIAIIFYY

SEQ ID NO: 32509 - DNA, 855 bp, Zea mays
  misc_feature: Ceres CLONE 1409785-R
ttgggtactgggccccccctcgaggtcgacggtatcgataagcttttttttttttttttttcgtttttttttttttttttttttttttttttttttttttcccgaaaaaacgcaggaggactgcgttttagatatatattaagaagagagaaaggtctaagagacccaaaaaacataacaacgcactccctatggaggcgagtaacactcgtacatgaaaggatccataaaaaacacccacacacactccctacaacaacctatgcaagggggcagccaaggagagccctttggctccagcaatttcccagcctcttctttcctcatctgcatgctccataatcagaggaaggctgggagaccctccatcaaaaatgactctattacgatgcttccaaatcatccacgaccctaaaatgatgagggagtcaagaccttccctgaccaaaccatttactgtctctgaaaccatctcccaccaatccataaaagagactgcatctggctgtgggctaaactatgcagcccgaactttcttagcaggttgtaccagaaaatccttgagaagacacaattcacaagcaagtggttcagggtttccccttgctggtcacataaaggacatctgatagggtgattcaatcccctttttgccaagggatcagttgtccaacatctattctggggcacccaaccaatgaaaaaacagcttttttgggggagcccaaaatttccaaacccctttgcaaagtatagtatttgaaaaaacaggggtgtttgaacttttagagaaaaaattgggggccaaaacaaaaccacaaaatttttaagggttgttttgggcaacccttggaa

SEQ ID NO: 32510 - DNA, 762 bp, Zea mays
  misc_feature: Ceres CLONE 1409785-F
  misc_feature: Encodes the peptide sequence at SEQ ID NO. 32511
aaagctggagctcaccgcggtggcggccgctctataactagtggatcccccgggctgcaggaattcgcacgagaccattacctagaacatcctaatcgaaaaacacaatacttacacttaaataaaggaggttcttcaaacaccattgcctctgtgtctccctgactgccttactgactactgactgccggtgactctacttcgtgcgcacctacatcgccatgacggcctaacacaggcgccgaaacgttcttccgccttctaaaagatcaaaaccactaccaagccggtcaagatcaaaaatacctaacacgtcactcagacgaagctgccagatcgacagtgatacactgacaccctagccggataaggtgctctgtccgtatatgcatgcaccatgggtacaacgcagccctcctgttgctcatctcctgtgaccagctaccgcgcatgcgtatatatgatatacacgcgtgatagctattccgatgcctatatacgctcaagaagatgaaagtgaatgtatgacaacagtccttcacagtcaagctcgaccatgactaggagtacaagaaaccaaaatgtggtgcagacatctcgttttgcgcccactagagagagccccaggctacacgtacacatatctgtacccgatgaaacttccgattaatcagatgcgcagcagagaactgcttgcataattgcagaaccgaaaaaaacatctacaatgcaagcccagaatttacattgacaactcaccag

SEQ ID NO: 32511 - protein, 49 aa, Zea mays
  misc_feature: Ceres CLONE 1409785-F
MYDNSPSQSSSTMTRSTRNQNVVQTSRFAPTRESPRLHVHISVPDETSD

SEQ ID NO: 32512 - DNA, 681 bp, Zea mays
  misc_feature: Ceres CLONE 1409786-F
  misc_feature: Encodes the peptide sequence at SEQ ID NO. 32513
  misc_feature (292)..(292): n is a, c, t, g, unknown, or other
  misc_feature (293)..(293): n is a, c, t, g, unknown, or other
  misc_feature (296)..(296): n is a, c, t, g, unknown, or other
  misc_feature (299)..(299): n is a, c, t, g, unknown, or other
  misc_feature (396)..(396): n is a, c, t, g, unknown, or other
  misc_feature (409)..(409): n is a, c, t, g, unknown, or other
  misc_feature (410)..(410): n is a, c, t, g, unknown, or other
  misc_feature (464)..(464): n is a, c, t, g, unknown, or other
  misc_feature (491)..(491): n is a, c, t, g, unknown, or other
  misc_feature (512)..(512): n is a, c, t, g, unknown, or other
  misc_feature (527)..(527): n is a, c, t, g, unknown, or other
  misc_feature (596)..(596): n is a, c, t, g, unknown, or other
  misc_feature (605)..(605): n is a, c, t, g, unknown, or other
  misc_feature (606)..(606): n is a, c, t, g, unknown, or other
  misc_feature (610)..(610): n is a, c, t, g, unknown, or other
  misc_feature (616)..(616): n is a, c, t, g, unknown, or other
  misc_feature (617)..(617): n is a, c, t, g, unknown, or other
  misc_feature (637)..(637): n is a, c, t, g, unknown, or other
aaagctggagctccccgcggtggcggccgctctagaactagtggatcccccgggctgcaggaattcgcacgagaccattacctagaacatcctaatcgaaaaaaaaaattcgattccacgaagcagcaatcgcaagttcgaagctctaaaataatctcttcccgacgtctctggaaggtcagcatctgaacccaggtagcctccagcgctggagacgtgccgtactcaaaccctagccaccaatggcagccggcggcggggctccgtgggcggagcgcgcgcgggtggtggnnacncanatccgcaacaggttccgcgtggcgcccgtggaccaccggtcgctgtggctgcggcgggacggtcgtgttgccactggagcggccccgggggtggccncaacgcgccccgnnccattctgtccccgggccccgcgcgcggtttggaaggccggcgcccggcgcggncccggtctgcggccggagacatggggntggctctgggttggccccccnccccgacacccgccnttcgacccgcgccgggccccgtagataccaagtttgcccctcgggtccccccccacaaaccccgcaagnggttgggcnncttnaacaannaacgattctgaaagcccaanagggggcgcccccccctccactccaacccctttacggctaaggg

SEQ ID NO: 32513 - protein, 102 aa, Zea mays
  misc_feature: Ceres CLONE 1409786-F
  misc_feature (17)..(17): Xaa is any aa, unknown, or other
  misc_feature (19)..(19): Xaa is any aa, unknown, or other
  misc_feature (52)..(52): Xaa is any aa, unknown, or other
  misc_feature (56)..(56): Xaa is any aa, unknown, or other
MAAGGGAPWAERARVVXTXIRNRFRVAPVDHRSLWLRRDGRVATGAAPGVAXTRPXPFCPRAPRAVWKAGARRGPGLRPETWGWLWVGPPPRHPPFDPRRAP

SEQ ID NO: 32514 - DNA, 739 bp, Zea mays
  misc_feature: Ceres CLONE 1409787-F
  misc_feature: Encodes the peptide sequence at SEQ ID NO. 32515
aagctggagctcaccgcggtggcggccgctctagaactagtggatcccccgggctgcaggaattcgcacgagaccattacctagaacatcctaatcgaacagtgttcttgttcgtctccgcctcaggcaactccacacggacacgggcacacctcgctcgctctcgctcccgtatcgcggcttccttttcgaagccttgctaggattagctggggcctccgtctatcctgtcaatggtgccttaggcggctgtacttcagacttcacaggtgacgtgaggcgtggagacgcgcgtagctgattgcttctaggaggcggcgatggacccggacttctcgccggagagtgggggtccgagctttgagttcgtctgcaactcggtcaacttctctgaccgggagatgaggatcgagatcgtcgctggggatgacgccctcggggtcaagctcgccaccgaagaggggtgatcatctcttgtcgactgcgcgtagcaccgcaagcgacgacgggaggagctccgacgcgacgaagagtctagaaatacttgccagatccagcggagtgcagagttgaacctgaataatgtgatgcctactaggtaggcaatgagcctgtaggtatgatagaagaatcatcgtctgaatactgagcatatgctgaggatggaacagcatcgactcatactgtcagatgcagagtactcaggtattgagagataagactatgaacgtcagctcgt

SEQ ID NO: 32515 - protein, 48 aa, Zea mays
  misc_feature: Ceres CLONE 1409787-F
MDPDFSPESGGPSFEFVCNSVNFSDREMRIEIVAGDDALGVKLATEEG

SEQ ID NO: 32516 - DNA, 732 bp, Zea mays
  misc_feature: Ceres CLONE 1409791-F
  misc_feature: Encodes the peptide sequence at SEQ ID NO. 32517
  misc_feature (677)..(677): n is a, c, t, g, unknown, or other
ggagctccccgcggtggcggccgctctataactagtggatcccccgggctgcaggaattcgcacgagaccattacctagaacatcctaatcaaaaaaactccacgtcacacacctcacagagctgcagcagtatcagttgccacctcctgcctctcctccttccttcctgcctgcataggttgctacacgtatatattctgaagaagagatcgagatgaccagcgtgtggaagaccaaggctctgcctggcctcaacaagatctttgacaaggatggcaagaaggctgcagctgcaggcttcttgaagtccttcaacaaggaggagtttgacaaggagattgaggacaagaagacagagctggagcccaaggtcgtggaggcctacgaagcatctcctcctgaggtcaaggctctcttcaaggataagaagccagtcaaggtcagcaagaacaactcggctgcagtcaccaagttcctcgatgagctggctaagattgacttccctggagccaaggtggtgagcgaggcgccgtccaagtccggcacctcgccactgcttccggcgatcaccttcatcttggacaaggtcgcaccgtttatccccattgagtaccccaatgaagagccggctgcgaatgacacctcccgggaagtcagcgtgtacgagaaaaaggtnagagccgaagcagctgcatcgacggatgcgccacagcgacgtagagacacgtcgg

SEQ ID NO: 32517 - protein, 172 aa, Zea mays
  misc_feature: Ceres CLONE 1409791-F
  misc_feature (2)..(168): Pfam Name: DREPP Pfam Description: DREPP plasma membrane polypeptide
MTSVWKTKALPGLNKIFDKDGKKAAAAGFLKSFNKEEFDKEIEDKKTELEPKVVEAYEASPPEVKALFKDKKPVKVSKNNSAAVTKFLDELAKIDFPGAKVVSEAPSKSGTSPLLPAITFILDKVAPFIPIEYPNEEPAANDTSREVSVYEKKVRAEAAASTDAPQRRRDTS

SEQ ID NO: 32518 - DNA, 723 bp, Zea mays
  misc_feature: Ceres CLONE 1409799-F
  misc_feature: Encodes the peptide sequence at SEQ ID NO. 32519
  misc_feature (390)..(390): n is a, c, t, g, unknown, or other
  misc_feature (439)..(439): n is a, c, t, g, unknown, or other
  misc_feature (504)..(504): n is a, c, t, g, unknown, or other
ggagctccccgcggtggcggccgctctagaactagtggatcccccgggctgcaggaattcgcacgagaccattacctagaacatcctaatcgaaaaaatttgcttgcagttttgataatttgcttgcagttttgcactaggcattgattgcatctctagtgcccgtcctccgtcctccggagcggctatgggcgaagagagggagttcgtgggcgctaggttggacgccggcctccgcgctgcccgcttctcgtcgccgccgtctgccgacgagtttgcggcagatgtcgagcccaagaacgtccctgcggtctttcgcggcgtggttaaggagtgggcggcctcctcccgttgggatcctctccatggcggcctcgattacctgctggnaaaagtgggacctgacgtggctgtggaagctatgatgtcaaacactggncatggtgtctacggggatctcagaagcatgagagggtggctgtttcattctcacggtcattcagncggggcagcctacctggatcatatgaatgcggtaggggatctccaaaaacaggaaatgctggggagccactattcagggaaaactgtccaacagttcaaaaattggggcaatttttttgcacaagaacaaaaaggggcctcataaaggtttgggagggccttcccaggcttttttttggggggaaaatttttcccaaaaattttggggaaaaagggcct

SEQ ID NO: 32519 - protein, 153 aa, Zea mays
  misc_feature: Ceres CLONE 1409799-F
  misc_feature (68)..(68): Xaa is any aa, unknown, or other
  misc_feature (106)..(106): Xaa is any aa, unknown, or other
MGEEREFVGARLDAGLRAARFSSPPSADEFAADVEPKNVPAVFRGVVKEWAASSRWDPLHGGLDYLLXKVGPDVAVEAMMSNTGHGVYGDLRSMRGWLFHSHGHSXGAAYLDHMNAVGDLQKQEMLGSHYSGKTVQQFKNWGNFFAQEQKGAS

SEQ ID NO: 32520 - DNA, 640 bp, Zea mays
  misc_feature: Ceres CLONE 1409800-F
  misc_feature: Encodes the peptide sequence at SEQ ID NO. 32521
  misc_feature (334)..(334): n is a, c, t, g, unknown, or other
  misc_feature (357)..(357): n is a, c, t, g, unknown, or other
  misc_feature (395)..(395): n is a, c, t, g, unknown, or other
aaagctggagctccccgcggtggcggccgctctagaactagtggatcccccgggctgcaggaattcgcacgagaccattacctagaacatcctaatcgaaaacaatatatccccactcttcgcctcctttctggagcagctagggttccgtcctcgatccgatccgccgagtgcgcaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacnacggcatccctcttcctaacgtnaactccagatcctatccaagggtaatcgagtactgcancaaagcaccgtacattggcggccggccggccggccgccggccggccttgaaaagggccgggttccccaacaaacctgggggtggcccggcccttccggccaaaaggcacccggccgccctcccggggggaggagactcccaagaaacttgggagaagggggggaacttttcccgtcaaaaggggtggaaaaccaagggccccccgctcttttttccgaaccccccacttctgtggggggggcgag

SEQ ID NO: 32521 - protein, 145 aa, Zea mays
  misc_feature: Ceres CLONE 1409800-F
  misc_feature (8)..(68): Pfam Name: Skp1_POZ Pfam Description: Skp1 family, tetramerisation domain
  misc_feature (44)..(44): Xaa is any aa, unknown, or other
  misc_feature (64)..(64): Xaa is any aa, unknown, or other
MAAEGEKKMITLKSSDGEEFEVEEAVAMESQTIRHMIEDDCADXGIPLPNVNSRSYPRVIEYCXKAPYIGGRPAGRRPALKRAGFPNKPGGGPALPAKRHPAALPGGGDSQETWEKGGNFSRQKGWKTKGPPLFFPNPPLLWGGR

SEQ ID NO: 32522 - DNA, 713 bp, Zea mays
  misc_feature: Ceres CLONE 1409804-F
  misc_feature: Encodes the peptide sequence at SEQ ID NO. 32523
acagctggagctccccgcggtggcggccgctctacaactagtggatcccccgggctgcaggaattcgcacgagaccattacctagaacatcctaatcgaaaaaaaaaaaaataaaaatcgcagccaaaacacgcttctcccttcccatcttttcctttcccctcctccctcctcggctcgtctctgttcccctttccctcctgcgcacccgtcttctcctccccgcgtcaaaccccagcacaaaaagctaccgcccgccgcctcctcgttcctctcccgaatcagccgtcgcggtgcctaatccggccgatcccccctccgatccgcgggtgcccgccgcagaggcggcgcctccgggcctcccccgatgtatagcaacttcaaggagcaggcgatcgagtacgtcaagcaggcggtccaggaggacaatgccggcaactacgtcaaggcgttccctctctacatgaacgcgctcgaggacttcaaaacccacctcaagtacgagaagaaccccaagatcaaggaggccatcaccgccaagttcatcgagtacctccgcccgcgccgagaagaatcgggtgtccttcaatgaagtcgccccaaagcccggggccaatgagggaaacccaaccggcggccagcccccggggaaaaagtaaaggacgtcacctttctcccctaccttgtaccccccgaccccccccccccgacct

SEQ ID NO: 32523 - protein, 74 aa, Zea mays
  misc_feature: Ceres CLONE 1409804-F
  misc_feature (5)..(73): Pfam Name: MIT Pfam Description: MIT (microtubule interacting and transport) domain
  misc_feature: SWISSPROT Homolog: EC 2.7.11.1 Non-specific serine/threonine protein kinase
MYSNFKEQAIEYVKQAVQEDNAGNYVKAFPLYMNALEDFKTHLKYEKNPKIKEAITAKFIEYLRPRREESGVLQ

SEQ ID NO: 32524 - DNA, 573 bp, Zea mays
  misc_feature: Ceres CLONE 1409806-F
  misc_feature (259)..(259): n is a, c, t, g, unknown, or other
  misc_feature (272)..(272): n is a, c, t, g, unknown, or other
  misc_feature (273)..(273): n is a, c, t, g, unknown, or other
aagctggagctccccgcggtggcggccgctctagaactagtggatcccccgggctgcaggaattcgcacgagaccattacctagaacatcctaatctaaaaatcgagctgagctgagcatcatggggtagtgtgtgtgtgaggcgatagagaagctagtgctcataaccaaccaccactcagtcctcctcctctaccctttcccttccgccgcgttcctacttggtcctagagggagagagatctcgaaactccagggncgcatgctccggnntgctagctaccatgccgtgtggcgtagccttcggcaagcctttgatcgaatcaatcgatccgcttgtgccggaaaggaagcccggatccagaggggagacccagcttagctttgaaaacctcccccgggggggccccccccccccccctttggggagccgcccccccccccgaaaaaagagggggggctttaaaaaaaaaaaaacccggggaagggtggttttccaaaaaggggagagtgggttccttgtgggccccccttggttgggaaaacctcggggaggggggaaaaaaaaaaata

SEQ ID NO: 32525 - DNA, 702 bp, Zea mays
  misc_feature: Ceres CLONE 1409809-F
  misc_feature: Encodes the peptide sequence at SEQ ID NO. 32526
aagctggagctccccgcggtggcggccgctctagaactagtggatcccccgggctgcaggaattcgcacgagaccattacctagaacatcctaatcgaaaactagctgattggcgtgtacaggcccgagctgcgatacatagcttgctttgtgctcatcggcggacgtaccccctgcgatggaagccgcctcggctactcctgccctggaggtggcgccatacaaaaacaagctgctgtgacctcaatgaccccttccccgccgccgcgaacggcggaacccaggagctcccggcgcgcaactgcgtgatgaacaacaagatggtgggaggggacccccgctacgtgctcgaggacgtgacgcacctcacgattacatgcacgagctcgcgatataccctaatcctctccgagacaactcggtatattcggccgttaagcagtattacggcaatccagaccactccgtcgacgcagaagattgttgttcataacaccattgtcacgggcaaccacttccttcgtgtcggagcacgacatcgagtgaactaccagcccgatgaggtgaacgccgcccttgtcacgtgtggaggcctctgacacggattgaacacgctcatccacgagcttgtttgcgagttgcatgatatagatgacgacacccgcgtcgtcgggatatgaggtggatgacatggttgctatc

SEQ ID NO: 32526 - protein, 198 aa, Zea mays
  misc_feature: Ceres CLONE 1409809-F
AGAPRGGGRSRTSGSPGLQEFARDHYLEHPNRKLADWRVQARAAIHSLLCAHRRTYPLRWKPPRLLLPWRWRHTKTSCCDLNDPFPAAANGGTQELPARNCVMNNKMVGGDPRYVLEDVTHLTITCTSSRYTLILSETTRYIRPLSSITAIQTTPSTQKIVVHNTIVTGNHFLRVGARHRVNYQPDEVNAALVTCGGL

SEQ ID NO: 32527 - DNA, 848 bp, Zea mays
  misc_feature: Ceres CLONE 1409809-R
  misc_feature: Translation starting site: 381
  misc_feature: SWISSPROT Homolog: EC 2.7.1.11 6-phosphofructokinase
aattgggtaccgggccccccctcgaggtcgacggtatcgatattttttttttttttttttcagagaaagtagaacatgatcacagcatcacatgagaaaaagtctggacatatagttaaaattacaaggaggtcaaacagaaacaccggcggctgtctgaaaaccaggtgttcacttgagccaatcaggtctatgaccagccgaagacatagtcgaggatgtagacgatgatcagcgagagcgggtagagcatgtaggcgacgaggcaggtccagagcgggaacgtggtccggaagctggtgaagagggccatgacgacgcagaccagcaggatgatgagcacctccgacgagaagtcccacgtcaggttcctgaagtagatgagcgccaggaacacgccgaggcacagcgtgttgttcatcgtcacgccgccgtacacctcggagaaggtgagggagcaggtcctctgcttcttcctgctggcgaagatgatggcggagacggcctcgctggagttggcggcccataagcttcacgacaccgatgccgttctccgcactttcagcctcgacatgagcagcattgatggccctctgggcctcctccacagcagtgtcgaatccaaacgacttgtcaatcaccgcgatgtcgttatcaatagtctttgggacaccgacaacagaacacttgagggcgcgtcctcgggacttcctcataaattacagaagcgccttttctgaggtgccgtcgcctccgataaaatagaacctggttaaatggcacggtccctgaagaaaattcaagaatttttgcaggggtcttgccccccctccttgagggtcccaagg

SEQ ID NO: 32528 - DNA, 693 bp, Zea mays
  misc_feature: Ceres CLONE 1409811-F
  misc_feature: Encodes the peptide sequence at SEQ ID NO. 32529
aagctggagctccccgcggtggcggccgctctagaactagtggatcccccgggctgcaggaattcgcacgagaccattacctagaacatcctaatcgaaaaatctcggggatccggcactcgcctcccttttccctttccgcgccccatcaccattgccacaaatagcaaccaaggcagtaagcctagccaagccaaccgacggcggcgagagtatatatacacacacacctgacgcctctgctgctgctgggatcaacgcggcagcttagtgacgacgacgactcttctgtctctgcgttgattaatggacagtaacagatccatggcgacgagcggcgtggctccgttcgtggccaagacctaccgcatggtggatgacccggcgaccgacggcgtggtcgcgtggggcagggacaacaacagcttcgtcgtggccgaccccttcgccttctcgcagacgctcctgcccgcgcacttcaagcactccaacttctccagcttcgtgcgccagctcaacacctacggccttcgggaaggtcgatccggaccggtgggagttcgcgcacgtgtcccttccttcgcggccagacgcatctccttgggccaaatcgtcccgccggaacagccggcgggcaaggcaaaggacgacgggcaacggggcccggcgccgggctccgccgacaaccgaggg

SEQ ID NO: 32529 - protein, 129 aa, Zea mays
  misc_feature: Ceres CLONE 1409811-F
  misc_feature (13)..(117): Pfam Name: HSF_DNA-bind Pfam Description: HSF-type DNA-binding
MDSNRSMATSGVAPFVAKTYRMVDDPATDGVVAWGRDNNSFVVADPFAFSQTLLPAHFKHSNFSSFVRQLNTYGLREGRSGPVGVRARVPSFAARRISLGQIVPPEQPAGKAKDDGQRGPAPGSADNRG

SEQ ID NO: 32530 - DNA, 833 bp, Zea mays
  misc_feature: Ceres CLONE 1409812-R
  misc_feature (1)..(1): n is a, c, t, g, unknown, or other
ncccgattgggtaccgggccccccctcgaggtcgacggtatcgataagcttttttttttttttttttctttttttttttttttttttttttttacgagcagcatggcattgccggccggtagcccaacagggcccactcctgtttaggtgtagcgctaaaagttttttacaatcccacagccaaacacaggtggcgatctttttattcggccttggacaccgaatgcactggacattcaatccgcctaccctctcaaggggaattctctccaaatttagacatccctgggtattgggctctcaccaaccacaccaatctcggaacgaagcagcatcctcaggccttcatggatgggttgggccgccgcctccctggatatgatcactgaccggtgggggattgaccacatgaatatccaagctgccgacgaccgcctctggggagacctcccggacatcagcgatgaacgcttctggctgctggaagatactccactctgcatcgccaacaggacggatgtccaccccatccacctccaggtggacctcaatgctattggtcgaaaccgggaccaatctagagtcacttaccccggctatggcctccttagagaccgatgcgtcaacatgctttgtcaacacatgtgaattatccgcccctgaccatgatccatacctctcctcccatacttgctttatgccgctctagactctcatgacttgtccattggagaacaccaacaaagggctagaacctccctcttttgctttcttcaaagtatgcgaggttttcagcaacttccccttatccaagccggcgaatcaagggggtt

SEQ ID NO: 32531 - DNA, 705 bp, Zea mays
  misc_feature: Ceres CLONE 1409812-F
  misc_feature: Translation starting site: 243
tggagctccccgcggtggcggccgctctagaactagtggatcccccgggctgcaggaattcgcacgagaccattacctagaacatcctaatcgaaaaatctatcagtaagcccttgccaccgcgggatcgcgcacctcatgcaacttaccttcgcgctgcgcctgtggccgtcgatgaatcagctccggtttccgccctgccaaaaacctactacctcttaccttcgagcccggcgacctccatggacacctacatgtgctctgtcgacaattcgacacacggggattaccctagagaaggggacaggcgatctgcaatttcggcctggcagacaccggctgcaagggcccctggtcgcgccatctgatacgttacgcagatgtagtgctctgtgagtcatattgcacccgacatcaggatcgacggaatacacactgcggacatatgaaactgccatcatcggaactagtctgactgacgcctcgagcaccattactttatctcctgtgacctttcaagggatgccaaaatctaaggactggtgctccataatacacagtcctcacaagaaggattactttcttttgtgctgaaagtcctgcagctgcgacagcttggtgatctacatgacatgcgactcagtcagacttagcgagctcatagagaggcagtagaattcttttgactgggaatggctcgtcgcc

SEQ ID NO: 32532 - DNA, 521 bp, Zea mays
  misc_feature: Ceres CLONE 1409817-F
  misc_feature: Encodes the peptide sequence at SEQ ID NO. 32533
  misc_feature (272)..(272): n is a, c, t, g, unknown, or other
  misc_feature (286)..(286): n is a, c, t, g, unknown, or other
ggtggagctccccgcggtggcggccgctctagaatagtggatcccccgggctgcaggaattcgcacgagaccattacctagaaatcctaatcgaaaagcaacgagatccctcgcgcgcgcggaccccggagaggccgagggagggtgacagggcgtggcagctcgaggggaatgggatcggagggacgggcctggaacggcgcgggcatggccgccggcagcggctatggcagcggtggagagggcaaagcgaccaccacggctgtgtcggnccgcgcccccgcgnaggtcccacgtcggcggcctccgtcgacatctcgcttgcgctcctggagatgccgcctcccatcatagttctccgcaaagaattgtccaaaagggggcccgccaattggaaagttctcccttttccatcaaaacccgggccccgggggaattcaccaaacttattgggtgaaggggtttttggccaaaaaaaaaaaaacgggaaatggggctttttttttaaattggtccgggtg

SEQ ID NO: 32533 - protein, 60 aa, Zea mays
  misc_feature: Ceres CLONE 1409817-F
  misc_feature (34)..(34): Xaa is any aa, unknown, or other
  misc_feature (39)..(39): Xaa is any aa, unknown, or other
MGSEGRAWNGAGMAAGSGYGSGGEGKATTTAVSXRAPAXVPRRRPPSTSRLRSWRCRLPS

SEQ ID NO: 32534 - DNA, 787 bp, Zea mays
  misc_feature: Ceres CLONE 1409818-R
tattttttttttgttggggtggagcagatcttttcgggggaatgtatcatacttggtatgagagaattacaatgcaagacgacctttctgcagcctcacgaacgcccacggttcgagcttctcaggcagccacttgcccatcccgcacttcacccgcatcatgcgcgccatgaacgctccactgagctgccgtgcgcggcaactgatcaacagattgcaccgctcacgtacgctaacgccgtaggcactaatttaaggctgctatccaaggattgctggaacttacctccggaaaaacccaaagcccttggaaattgggatgggtcaaggggttcccccccgggggggggggcacattggaaaaaacactccgtaacttgacctggggtcgggggggggggcccccccataacttgggggacccagttctcccttcccttgtgggggcggtttcctggcaataaaaggggcccccccggtgtgtgggtgttttctcttgctccaataagcatatggggtgggggggaaaacccccccccccccacatttcgtgggggggggcccacagaagatctaccccccctcctccttttggtggggtgtggtgggtgtttttccccctcccacccttgcgggtgggggaaattaaaaaactattccgcgttgctctggggtggtgtgataataatttggttgttgtttgattttcccccccaccttcttcttttcctcttcggcggggggggggggatgataaacaaagtccggactctacccccctcgccgg

SEQ ID NO: 32535 - DNA, 731 bp, Zea mays
  misc_feature: Ceres CLONE 1409818-F
aaagctggagctccccgcggtggcggccgctctagaactagtggatcccccgggctgcaggaattcgcacgagaccattacctagaacatcctaatcgaaaagagctctctcactcgtcagataaagcctgaattaatcgactgtagctagttcgctcccgcgtgcgtgtacaagtagtctacttaaaatacactccctctcccttcaactcacactcagctgtgctcgcgtgatctctgaccgcctcgaccactaccgaatcacctcgcagctgatggcggacaccgtatcttcctgcctgagcctcgatccccactgagcaccaccgtgactgagagttctccatcagagtgccatgtgacgaaacccttcatgcgcgtcccctcatctcgccggctatcttgacactccctctccgacgagagccgatatggatgactcgccctgcgacgatcgaggacgtggatctcttctctcatcacgccgcgtgccgacaacgatgagctcaccgcccgtcggtcataggtccacaccagcaacaactgtgagggtctgctggaccccatcgatcaccgtgctccctcctggagctcatccgctacctcaatctcttccaggacacctactacagtatgccactacgaccgcttctccacctactgatgcagctgcaagtcaccggcgaagaccttcttcctcgacgtctgcctcgacagcatgctatactagg

SEQ ID NO: 32536 - DNA, 718 bp, Zea mays
  misc_feature: Ceres CLONE 1409819-F
  misc_feature: Translation starting site: 115
  misc_feature: SWISSPROT Homolog: EC 2.7.11.1 Non-specific serine/threonine protein kinase
aaagctggagctccccgcggtggcggccgctctagaactagtggatcccccgggctgcaggaattcctacgaaacctctcgaaagacttctcatagtgcaacgagcgattggacatggtgtctttggagtggtctataagggcatacttcaaaatgtacaactggttgctgagaagaactttgtgcaaacctccggagtccatgatagacgggttcagaatgacgcaggcaatctccagtttctggagcacagaaatatagtccagttacttggttcttgctaccaagtagaaaagaaattggtggagagaaacaacaaacattttctagcagatgttccagaaaagtttctatgctatgaatatctgtctaatggaagccttgacaactatatttacgatgaatcttctagaattgattggaccatgcgcttcaaaataatcttgcggatatgcaatgcgttacattttctgcatgaggagcgaagtgaagccatagttcatttgaaccttagacctagcaacataatgttgggtgacgacatgttgccgaaaattgcagattctgccctttcaaggttgtttggtgaagaacatcccagaactctcaccacaaacgttgggggacgtagaggatacattgccccggaaaaccatttcagatgagacctacctctacagccgacccattcaccttggggcgcctttttcttgcaaat

SEQ ID NO: 32537 - DNA, 807 bp, Zea mays
  misc_feature: Ceres CLONE 1409820-F
  misc_feature: Encodes the peptide sequence at SEQ ID NO. 32538
  misc_feature (11)..(11): n is a, c, t, g, unknown, or other
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
ttttccccccnnctnnnnccccccccccccccttcttccccannnnnnnnccaaactggagctccaccgcggtggcggccgctctagaactagtggatcccccgggctgcaggaattcgcacgagaccattacctagaacatcctaatcgaaaagacattggttgctatgagcttgtatagatatttttttttgtagttaggtgtgatcacccagtgtaccaaacccaaggtttaggaatccaacaattggtccttccctctcagcttgtctaacagtagggaccagttttaaggtgctgaacagtgaactggtttgacccacaggtgatgtgcgattgctacaccccacccggcgagccaatccccaccaacaagaggtacaacgccgccaagatcttcagcagccctgaggccgcccgccgagcagccgtgctatggcattgagctaggagaacacccttcctcccaagaaggacacccaactgggcccccttgtgctgcgcccatccggtggctttccccgggccctcagggcccctttaccacctggtcgaaacccggcggccgaaaaagtcgtttcggctcgcagacatccaggggacggcccaacttacaaaggcctggctttggtatggcggcccaatcaataatccagggggagatccaacggcggaagcgcggcggccatgggccctctggtacagttccaaagaatcaggacacttttcgtggggttattttcatcttaacgcgatcctaggtttttgtggcgtcgtttcgtattcacttttcttgcaggggggcag

SEQ ID NO: 32538 - protein, 38 aa, Zea mays
  misc_feature: Ceres CLONE 1409820-F
  misc_feature: SWISSPROT Homolog: EC 6.3.1.2 Glutamate--ammonia ligase
MCDCYTPPGEPIPTNKRYNAAKIFSSPEAARRAAVLWH

SEQ ID NO: 32539 - DNA, 677 bp, Zea mays
  misc_feature: Ceres CLONE 1409820-R
  misc_feature: SWISSPROT Homolog: EC 6.3.1.2 Glutamate--ammonia ligase
tcgaggtcgacggtatcgataagcttttttttttttttttttacgtactgaaaggtaccacaagtgtggtacggccattattagatgatataacattaacgccacacgtcttgttttttttttcttcttcctctttctgtgttctgtttttggcacaccacgacctgaccctcggatgatctagctagataataataataagcaaacagaacggaaggaacaatggctttgcaatcgcttcggggaccctgcaacgcaacggccgcggcgctcagggcttccagatgatggtggtctcggcgatcatggaggtgacgacgtaggggtccatgttggacgccgggtggaggacctcgaagtagcccttgccgttctgctccgtctccccgcccacgcgcaccgacgcgccgcggttggccacgccccagctgaacgtgttgatgtcggcggtctcgtgcctgccggtgagccggcgctcgttgccctcgccgtaggccgcgatgtgctccctgtgccgcagcttcagcttctcgatggccgccttgatcacctcgtacccgccctccttcctcatcgactccgtgctgtagttggtgtgcgcgccggctcctttccaatccccgggatcggcttcgggtccgacgtccacaccccaccggcgatctccgtgatcctct

SEQ ID NO: 32540 - DNA, 716 bp, Zea mays
  misc_feature: Ceres CLONE 1409821-F
  misc_feature: Encodes the peptide sequence at SEQ ID NO. 32541
aaagctggagctccccgcggtggcggccgctctagaactagtggatcccccgggctgcaggaattcgcacgagaccattacctagaacatcctaatcgaaaacgaaaaattcgaaagatccctccaggaaagatttttcttccctcctccgacgccccagcccaccaacacactctataaagcagccctcagtcacacacagaacgcacaagcgcaagccgggcaagaaaactccgtaggccagtctgcgagttggatggccttcttcttggccctcgtgtgcatcctcatcttgctagccatcgcctcctacgtccagtacactcgctggaaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctggcgagcccggaggcggcgcggttcgtgctggtgacgcaggcgcacctgttccaggcgacctacccgcggagcaaggagcgcatgatcgggccgtcggctctcttcttccacagggggactaccacttccgcctccggaagctcgtccagggggcggtcgggcccgaagcgctggcgcgcgcccggtg

SEQ ID NO: 32541 - protein, 153 aa, Zea mays
  misc_feature: Ceres CLONE 1409821-F
  misc_feature: SWISSPROT Homolog: EC 1.14.13.93 (+)-abscisic acid 8'-hydroxylase
MAFFLALVCILILLAIASYVQYTRWKKGKGRFGGHGRSAPLKLPPGSMGWPYLGETLQLYSQDPSFFFASKQKRYGEIFKTHLLGCPCVMLASPEAARFVLVTQAHLFQATYPRSKERMIGPSALFFHRGTTTSASGSSSRGRSGPKRWRAPG

SEQ ID NO: 32542 - DNA, 670 bp, Zea mays
  misc_feature: Ceres CLONE 1409824-F
  misc_feature: Encodes the peptide sequence at SEQ ID NO. 32543
  misc_feature (501)..(501): n is a, c, t, g, unknown, or other
  misc_feature (522)..(522): n is a, c, t, g, unknown, or other
  misc_feature (568)..(568): n is a, c, t, g, unknown, or other
  misc_feature (573)..(573): n is a, c, t, g, unknown, or other
  misc_feature (646)..(646): n is a, c, t, g, unknown, or other
aaagctggagctccccgcggtggcggccgctctagaactagtggatcccccgggctgcaggaattcgcacgagaccattacctagaacatcctaatcgaaaaaccaccaccgctctgcctcgcctcgcctcgcgtcgtctcacctcacctcacctcgccgactagggttttgtaccgccgtggatctcgccgtccccgccatggacgtctcgcacgcgggatcctccgtcgccggcgaggctccgaccaccggggagcaccggatggggactaccatcgtcggggtctgctacgagggcggcgtcgtcctgggcgccgattccaggaccagcactggaatgtatgtagccaaccgtgcttcagacaagattactcaactgacagacaatgtgtatgtctgtcgctctggatctgctgctgatacacaagtcatttcggattatgtacgctatttcctccaccaacacacaatccagcttggacaaccagctaccgttaaangtgcagccaacttgattaggntgctagcttatcagaacaagaacatgggtgcagctggcatgattgntgganggatgggacagtacgagggagccaaattttctcagtccctcttggtggaacgatcttgaagcaccatttgcanttggaggtcaggtccagttacctt

SEQ ID NO: 32543 - protein, 143 aa, Zea mays
  misc_feature: Ceres CLONE 1409824-F
  misc_feature (20)..(143): Pfam Name: Proteasome Pfam Description: Proteasome A-type and B-type
  misc_feature: SWISSPROT Homolog: EC 3.4.25.1 Proteasome endopeptidase complex
  misc_feature (101)..(101): Xaa is any aa, unknown, or other
  misc_feature (108)..(108): Xaa is any aa, unknown, or other
  misc_feature (123)..(123): Xaa is any aa, unknown, or other
  misc_feature (125)..(125): Xaa is any aa, unknown, or other
MDVSHAGSSVAGEAPTTGEHRMGTTIVGVCYEGGVVLGADSRTSTGMYVANRASDKITQLTDNVYVCRSGSAADTQVISDYVRYFLHQHTIQLGQPATVKXAANLIRXLAYQNKNMGAAGMIXGXMGQYEGAKFSQSLLVERS

SEQ ID NO: 32544 - DNA, 714 bp, Zea mays
  misc_feature: Ceres CLONE 1409825-F
  misc_feature: Translation starting site: 137
  misc_feature: SWISSPROT Homolog: EC 4.2.3.1 Threonine synthase
  misc_feature (430)..(430): n is a, c, t, g, unknown, or other
  misc_feature (507)..(507): n is a, c, t, g, unknown, or other
  misc_feature (609)..(609): n is a, c, t, g, unknown, or other
  misc_feature (661)..(661): n is a, c, t, g, unknown, or other
  misc_feature (670)..(670): n is a, c, t, g, unknown, or other
  misc_feature (695)..(695): n is a, c, t, g, unknown, or other
aaagctggagctccccgcggtggcggccgctctagaactagtggatcccccgggctgcaggaattcgcacgagaccattacctagaacatcctaatcgaaaaactctccaatctcgccgccaagcctcaccgcaccatggcgaccttcaccgcggcctcctccctctccctcctcttctcccacccgcactcccactcccgccaaccatccgcccaggggcccaccgccagctcccacctccacctgcatccgcgcgccagccgcgcgcgctgcgcctcttccgacacgacggccacgaagcaccgccgcccagcggaggagaacatccgcgaggaggcggcgcggctccgaggcccggcccagggtttctctgcgtggtacgagcccttcccgccggcgcccggcggcgacccgaacgagcgctactcngctggacgaggtcgtctaccgctccagctcggggggcctcctcgacgtgcgccacgacatgggaggcgctggcccgnctacccggggtccctactggcgtgacctcttcgactcccgcgtcggccgcaccgcctggcccacgggcttcgggcgtctggtcccagaaaagagttcgtgcntccccgagatcgactccgaccacatcgtctcccctcttcgagggcaactccnacctctttnctgggcggagcgcctcggccgcagncacccttcggcgggatgaa

SEQ ID NO: 32545 - DNA, 662 bp, Zea mays
  misc_feature: Ceres CLONE 1409826-F
  misc_feature: Translation starting site: 150
  misc_feature (662)..(662): n is a, c, t, g, unknown, or other
ggagctccccgcggtggcggccgctctagaactagtggatcccccgggctgcaggaattcgcacgagaccattacctagaacatcctaatcgaaaaaaagccgtcccttcccaaccctcccttcgatccctggggcggcggccgggaccatgacgaccggatccaacggcgacggaggcggcgcggggtcctggtacccgcagcgccgcccgcactacgggtacggcggggggtccgcctccttccgcggctgctgctgctgcctcttcctgctgctcaccttcctggcgctcctcgctctggacgtcccgctcgtcatcgtgctcgggatgaggccccgaaaccgaagttcgacctcaccaggttgtccgtgcagcaccctcgtgatggcctacgcaaaacgaccccggaggcggtgccccccggggccgcctacctctccctcaaatgacgctggtcttcccggccaataccccccaaaagggggaatcccggacgacgccccgggttcaacgtaatgaaccccggggggcccctcggggtgggggagaggcccgggttccaaaaacccgggcaaaaaacccgccaggtacaaaacccgggtatttggaaaacccttttaaaggggttccaaaccggagcgggaggacccccttccgggn

SEQ ID NO: 32546 - DNA, 665 bp, Zea mays
  misc_feature: Ceres CLONE 1409832-F
  misc_feature: Encodes the peptide sequence at SEQ ID NO. 32547
  misc_feature (593)..(593): n is a, c, t, g, unknown, or other
tcaccgcggtggcggccgctctagaactagtggatcccccgggctgcaggaattcgcacgagaccattacctagaacatcctaatctaaaaaggcagggcgccaattgcggtggccaccacttccaatccactccccgtgttcgcctcgccgagctgttcttgctctgtcctctctccaactccacgatttgttccacacccggttcccgagcctccgcagcgcttcttgctgaaaaagggaactccgagttctccagctctggatcggcagagagcggtggttccttttgcggactctgaggtccagttcttgtttttgatttgtctcatcaacccaccagtcgggctgcaggcttagagctggaaggaataatttgactagagaaatggggcagtgttgcagcagagctacggccccggactctggacggggaggtgccaatggttatggctatttctaccaggcaaagccggggcaagcacctcccagttacaaccctcctcagcaggcggccgaggtgaggtacacaccaatcggcgacgaactcttcggcaagcccaccccgtggctgtggcggcggaaaccaaacgncggacacgattctttggcaagcagtacgagggacgtgcggctctgtcctactcccctcgggaaagggccttg

SEQ ID NO: 32547 - protein, 92 aa, Zea mays
  misc_feature: Ceres CLONE 1409832-F
  misc_feature: SWISSPROT Homolog: EC 2.7.11.1 Non-specific serine/threonine protein kinase
  misc_feature (69)..(69): Xaa is any aa, unknown, or other
MGQCCSRATAPDSGRGGANGYGYFYQAKPGQAPPSYNPPQQAAEVRYTPIGDELFGKPTPWLWRRKPNXGHDSLASSTRDVRLCPTPLGKGP

SEQ ID NO: 32548 - DNA, 619 bp, Zea mays
  misc_feature: Ceres CLONE 1409833-F
  misc_feature: Encodes the peptide sequence at SEQ ID NO. 32549
  misc_feature (619)..(619): n is a, c, t, g, unknown, or other
ggagctccccgcggtggcggccgctctagaactagtggatcccccgggctgcaggaattcgcacgagaccattacctagaacatcctaatcgaaaaagcctgcctcggtgcgccgccgccacacctccaccatggctgcgaccacgccggccaccgacccgccggatgccttgcttgcagtaacagctgatgctcccactcctgctcgtcccaccccggcggagctggtagcccgcgccgtcgcccccgtcaagcccgccttcctctgcccgcctcccgtccgtgaggcacccaaggaggagggtaaagccgccggcggcggggccgtcgtaaaggtggagaagaagtccaagcgccagctcaagcgcgagcggcagcaggaacaaaaaatctacttctcacctttgtatcgaagtagggaaaaagtggaaatgtggactcatgcaaatatgggaacttcttgccgtttcaggcatgaacataaatgcttaatttgccccaaaaaccagctgaccttgaaaggaccttgcccatttacgtgcctgggaacatttggggcccaaatgggaacaaacttgggcaattcccttaaaaaccaaaaaggaaaaacctttgtccn

SEQ ID NO: 32549 - protein, 162 aa, Zea mays
  misc_feature: Ceres CLONE 1409833-F
MAATTPATDPPDALLAVTADAPTPARPTPAELVARAVAPVKPAFLCPPPVREAPKEEGKAAGGGAVVKVEKKSKRQLKRERQQEQKIYFSPLYRSREKVEMWTHANMGTSCRFRHEHKCLICPKNQLTLKGPCPFTCLGTFGAQMGTNLGNSLKNQKGKTFV

SEQ ID NO: 32550 - DNA, 748 bp, Zea mays
  misc_feature: Ceres CLONE 1409834-F
  misc_feature: Encodes the peptide sequence at SEQ ID NO. 32551
  misc_feature (504)..(504): n is a, c, t, g, unknown, or other
  misc_feature (550)..(550): n is a, c, t, g, unknown, or other
  misc_feature (626)..(626): n is a, c, t, g, unknown, or other
aagctggagctccccgcggtggcggccgctctagaactagtggatcccccgggctgcaggaattcgcacgagaccattacctagaacatcctaatcaaaaaaccggtcgcgaaccctcctcctccagccacgcctcgaaacggcgtcggggcctgcgcggcgagtccatggctgatcgcttcattcccaatgactttcctgacttcgtcgccgaggctgaggcctccgacggcgaggggcaccgccccgcagggcatcggggcctgctctcgcttccgtacaccaggctctccgaccacttcgtccgcgccgcgcgccgcctcaaggacaaggtggttgaggagacgtgggtgaaagccggacggaaggtgacggactacacgctctacacgggctctctcgggacagcgctgctgctgttcaagtccttccaggtcactggagaccgcggggacctcaccctcgccgctgatatcgtccgcgcgtgcgatgatgcgtcgcggngcctgccgttcttgacattcatatgcgggaagggcgggtgtctgcngctcttggggcggtgattggcaagcattgcgatgatcagctgagggtcactcagtatctgagctcctttgatgagnatacaatcaccgagaaaagtccaaatgagtggctgtatggaagggcgggctatctgtggggcttggtttggtcttgaatagcatctcagcgagaagacgatccctctcgagcacattaattc

SEQ ID NO: 32551 - protein, 132 aa, Zea mays
  misc_feature: Ceres CLONE 1409834-F
  misc_feature (113)..(113): Xaa is any aa, unknown, or other
  misc_feature (128)..(128): Xaa is any aa, unknown, or other
MADRFIPNDFPDFVAEAEASDGEGHRPAGHRGLLSLPYTRLSDHFVRAARRLKDKVVEETWVKAGRKVTDYTLYTGSLGTALLLFKSFQVTGDRGDLTLAADIVRACDDASRXLPFLTFICGKGGCLXLLGR

SEQ ID NO: 32552 - DNA, 532 bp, Zea mays
  misc_feature: Ceres CLONE 1409836-F
  misc_feature: Encodes the peptide sequence at SEQ ID NO. 32553
  misc_feature (255)..(255): n is a, c, t, g, unknown, or other
ggagctccccgcggtggcggccgctctagaactagtggatcccccgggctgcaggaattcgcacgagaccattacctagaacatcctaatcaaaactctcctatcttctctctctccatcgctccctcctccgcgccgcgttggcaccgaaccctcctgtcatggcaaggccgccgaaggaggcgattgataccttcatcagcatcacgggggcggacgaggccgtcgccgtacgcaaactcgaggaacatggtnggtggatcttaatcgaagcaataaattcacatttcaatgatggagacagcatattgaacggatcagtcaaaacgcatgcctgctagcgtgatgatttgatgacctgaaggaccacttgaaaaaaatttcaaaaactttgtggcaaaaagttcccgggcccctttgttctaagggacccaatttccccggaccatttttttgaaaaagaagggccccccggggggggggcttttcggaaaccccttttttttccccccccaaaaaaagggggggggga

SEQ ID NO: 32553 - protein, 59 aa, Zea mays
  misc_feature: Ceres CLONE 1409836-F
  misc_feature (32)..(32): Xaa is any aa, unknown, or other
MARPPKEAIDTFISITGADEAVAVRKLEEHGXWILIEAINSHFNDGDSILNGSVKTHAC

SEQ ID NO: 32554 - DNA, 626 bp, Zea mays
  misc_feature: Ceres CLONE 1409837-F
  misc_feature: Encodes the peptide sequence at SEQ ID NO. 32555
  misc_feature (234)..(234): n is a, c, t, g, unknown, or other
aaagctggagctccccgcggtggcggccgctctagaactagtggatcccccgggctgcaggaattcgcacgagaccattacctagaacatcctaatcgaaaaatcagatctagcagaactctctcgacctcatcggcgttggcggagcgcgtgttgaccggagatggcgccgagcgggtggaggaggagcgcggcggcgcgggtcgcctggcgcccggccacggtttgcctgtnggtcgcgctcgccgccgccgcactgacgctcgcccaggctaagaaagacctgacggaggttacccacaaggtctacttcgacatcgagatcgacggccagccccgcagccggattgtcatgggggctttttgggaaagactgtttcctaagacggcagaagaacttccgagctctttgcacagggagagaaaggggttggcaagagtggcaaagcccctccactacaagggaagtaaagtccacagaatcatccccaggcttcatgctccaaggaggtgacttcactctcggggacggggggggggggtggatctatctacgggtttgaagtttgggggatgaaaacttcaagatcaggccccctggcccaggccttcctgtccatgggcca

SEQ ID NO: 32555 - protein, 116 aa, Zea mays
  misc_feature: Ceres CLONE 1409837-F
  misc_feature: SWISSPROT Homolog: EC 5.2.1.8 Peptidylprolyl isomerase
  misc_feature (24)..(24): Xaa is any aa, unknown, or other
MAPSGWRRSAAARVAWRPATVCLXVALAAAALTLAQAKKDLTEVTHKVYFDIEIDGQPRSRIVMGAFWERLFPKTAEELPSSLHRERKGLARVAKPLHYKGSKVHRIIPRLHAPRR

SEQ ID NO: 32556 - DNA, 666 bp, Zea mays
  misc_feature: Ceres CLONE 1409840-F
  misc_feature: Encodes the peptide sequence at SEQ ID NO. 32557
  misc_feature (315)..(315): n is a, c, t, g, unknown, or other
  misc_feature (347)..(347): n is a, c, t, g, unknown, or other
  misc_feature (361)..(361): n is a, c, t, g, unknown, or other
  misc_feature (397)..(397): n is a, c, t, g, unknown, or other
  misc_feature (482)..(482): n is a, c, t, g, unknown, or other
  misc_feature (507)..(507): n is a, c, t, g, unknown, or other
  misc_feature (511)..(511): n is a, c, t, g, unknown, or other
aaagctggagctccccgcggtggcggccgctctagaactagtggatcccccgggctgcaggaattcgcacgagaccattacctagaacatcctaatcgaaaaatctccagcggcttcttccaaagctccaactccgacgagaaccgccactcctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgatgggtgcgtcggccgcgtcgccgccnagctcgagtccatggagccctgctccagcgtncaggataggatggnctacagcatgatcacggacgcaaagggagaaagggnctgatactccaggcggagtggtctgattgaaccactagcgccacacagcattggactgggctttatggctgctggcaaggctacnaactaccctcacaatgctggctcantganctgggaaggggggtcttattgaaggttttggggtgaaatggccttactgacccattttgggaatagagggttttcaaaaaaggggaaaaatacaagaaaaaccccctctggaattttttcaaaatttaaaaaccccttacccaaattcccttaga

SEQ ID NO: 32557 - protein, 64 aa, Zea mays
  misc_feature: Ceres CLONE 1409840-F
  misc_feature: SWISSPROT Homolog: EC 2.5.1.47 Cysteine synthase
  misc_feature (38)..(38): Xaa is any aa, unknown, or other
  misc_feature (53)..(53): Xaa is any aa, unknown, or other
MGEASPSIAKDVTELIGNTPLVYLNKVTDGCVGRVAAXLESMEPCSSVQDRMXYSMITDAKGER

SEQ ID NO: 32558 - DNA, 660 bp, Zea mays
  misc_feature: Ceres CLONE 1409842-F
  misc_feature: Encodes the peptide sequence at SEQ ID NO. 32559
  misc_feature (355)..(355): n is a, c, t, g, unknown, or other
  misc_feature (527)..(527): n is a, c, t, g, unknown, or other
  misc_feature (548)..(548): n is a, c, t, g, unknown, or other
  misc_feature (622)..(622): n is a, c, t, g, unknown, or other
  misc_feature (636)..(636): n is a, c, t, g, unknown, or other
  misc_feature (642)..(642): n is a, c, t, g, unknown, or other
tggagctccccgcggtggcggccgctctagaactagtggatcccccgggctgcaggaattcgcacgagaccattacctagaacatcctaatcgaaaaatttcttccccccttctctcgtcacgtccaataaaaaggggggaaaacttctctctctttttttccctcccccgcccgaatctgatgcttaaaccctcgccgggaggaggattccaatcccgacgcaccagcccgcgcccgccacctacagccgcgcccggatctccgccatggccgccgcgccgcaccaggcccagggccccgcagatagtgtgattccgctgcagtctgaacctgcacttgataataatccctccnagagtgcaaacgctagggaccagattctttctggtacggagaatgtgactacaggcaatgcacgcggcggcagctccttgaaatcgcaaaaaggcccgccagagaaggctagctctgtcggaaaacctggagaacaccttttccctaccatcaaaatgtgtatgcaccacangccacaccactctatcttggnagctacatgaacccttcagggacatggggaggatatccccattatgtgaggattggaggggctcattccgtatnctccggaatctacnatgacnacccagtcctcatgctat

SEQ ID NO: 32559 - protein, 96 aa, Zea mays
  misc_feature: Ceres CLONE 1409842-F
  misc_feature (30)..(30): Xaa is any aa, unknown, or other
  misc_feature (87)..(87): Xaa is any aa, unknown, or other
  misc_feature (94)..(94): Xaa is any aa, unknown, or other
MAAAPHQAQGPADSVIPLQSEPALDNNPSXSANARDQILSGTENVTTGNARGGSSLKSQKGPPEKASSVGKPGEHLFPTIKMCMHHXPHHSILXAT

SEQ ID NO: 32560 - DNA, 678 bp, Zea mays
  misc_feature: Ceres CLONE 1409848-R
ccaattgggtaccgggccccccctcgaggtcgacggtatcgataagcttttttttttttttttttgatattaatcaaatgcttttcttttattgaccaatgatattcttccatgtttttgaacaaaagccataccagctgggtgctggaataaactacaactcagccagaccatcaatcatctatcgtcctcccaccccggaatgtttgcggtggcctcattgaccatcttcacaagggtgaccacactttcaggaactcctggagggggcagtgaaagatttcttggtggaggagattgaaggtaagatcttttgtcaaaacgccattcaccgattttcccataaataagctgacccttcattgaataatcgcatccatacgtataatggatgatgaatgtgttgtccgttttcacgtcccaaggaggctgaatcataaaatctttatggagactatggtgcacaccgtgcagtgcactagcaacagcgtatgcgtacatttccaagacccatccgaatgctttgtctgtctcctgatcctctttcattctgtatgaaacattcatccaggttggagcaatcttctcaagctgagccctcttgattatcaccggagagttgcccataggcatcatatttgaaataggccctttttcctctgggaaaaactacatcat

SEQ ID NO: 32561 - DNA, 886 bp, Zea mays
  misc_feature: Ceres CLONE 1409850-F
  misc_feature (21)..(21): n is a, c, t, g, unknown, or other
  misc_feature (22)..(22): n is a, c, t, g, unknown, or other
  misc_feature (29)..(29): n is a, c, t, g, unknown, or other
  misc_feature (37)..(37): n is a, c, t, g, unknown, or other
  misc_feature (38)..(38): n is a, c, t, g, unknown, or other
  misc_feature (371)..(371): n is a, c, t, g, unknown, or other
  misc_feature (378)..(378): n is a, c, t, g, unknown, or other
  misc_feature (386)..(386): n is a, c, t, g, unknown, or other
  misc_feature (521)..(521): n is a, c, t, g, unknown, or other
  misc_feature (522)..(522): n is a, c, t, g, unknown, or other
  misc_feature (528)..(528): n is a, c, t, g, unknown, or other
  misc_feature (543)..(543): n is a, c, t, g, unknown, or other
  misc_feature (559)..(559): n is a, c, t, g, unknown, or other
  misc_feature (569)..(569): n is a, c, t, g, unknown, or other
  misc_feature (608)..(608): n is a, c, t, g, unknown, or other
  misc_feature (645)..(645): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (748)..(748): n is a, c, t, g, unknown, or other
  misc_feature (809)..(809): n is a, c, t, g, unknown, or other
  misc_feature (810)..(810): n is a, c, t, g, unknown, or other
  misc_feature (841)..(841): n is a, c, t, g, unknown, or other
  misc_feature (857)..(857): n is a, c, t, g, unknown, or other
  misc_feature (872)..(872): n is a, c, t, g, unknown, or other
ccccccgccccccgtccgccnnggagacncgcccccnnccaagctggagctccccgcggtggcggccgctctagaactagtggatcccccggggtgcagggattcgcacgagaccattacctagaacatcctaatcgaaaaaggggggagtttctcctcgtcgcctcgtgtctgccgggctcgctcggacgtccctgcccacctgcaatggcggacactttcgacctcctccttctcctgatcctggcctcgtgggtccgcgccgaccccgacgccggggtggcgagaagctgcttcggatcctggtccaaccatagggagccccccgcccatttggaatgccttcccgggcgaaaaacccccacgcgtgnggatggntcgggaanacagggttacggggaaaaaaaggggctatttccggatcttccgcaagggagagcagcgtcgggggccctggaacaacgagcctggtggtctaaccttttccccccacccggatcctgctttaagatagcacgcanncttgtnaaagaccccattctngggaagaccctagcgngcctgggcanagaagacttcccgttgtgtggcgcgctggctggatggancatgcgactcccgggcggtgcgttcgcttccccccanaaagacggatctnnnctcgtcacacccgaatctactccgcgggggcggcgggttgcgaccgttcgcgcgtgaaccgctctcccgcccgccgcggggggcgganaaaacaggtaggagaggcggttggccttccgcgggtcttggcggcatggcgaacgtctacnngccagcccgcacgctagtctggcgcagaaanggacccccacgacgancccggccgaaaaagnccagccgccccggg

SEQ ID NO: 32562 - DNA, 678 bp, Zea mays
  misc_feature: Ceres CLONE 1409853-F
  misc_feature: Encodes the peptide sequence at SEQ ID NO. 32563
  misc_feature (678)..(678): n is a, c, t, g, unknown, or other
tccccgcggtggcggccgctctataactagtggatcccccgggctgcaggaattcgcacgagaccattacctagaacatcctaatcgaaaaaaggcatcgctcgcttcccgttcaccccaatctgcccaccgagcgcttgtaggagcgcttacttgacttgacctcgtcgtctcctgccttccccctcccctccccttgccggcgcccgttctttcctttcctcgctggacgcccaccgccggagcgcaagaggggggaatgcagcctctgcagcaatacccgccggcgtccggatcctggggcgggatcgcgagagtcacgcccgcggtcaccaccgtggatgaggcgtccatggaacgtagcacgagctccttcaaggccctgcatgagatcaagaatctgcacccgcagctctacaccttctccaagtactgcttagaaaacataccaccacagctgagtagagacacaatgtgctggacaacctacaaagactatgacgttacaactgtcgtcaacgcgagcgatcatcaggatactgatgcatacaaactgatggatcttttcgagcagcaaggttcccaggcgtctacatatgaacagaaagaagcacgcctgaaccaggaaatctcctcatgccaggtctacacctgacaactaaggatcaggtatcagcn

SEQ ID NO: 32563 - protein, 131 aa, Zea mays
  misc_feature: Ceres CLONE 1409853-F
MQPLQQYPPASGSWGGIARVTPAVTTVDEASMERSTSSFKALHEIKNLHPQLYTFSKYCLENIPPQLSRDTMCWTTYKDYDVTTVVNASDHQDTDAYKLMDLFEQQGSQASTYEQKEARLNQEISSCQVYT

SEQ ID NO: 32564 - DNA, 763 bp, Zea mays
  misc_feature: Ceres CLONE 1409854-F
  misc_feature (411)..(411): n is a, c, t, g, unknown, or other
  misc_feature (426)..(426): n is a, c, t, g, unknown, or other
  misc_feature (748)..(748): n is a, c, t, g, unknown, or other
  misc_feature (751)..(751): n is a, c, t, g, unknown, or other
  misc_feature (754)..(754): n is a, c, t, g, unknown, or other
  misc_feature (756)..(756): n is a, c, t, g, unknown, or other
aaagctggagctccccgcggtggcggccgctctagaactagtggatcccccgggctgcaggaattcgcacgagaccattacctagaacatcctaatcgaaaactcgtgttcttgttcgacgccgcctcaggcaactccacacggacacacctcgctcgctctcgctcccgtatcgcggcttccttttcgaagtcttgataggtttaggtggggcctctgactatcctgacaatggccccttagagcggctgtacttcagacttcacaggtgacgtgaggcgtgctgacacacgtaactgattgatttgaggaagcgactatgcacccgcacttctcgccagagagtgatccgcgcgaactttgaggacgccttcaacgtagatgacttctctgacctgctgctgctcatgnaggacgggggctggncatccgggactggcgggccaaggatgctccccggaagagggctgacgttttgtgtgacactgggttataacaccgcaatttggcaacctcaagagggctcccacccccccaaaaaatcctttaagaagaatgccaataacccgggaagttggggagtttaaaatttaaaacattggggccctcccgcgggggggggatgaatctctctccccacacaaacaccaccccccccccaaaattgacgcaatatggcggggcaccgcaaacaacccccccctcttataggggcgggcgggggcaccctgcggtgtccgaaccagcnctnctncnccctccc

SEQ ID NO: 32565 - DNA, 670 bp, Zea mays
  misc_feature: Ceres CLONE 1409858-F
  misc_feature (557)..(557): n is a, c, t, g, unknown, or other
  misc_feature (655)..(655): n is a, c, t, g, unknown, or other
  misc_feature (670)..(670): n is a, c, t, g, unknown, or other
tggagctccccgcggtggcggccgctctagaactagtggatcccccgggctgcaggaattcgcacgagaccattacctagaacatcctaatcaaaaaaaaggaaacagctcgtccagtccgtagtccatagtactccatttgcaaattgcattgcattgcctcacctcaaccccacctcacctctcctctcctcggcctcacttcacaagtccacatcacgaaacaggagcgtcataaagacatgggcgtcgcagggtagcctcagaccagtgacgcatcggcagcggcagcggcagcgggcatggggtcctgactgactaactgcgaaggagatggctggagcgcgacggccccggagccattaatggggtgctcatcctcctcgtcctcgcctcctccccgccgggtcgcggacgcggtcggctccgccttttaaccggcctgtccgggagcggggcgccggaaccctagtgctgtgctggtggcacgcggcgcgccccatgggcatcgatctcaacatggtggacgggagaagccacgagcgcgccccggccgnccggtggcgtggccgggagctgtggcacgcgtgcgcgggggccccgtggtcgcgcttaccgcgggcgagcaagcctggtcgtggaacctgccgcaggncactgggggtgcggn

SEQ ID NO: 32566 - DNA, 682 bp, Zea mays
  misc_feature: Ceres CLONE 1409861-F
  misc_feature: Encodes the peptide sequence at SEQ ID NO. 32567
aaagctggagctccccgcggtggcggccgctctagaactagtggatcccccgggctgcaggaattcgcacgagaccattacctagaacatcctaatcgaaaaacaaactagaggacaagagagagagcaggaacagaggggagaagtgattctctctctgacccgcccactccctccttccctgctgcggtcgcactccgatcggtcctccgcgcacgtacgtacaggagccagacacgagatcgagaggtacagggcccgccagaaacctcacgagctatttggctcctgatcagcggcctgtgccgcgcgccgatgcacgcatggggccgacgctcctgcccgtgcgctccctctgcgcgtccgtcgcgctgctcgccgacgccttctcctcctcgctaacgcgtccgtcacgcgcatccgatgcgatcgatccgaacgcgaacataaccatcaagtggaatgtgatacagcgaactgccgatgacgatgtgacctgtgcttctctatacaagtaccaggaataccgccacatccagatgccaacgagtacgttaggctgtctgtgggcgaagaacgatgtgatctgactgatgacctgaggccagggcaccgagcacggcgactgatccaggtgcaaggacagcggcctccctcactgctgaaggaggcaccaggaggc

SEQ ID NO: 32567 - protein, 88 aa, Zea mays
  misc_feature: Ceres CLONE 1409861-F
MGPTLLPVRSLCASVALLADAFSSSLTRPSRASDAIDPNANITIKWNVIQRTADDDVTCASLYKYQEYRHIQMPTSTLGCLWAKNDVI

SEQ ID NO: 32568 - DNA, 706 bp, Zea mays
  misc_feature: Ceres CLONE 1409863-F
  misc_feature: Encodes the peptide sequence at SEQ ID NO. 32569
aaagctggagctccccgcggtggcggccgctctacaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggaccaaggagttcatggaagcccttgctgccggggctgatgtgtccatgattggcccagctcgggtatgcctcaactacgcctaccccgatcgccatataagcgcccccccccccccggctaaccattacccccccttatattcccccccccccccccccatccctagggtcccctcccccccccatttatccgttgcttagcccccccccactcgcatttacaattattt

SEQ ID NO: 32569 - protein, 168 aa, Zea mays
  misc_feature: Ceres CLONE 1409863-F
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGTKEFMEALAAGADVSMIGPARVCLNYAYPDRHISAPPPPANHYPPLYSPPPPPIPRVPSPPHLSVA

SEQ ID NO: 32570 - DNA, 667 bp, Zea mays
  misc_feature: Ceres CLONE 1409865-F
  misc_feature: Encodes the peptide sequence at SEQ ID NO. 32571
  misc_feature (325)..(325): n is a, c, t, g, unknown, or other
  misc_feature (343)..(343): n is a, c, t, g, unknown, or other
  misc_feature (644)..(644): n is a, c, t, g, unknown, or other
tggagctccccgcggtggcggccgctctagaactagtggatcccccgggctgcaggaattcgcacgagaccattacctagaacatcctaatcgaaaagggaaacaaagcgaagttggggcggcgagacgcgagacgcgagacgcgagaaatggcggagccgcctttggccgccggctgcacgacaaactggaggagggaggcggatgagcggctgcggcgcctccactccctcctcttcggcgccgacgccgcactcgagcacggggacgccacggtggcgcaggcgctcgcgctccgcctcctcggcttcctcgactctcaggnctagccggcaggcgcggngccccgaggacgccgccttcgtcgcgcccattcgcaccgcggcttccgctcggctagccgccgcctcacgcgcccgcgcctctgactccgaccgtgcagcttttgagcttgcaagaacggatgttggctgtgtttttgcaaatcagggtgacaataatgttgaaagaatccagcgttcgaagtatttccaagctcttcttcagaagtctaaagcaaatgtttctgaacaacggaatgcaacatgtcaagagttctcagttcaatgggctccatgcgtcgatgaaagccaagctgaaatggnaaatgagaagctaagcatcaggg

SEQ ID NO: 32571 - protein, 58 aa, Zea mays
  misc_feature: Ceres CLONE 1409865-F
MAEPPLAAGCTTNWRREADERLRRLHSLLFGADAALEHGDATVAQALALRLLGFLDSQ

SEQ ID NO: 32572 - DNA, 672 bp, Zea mays
  misc_feature: Ceres CLONE 1409866-F
  misc_feature: Translation starting site: 389
  misc_feature (328)..(328): n is a, c, t, g, unknown, or other
  misc_feature (343)..(343): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (349)..(349): n is a, c, t, g, unknown, or other
  misc_feature (350)..(350): n is a, c, t, g, unknown, or other
  misc_feature (352)..(352): n is a, c, t, g, unknown, or other
aagctggagctccccgcggtggcggccgctctagaactagtggatcccccgggctgcaggaattcgcacgagaccattacctagaacatcctaatcgaaaaagcaggagaagagagacgacacagcagctttttgggtttccccttccctttccccgcgcggtgatcgcagggttctccgcgagcgaggcagagcactgcgcgtcctccgtgacttcctggtgatcgctgggggttctggacgttggtgtttcatttggttggttggtgggtggcagcagccgtggcgagatggacctgatgatgccggtgacgggaaggagtgggcngcccccccaagaagnannnannangaggacgtgaacgcggacgcggacgctccgcggccgatggaggggctgcacgaggtcgggccaccgccgttcctgaccaagacgttcggacctggtggccgacccggccaccgacgaggtcatctcctggggccgcgccggcaacagtttcgtggtctgggatccccacgtgttcgccgccgtgctgctccccaggttctttaagcacacaacttctccagctttgtgcgccagctgaacacctatctagatggaccaggacaagggatgaacgaagctactacagcctacaagaaagaacaaactgcttgtttgtccaa

SEQ ID NO: 32573 - DNA, 690 bp, Zea mays
  misc_feature: Ceres CLONE 1409867-F
  misc_feature: Encodes the peptide sequence at SEQ ID NO. 32574
cgcggtggcggccgctctagaactagtggatcccccgggctgcaggaattcgcacgagaccattacctagtacatcctaatcgaaaaacctgccacatctggccatctctcagtctcacacgcgctgccatggacggatccatgtggtgcgctgccaactacgtgcctctgacgccgctcagcttcctggagcgcgccgcggtcgtgtacggcgaccgcgcggccgtcgtttgcggggataggcggttctcctggccgcgagaacaaggagcggtggcccccccggggaagccgctcttcgctcgctctggggttgggccgccccaaaggggaccccggttctccgcccccaacacgtccccgcccatggtcacagcccccccttttcgagcggtccccaaatacccccgccccccccctccccgggagggggttacaaaccccccccctctgcaactcgggtcatcgggttgttcccccccccccccccaacaacccaccccaaaaaacacacgagcgcttccccctccggggagaaccccctagtttttacaacccccacgagtgccgcgcgggggcggccgtcgatgagtgctcccccgccccccccccccccacgaggcggaagagcgccctcctccccgccgccaacccgcgctctctcctcacaccccacacgcggtaacaacg

SEQ ID NO: 32574 - protein, 138 aa, Zea mays
  misc_feature: Ceres CLONE 1409867-F
MDGSMWCAANYVPLTPLSFLERAAVVYGDRAAVVCGDRRFSWPREQGAVAPPGKPLFARSGVGPPQRGPRFSAPNTSPPMVTAPPFRAVPKYPRPPPPREGVTNPPPLQLGSSGCSPPPPQQPTPKNTRALPPPGRTP

SEQ ID NO: 32575 - DNA, 646 bp, Zea mays
  misc_feature: Ceres CLONE 1409871-F
  misc_feature: Encodes the peptide sequence at SEQ ID NO. 32576
  misc_feature (519)..(519): n is a, c, t, g, unknown, or other
  misc_feature (548)..(548): n is a, c, t, g, unknown, or other
cgctctagaactagtggatcccccgggctgcaggaattcgcacgagaccattacctagaacatcctaatcaaaaagttagtagttcaccagagttcacacaaaaatcacaagcaagcagtcgcgtgtgtagctcgcaacaatggcgacgaaccccggcctcttcaccgagtggccgtggaagaagctcggcaacttcaagtacctgctgctggcgccgtgggtggcgcacggcggctaccaagcggcgaccaaggggtggagggcggccgacctggggtacgtggccatcctcccgtcgctgctcctccgggcgctgcacaaccaggcgtggatcaccgcgtcccgcctgcagagcgcgcgcggccggcggcaggtcgtggaccgcggcatcgagttcgagcaggtggaccgcgagcgcaactgggacgaccagatcctgctcagcggcatcctcctgtacctgggctccacctacctgccggggggccagcacctgcccgctgtggcgcgcggacggngccgcgctcatcgcccgctgcacggcggncccgtcgagctcgtctactactggttgcaccggggggtggaccaccacttcctctaatcccggtaccaatccaaccacaaggcctccttcgtcacgag

SEQ ID NO: 32576 - protein, 154 aa, Zea mays
  misc_feature: Ceres CLONE 1409871-F
  misc_feature (127)..(127): Xaa is any aa, unknown, or other
MATNPGLFTEWPWKKLGNFKYLLLAPWVAHGGYQAATKGWRAADLGYVAILPSLLLRALHNQAWITASRLQSARGRRQVVDRGIEFEQVDRERNWDDQILLSGILLYLGSTYLPGGQHLPAVARGRXRAHRPLHGGPVELVYYWLHRGVDHHFL

SEQ ID NO: 32577 - DNA, 712 bp, Zea mays
  misc_feature: Ceres CLONE 1409872-F
  misc_feature: Encodes the peptide sequence at SEQ ID NO. 32578
tcaccgcggtggcggccgctctagaactagtggatcccccgggctgcaggaattcgcacgagaccattacctagaacatcctaatcgaaaaaatgtttcgagtgtccactacataattcctgaggcggtgtctgctccaacttcgcctattctcccccaggtggcggtagtagtggcgcggtactgtttgcgctactaggtctattgatatggatgacttcgggttcgagcgcggcgaggcgttcagctctcgggcgtacctcttggcagttactgaacctgacaacgggagcgtcaccctctgtaactgctactgctgctacgacggctgctctaatggtggaaaagacacccaggtgagaggccggaggggcccaaggaaatttattgtttgggtgcccggccaaaacctatggcaaccatgggggcaaaaggtcaaaaagccaaacaaatttccttgttggccccaccttaaaaacaaaggaaacccccccgtctttgggagttcctctcccccgggaaaatttcacgggggggccccttatatttgtttgggaaaaatatcccccccggtgtttaaaaaaaagggttttttaaaaaatagtaaaaaactttgttaaaattaagggggatccaaaaaaccccccccatcccggggtaaatcttgtgggggggttaaactttccctccgccaaaggggggtcgaaaaaat

SEQ ID NO: 32578 - protein, 65 aa, Zea mays
  misc_feature: Ceres CLONE 1409872-F
HRGGGRSRTSGSPGLQEFARDHYLEHPNRKNVSSVHYIIPEAVSAPTSPILPQVAVVVARYCLRY

SEQ ID NO: 32579 - DNA, 718 bp, Zea mays
  misc_feature: Ceres CLONE 1409879-F
  misc_feature: Translation starting site: 341
  misc_feature: SWISSPROT Homolog: EC 1.2.1.3 Aldehyde dehydrogenase (NAD(+))
  misc_feature (158)..(158): n is a, c, t, g, unknown, or other
  misc_feature (332)..(332): n is a, c, t, g, unknown, or other
  misc_feature (365)..(365): n is a, c, t, g, unknown, or other
  misc_feature (482)..(482): n is a, c, t, g, unknown, or other
  misc_feature (483)..(483): n is a, c, t, g, unknown, or other
  misc_feature (494)..(494): n is a, c, t, g, unknown, or other
  misc_feature (497)..(497): n is a, c, t, g, unknown, or other
  misc_feature (498)..(498): n is a, c, t, g, unknown, or other
  misc_feature (532)..(532): n is a, c, t, g, unknown, or other
  misc_feature (623)..(623): n is a, c, t, g, unknown, or other
  misc_feature (654)..(654): n is a, c, t, g, unknown, or other
ggagctccccgcggtggcggccgctctagaactagtggatcccccgggctgcaggaattcgcacgagaccattacctagaacatcctaatcgaaaaatccgctccccgccttccgcttccctaccccccgcatcacctaccaacgccgacaccatggngggccttcgcgaaggaggagcaccagttcctagccgagctcggcctcgcgcagcgcaacccaggcgcgttcgcatgcggtgcgtggggcggctcaggtcccaccgtcacctccacgagcccgaccgacaatcaggtcatcgcagaggtcgtggaggcgtccgtgcacgactacnaggagggcatgcgcgcctgcttcgatgccgccnagacatggatggcgattcctgctccaaagcgaggagagatcgttaggcaaatcggtgatgcactgagagcaaaagctccatcaccttggcaggctggtgtcacttgatatggggaannatcttcctganggnnatcgtgaggttcaggaaatcatcgacatgtgtgnatatgctgtgggggctaagtcgccaactaaatggatcattataccatctgacggccaaacctatgatgggtggggggggggatcccctggnaggtggggggggtaatacgggatttattttncttggggctgggcttggtgggatgctggcattgctttggcctggggaaattgggccctccggga

SEQ ID NO: 32580 - DNA, 682 bp, Zea mays
  misc_feature: Ceres CLONE 1409885-R
  misc_feature (354)..(354): n is a, c, t, g, unknown, or other
tcgaggtcgacggtatcgataagcttttttttttttttttttccaaattattcagcacgagaatacattgaccaattttccacaacagacgacgatcatacagctgatgcatgcacaacacaaccagtgaccagagtgcccagccacactagcaaagctcaaatattaccttccagacagacttatcacttattcccctagcaaaggatattcacatctatgacctggagcggcgatgaccagacaccggaattcaactggagcggcgatgaacacacacgacgaacaccgggacatacgtaacacacactcggggggagaaagacgaaggacggaaggacggtcatccacacntacaggaacacagtattctgcgacgaccctgctcgcctgctgatactgatagacacacacgcgcgcatctatccataatccatgcatggatgacttgcttaccaggaagccctgccgccgccgccagagccggaacttgcacctctcccggcgccggactcctgcgccctgccctggatggcttggcctggccgcccggccatgtggctcgcgagccccccggccctccgccatcttgcggggggcccacccccaagatagcccggggtgctcttgagaacccccgcccgcgtcaaggttggcccaaggccccgtgaacccaaggacc

SEQ ID NO: 32581 - DNA, 750 bp, Zea mays
  misc_feature: Ceres CLONE 1409886-F
  misc_feature: Encodes the peptide sequence at SEQ ID NO. 32582
  misc_feature (720)..(720): n is a, c, t, g, unknown, or other
aagctggagctccccgcggtggcggccgctctagaactagtggatcccccgggctgcaggaattcgcacgagaccattacctataacatcctaatcaaaaagaggaagttcagttccgtgccgtgctcgcgcgcacccaccccgcacgccgcatgccgccttactccgcgctgctgctgctgctgggaccaagaaaatcttttccttcacctttctctcctctttcccagttcatgcacggtctctgattgacgccatgggggatgacgccgccgccgaaacggactccacgtccgctcccgccacgcccacctccatcctcatctgcctggaggacggcagcgaccttctctccgacgcctactatggcgccggcgccaccgacttcgtcgtcgcccgcgactagcatctgcttgtccaggaccaggacgacgactacgtcgcgctgctcctgtccaaggagagcgcggcagtatgcgccccggcggaggaggaaacgtaggagtggatgaagaccgcacgctccggatgcgtacgctggatcatcatgaccacggcgatgttcgtcttcgacgggaagacgcgtacgtcgcagagacttacctcgatcgcttcctggttcaacggccgagtcatacggggaaacgagtgcgctttagcgctgctcacgtgggcgtggctgtctgtgcggatctatctggaggaggacacgcgacgccnctgtcgtactcccctctagaccagacgagt

SEQ ID NO: 32582 - protein, 49 aa, Zea mays
  misc_feature: Ceres CLONE 1409886-F
MGDDAAAETDSTSAPATPTSILICLEDGSDLLSDAYYGAGATDFVVARD

SEQ ID NO: 32583 - DNA, 706 bp, Zea mays
  misc_feature: Ceres CLONE 1409889-F
  misc_feature: Translation starting site: 535
  misc_feature: SWISSPROT Homolog: EC 4.2.1.9 Dihydroxy-acid dehydratase
  misc_feature (430)..(430): n is a, c, t, g, unknown, or other
  misc_feature (462)..(462): n is a, c, t, g, unknown, or other
  misc_feature (494)..(494): n is a, c, t, g, unknown, or other
aagagctggagctccccgcggtggcggccgctctagaactagtggatcccccgggctgcaggaattcgcacgagaccattacctagaacatcctaatcgaaaaaacccggctgtgctgtctcgtcgccttcctcccctcctgccggctgctgccgccgccagccgctgcaggcacgcttgccctctgctccctgtccatccactcatcattccccgtcatccaccaattcacaacccaaaaccctaaacccatttacctcaacgccaccgccgccgccgcgatgcagtccatggcgcccacctctccctcactcccggtggcaggccccgttccccgccgccgcctccagcgcgtccgcgccgccgcggtctccgacgagcccaaactcaacaagtacagcgcgcgcatcacggagcccaagtcgcaggncgcctcgcaggccgtgctctacggggtggccnttcaccgacgccgacctccgcaagccgcaggncgccgtctcttcggtgtggtacgaagggaacacctgcaacatgcacctgctccgcctcgccgaggccgtccgcgacggcgtccgtgaggccggcatggtcggcttccgattcaacaccgtcggtgtcaaggaacccatctccatgggcacccggggcaagggctacagcctccagtcccgggacctcatcgccgaaagcatcgagaccgtct

SEQ ID NO: 32584 - DNA, 705 bp, Zea mays
  misc_feature: Ceres CLONE 1409891-F
  misc_feature: Encodes the peptide sequence at SEQ ID NO. 32585
  misc_feature (404)..(404): n is a, c, t, g, unknown, or other
  misc_feature (613)..(613): n is a, c, t, g, unknown, or other
  misc_feature (616)..(616): n is a, c, t, g, unknown, or other
gctcttgaactagtggatcccccgggctgcaggaattcgcacgagaccattacctagaacatcctaatcgaaaaatctcaccacacaccgcagccccagcaagatcgcgcggaggccatggcgaagcccaagccttcctccgccggcgccaagccgaccgcgcctgcgccgccggttacagtgcactcggcgctggtcacctacacctccatgctcgcgctcctgtccctctgcccgcccttcgtcatcctcctgtggtacacgatggtgcacgcggacggatcggtggtgcggacttacgagcacctcagggatcacggcgtgctcgaggggctaaaggccatctggcccatgcccaccctcgtcgcgtggaagatcatcttcggcttcggcctcttcgaggncgtcctacagctgctgctccctgggaagcgcttcgaagggcccatctcgcctgccgggaacgtgccggtctacaaggcaaatggcttacaagcatatgcagtgaccttgataacttaccttggtttgtggtggttcggtatatttaacccctgcatagtgtatgatcacttggggagatatactctgctcttgtttttggaagctttgnatnctggattttctctacataaaggccatgtattcccatctcatctgactctggatctctgggatgtgataatgactctactggggatggag

SEQ ID NO: 32585 - protein, 196 aa, Zea mays
  misc_feature: Ceres CLONE 1409891-F
  misc_feature: SWISSPROT Homolog: EC 1.3.1.21 7-dehydrocholesterol reductase
  misc_feature (96)..(96): Xaa is any aa, unknown, or other
  misc_feature (166)..(166): Xaa is any aa, unknown, or other
  misc_feature (167)..(167): Xaa is any aa, unknown, or other
MAKPKPSSAGAKPTAPAPPVTVHSALVTYTSMLALLSLCPPFVILLWYTMVHADGSVVRTYEHLRDHGVLEGLKAIWPMPTLVAWKIIFGFGLFEXVLQLLLPGKRFEGPISPAGNVPVYKANGLQAYAVTLITYLGLWWFGIFNPCIVYDHLGRYTLLLFLEALXXGFSLHKGHVFPSHLTLDLWDVIMTLLGME

SEQ ID NO: 32586 - DNA, 670 bp, Zea mays
  misc_feature: Ceres CLONE 1409895-F
  misc_feature: Translation starting site: 245
ggagctccccgcggtggcggccgctctagaactagtggatcccccgggctgcaggaattcgcacgagaccattacctagaacatcctaatcaaaaaatctcccttcggttccccaattcgaaatcgaatcgggtcggtcttgccgtgcgtgcgtggctgcgcgagcgactcgactgcaccccccgctcctcccagtccccacacactgcgcgccgccgccgggtcctcctagggtttcgccgcgatgtcgctccggccgagcgagcgggagcagatgcggaagggcaactacaagcagacggtggacgcggaggagagccgccgccgccgcgagggccagatggtggacatccgcaaggccaagcgcgaggaaagcctccagaagaagcgccgcgatgggtttcccgcctccgccgctggtgtgccgccgatgggccactccaccgcgctccagcagaagctcgatggcttgccggcgatggtgcaggccgtccactccaacgacccctccgtgcagcttgaggccaccacacagttcaggaagctgctttctatagaacgtagtcccccaatcgaagaggtgtcagcacaggagtggtgccgcgattcattgagtttcttacacgtgaggaccatccccaactccagtttgaggctgcatgggcactca

SEQ ID NO: 32587 - DNA, 678 bp, Zea mays
  misc_feature: Ceres CLONE 1409897-F
  misc_feature: Translation starting site: 261
aagctggagctccccgcggtggcggccgctctagaactagtggatcccccgggctgcaggaattcgcacgagaccattacctagaacatcctaatcgaaaaacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagcccaggtccctgcccctccctccgtggtcgagaagaagcttgaaagcctctcagctatggttacgtggggtttattcggatgataataaccttcagcttgaggccaccacacagttccgcaaattgctctctatagagaggagtccccccatcgaagaagttatcaaaacaggtgtagttccaagatttgtgcagtctctcaccagagaggatttcccccagctgcagtttgaagctgcatgggctctcacaaat

SEQ ID NO: 32588 - DNA, 830 bp, Zea mays
  misc_feature: Ceres CLONE 1409902-F
  misc_feature: Encodes the peptide sequence at SEQ ID NO. 32589
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (40)..(40): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
tgccccccccccccccccnnnnnnngataaataattttgntccnnnnccaaactggagctccaccgcggtggcggccgctctagaactagtgcatcccccgggctgcaggaattcccacgagaccattacctagaacatcctaatcgaaaatctcatcttcggctgtgttcttgggcgtacgcggacacagacccgatcagaatcgtcgtccttgcgagcctcgccgatcccccactcccctcccctcgcttcaagatgcagatctttgtgaagaccctcaccgcaaagactatcgccctcgaggtgcagtcttctgacaccattgacaatgtcaaggctaagatccagaaccaggaggccattcccctactgaccaggagcgacttatcttcggcggaaggcagcttgaggacggaaccgcacactttgctgactacaccatccataaaggagggcaaccctcccacttgggggctgcgcccttaggagatggcatgcacaactttttgttcaaagacctcttgactgggcaaagaaattcaccccttttgggggggggtagggcccccagaaaaccattggaaaaacgggccagaggccaaaaggctccgcgggagagggggaggggcatccccccccttaacacaaaaaaaggtctccatactttttcacggaaaagccacgttggaacgcactaggggggggaccccttgggtttgacttatctacccttctgaggagggaagaagctccccctccccccttgggtgacctggcgcctcttaacggtgtttggactatggccacatacttttgtgtagaaaaaccc

SEQ ID NO: 32589 - protein, 76 aa, Zea mays
  misc_feature: Ceres CLONE 1409902-F
MQIFVKTLTAKTIALEVQSSDTIDNVKAKIQNQEAIPLLTRSDLSSAEGSLRTEPHTLLTTPSIKEGNPPTWGLRP

SEQ ID NO: 32590 - DNA, 743 bp, Zea mays
  misc_feature: Ceres CLONE 1409906-F
  misc_feature: Encodes the peptide sequence at SEQ ID NO. 32591
  misc_feature (12)..(12): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (24)..(24): n is a, c, t, g, unknown, or other
  misc_feature (35)..(35): n is a, c, t, g, unknown, or other
  misc_feature (36)..(36): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
ttgtttgggtgngggggggnngnnggggggaaggnnaannncnnngggccagtggccaaagctgctgctccccgcggtggcggccgctctagaactagtggatcccccgggctgcaggaattcgcacgagaccattacctagaacatcctaatcgaaaaatgaccgactagcccatggtctctctccgctccgacgcgcccgacccaccaccacatccctcatggctgccctcgccgacatcgactcctcggcacttccgccgtccgagtcatccaaaggcaagggcaagatggacgaggaggaggaggacgaggcggagggcgcggagaagatgtgcggcatctgctatctcgacggccggcgggccatccgcggcgagctcgactgctgcgcccatttcttttgctttgtcctgcatcatggcttggggccgcgtcgagtcccgctgtcccttctgcagggtccgcttccaaccatccgccgcccgcccgtccccggccgtttccccgacgagcgaaccgccttcgttccaagagcgcaaccaggtaccccatccctcaggggcaacgggagcaccactaccgggccgcaacaccctttacctgaaaccccatatcggcccccgttttgaaccaaccctccccgcgactggacgaaccctgcttgcttaccttctgtaaagcctcctgccgaactccccacctggcccaccaccctttaacttggtgttcaacgacacttg

SEQ ID NO: 32591 - protein, 136 aa, Zea mays
  misc_feature: Ceres CLONE 1409906-F
MAALADIDSSALPPSESSKGKGKMDEEEEDEAEGAEKMCGICYLDGRRAIRGELDCCAHFFCFVLHHGLGPRRVPLSLLQGPLPTIRRPPVPGRFPDERTAFVPRAQPGTPSLRGNGSTTTGPQHPLPETPYRPPF

SEQ ID NO: 32592 - DNA, 748 bp, Zea mays
  misc_feature: Ceres CLONE 1409908-F
  misc_feature: Encodes the peptide sequence at SEQ ID NO. 32593
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
ttttcccccccnnnncnnnnnncgggcaccggaanntntttttnnntnnccaaactggagctccccgcggtggcggccgctctatactagtggatcccccgggctgcaggatttcgcacgagaccattacctagaacatcctaatcgaaaaacactgcatcacaatacccgccagccagccatcgtcacactggcgagatctgcactctgcttagctccgagcttcagcgccttcgctgcttgctccacagtccacacacacacacgtccagctagctgcactgcaccaatggccggcgtcgaggtccaggtcccgactgccgctcccgtcgaggaggctgcccaggtggtcgccgcctccgccgtcgagacccccaaacgaggagaccgctgctccggcggtggagaccgaggccgtcgtcgcataaggacccggagccggtgcaggccgagactgagactgacacccaggaggccgaggccgttgctgagccgaccgaggaatagcccaaggaagcagagtcggaggccgccgctgctggcagcagagacggaggtcaacgaaacccatacggaggccgccccgccggaagaaaagacaaaggctggtgctgccccggtcgaagctgctgagccggatatagcccccgaaccccaacagggggccccattgtggaggctcaaccacgaaggaggaggaagtaccgccctggcagttggttgccactccctgggggcagaaacgtta

SEQ ID NO: 32593 - protein, 153 aa, Zea mays
  misc_feature: Ceres CLONE 1409908-F
MAGVEVQVPTAAPVEEAAQVVAASAVETPKRGDRCSGGGDRGRRRIRTRSRCRPRLRLTPRRPRPLLSRPRNSPRKQSRRPPLLAAETEVNETHTEAAPPEEKTKAGAAPVEAAEPDIAPEPQQGAPLWRLNHEGGGSTALAVGCHSLGAETL

SEQ ID NO: 32594 - DNA, 730 bp, Zea mays
  misc_feature: Ceres CLONE 1409909-F
  misc_feature: Encodes the peptide sequence at SEQ ID NO. 32595
  misc_feature (669)..(669): n is a, c, t, g, unknown, or other
  misc_feature (671)..(671): n is a, c, t, g, unknown, or other
  misc_feature (712)..(712): n is a, c, t, g, unknown, or other
  misc_feature (713)..(713): n is a, c, t, g, unknown, or other
caaagctggagctccccgcggtggcggccgctctagaactagtggatcccccgggctgcaggaattcgcacgagaccattacctagaacatcctaatcgaaaaccccgtccctccactccttccgtcgagcacttggcactgccaatggcggcagccgcccacaccccttcgatgcgcgcaagccgcctcctttcctcctgagatcgacgcacctcctcctctcgtactccattcccgctccaagttcgtttcttcggcaccgagacatcgcacggccgcccctgcatctcgtcctgctctcaggtccttggcctccgccgttcttcgacaggggcgcgccccggtgcccactccgcgaaatccgagtccctcgtgcagctccgtagggtgggagagatccatcaggcggtgagcggtaggaggcgcccgcacaactgaggggacgggcaatggcggccgtggcaggcccactctgcacgtggctcgacgccgcgtgcttgtctgcggcttgcgacgcacaagagtacaagcagaagcattgctgccccagcgaaagcggcgcttgggaggcgacgacatgctacggtcagcgacgccgccgtctcggagcgcaggagtcgcgacttggcgcggctctggaatggggctatggctgatgccttacagcntngaaaagaagtgtcatttgaacaagaagaaaccgattcaacnnagggggggaggggggtt

SEQ ID NO: 32595 - protein, 68 aa, Zea mays
  misc_feature: Ceres CLONE 1409909-F
MAAVAGPLCTWLDAACLSAACDAQEYKQKHCCPSESGAWEATTCYGQRRRRLGAQESRLGAALEWGYG

SEQ ID NO: 32596 - DNA, 745 bp, Zea mays
  misc_feature: Ceres CLONE 1409914-F
  misc_feature: Encodes the peptide sequence at SEQ ID NO. 32597
  misc_feature (620)..(620): n is a, c, t, g, unknown, or other
  misc_feature (646)..(646): n is a, c, t, g, unknown, or other
  misc_feature (739)..(739): n is a, c, t, g, unknown, or other
  misc_feature (745)..(745): n is a, c, t, g, unknown, or other
tggagctccccgcggtggcggccgctctagaactagtggatcccccgggctgcaggaattcgcacgagaccattacctagaacatcctaatcgaaaaaccacccgcagcgagccttgctcgtcaccaactcaccatcacgcgcgagcgcgacgcttcagctctctctcgttgaagagctgcatctccagccagtgcctagcccgtcgagggaccggtcgccttggcggactcccgctggtgctcctccacgcccatctctctcttttcctcgctgcagccacggatcttggtagcagggacgccaccgcatttccagaatccaaacggaattttacaggaatcgcgctggaatttcacaggaatcagttcaatttcacggaacaaacgcaggagcaaggaaattttgtcacgttcccctcatttgtttccttcggcgacgactaggcgagtgctgcccgctcttcacgaggttttcacctgcgacgaacatcctccagttgatcttctggctggaaaatcacgttgacggtggcaagtaggggttctatcatccgcagcctcatctcaagaagcaaaattctttcatgatccctttgaaccggagggcaagcctgcccanggctgggatggagtactttgatgcanggcggaagcctcgtaatggtggaaaatcattgcagccctggtcctcacacactctgtatatttgctctgaagcaatctcctggttttggtggncatagn

SEQ ID NO: 32597 - protein, 51 aa, Zea mays
  misc_feature: Ceres CLONE 1409914-F
  misc_feature (12)..(12): Xaa is any aa, unknown, or other
  misc_feature (21)..(21): Xaa is any aa, unknown, or other
MIPLNRRASLPXAGMEYFDAXRKPRNGGKSLQPWSSHTLYICSEAISWFWW

SEQ ID NO: 32598 - DNA, 574 bp, Zea mays
  misc_feature: Ceres CLONE 1409915-F
  misc_feature: Encodes the peptide sequence at SEQ ID NO. 32599
tccccgcggtggcggccgctctagaactagtggatcccccgggctgcaggaattcgcacgagaccattacctagaacatcctaatcgaaaacttggatagtccgtagccgcttgccctgttcgcatcttcgcgcgtggagcacaccgctccagctctccttcgacgggcacggccgagccgccttcgtcttggccgcagcggtgcgcgctctccatggcgtcctaattagcctagccgcaacgccgcgtccgtgcctgcgaagtagggtgtaaagttttgtatatgatgcccggcatggatgaaccccttcttgcaatggtcatagaccagcgggaaaagagagagcctggtactgcccgaggtcagaaacagatgtaccttgctggggcactcatcgctgcatggatcctacagaacattgtccagatgatttccatcaaggttggcgggccactttggggaggtggcctctccgggcccccctcgccccctcctttggggggtaacgggctccccttaattgcccgggaggggaaacaatttggaacccttgggggcaaaaccttctcgcaa

SEQ ID NO: 32599 - protein, 93 aa, Zea mays
  misc_feature: Ceres CLONE 1409915-F
MDEPLLAMVIDQREKREPGTARGQKQMYLAGALIAAWILQNIVQMISIKVGGPLWGGGLSGPPSPPPLGGNGLPLIAREGKQFGTLGGKTFSQ

SEQ ID NO: 32600 - DNA, 699 bp, Zea mays
  misc_feature: Ceres CLONE 1409920-F
aaagctggagctccccgcggtggcggccgctctatcaactagtggatcccccgggctgcaggaattcgcacgagaccattacctagaacatcctaatcgaaaagtccctccactcctcccgtcgagcacttggcactgccaatggcggcagccgcccacaccccttcgatgcgcgcaagccgcctcctttcctcctgagatcgacgcacctcctcctctcgtactccattcccgctccaagtttgtttcttcggcaccgagccatcgcacggccgcccccgcatctcgtcctgctctcaggtccttggcctccgccgttcttcgacaggggcgcgacccggtgcccactccgcgaaatccgagtccctcgtgcagctccgtagggtggaagagatccatcaggcggcgagcggtaggaggcgcccgtacaactgagggggcgggcaatggcggccgtggcaggcccactctgcacgtggctcggtgccgcgtgcttgcctgcggcttgggcgcagaacagactagcataagtattgctgccccggcggaagcgcgcctgggcgtcgaattctgctcagccaacgcccccgccacaggcagggttctaacacattgcaacgcccgcccccgataagcccgtaaattaacaagctcgacccgccccccgacctccaccgcccacttccccccccgcccccc

SEQ ID NO: 32601 - DNA, 735 bp, Zea mays
  misc_feature: Ceres CLONE 1409921-F
  misc_feature: Encodes the peptide sequence at SEQ ID NO. 32602
  misc_feature (486)..(486): n is a, c, t, g, unknown, or other
  misc_feature (540)..(540): n is a, c, t, g, unknown, or other
  misc_feature (609)..(609): n is a, c, t, g, unknown, or other
  misc_feature (634)..(634): n is a, c, t, g, unknown, or other
  misc_feature (714)..(714): n is a, c, t, g, unknown, or other
  misc_feature (721)..(721): n is a, c, t, g, unknown, or other
  misc_feature (735)..(735): n is a, c, t, g, unknown, or other
aaagctggagctccccgcggtggcggccgctctagaactagtggatcccccgggctgcaggaattcgcacgagaccattacctagaacatcctaatcgaaaaactcccaccgtatcctcccctgcgtagggtttaaccactcgcagcagccgccgtgactcgagaatcatgtcagcgccgccgtcgctcaagaccccggcaaccgccgtagcggtctctcggcgctcggtcgccaccccgagagccaccgggcttcgcggcgcctgtgctcccccgactcggcgcctccggtgctcagcctccgccgccgtggccggggcttccaccgagatggctgatgctccgctggactgggcagagaggtcgctggaggagttacgcagcttgccggaccacgacacgttctgcttgatggcgctctcgccgctggacgggcggtacgatcgcttcgtcaaggagctgatgccctttttcagcgagttcggnctaatcagataccgcgttctcatcgagatcaagtggctactgaaactttctcanattcctgagatcactgagggtgcctcagttcagcaaggaagcgcagtcctttgttgaatggcattattngagaatttttgcatagatgatgcanaagaaagttagaaaatcgagaaagtacccaccatgacgtgaaaagcgtggagtactttctgaagcaaaggtgcagctcanatcagangattgcaaaggtgn

SEQ ID NO: 32602 - protein, 88 aa, Zea mays
  misc_feature: Ceres CLONE 1409921-F
  misc_feature: SWISSPROT Homolog: EC 4.3.2.2 Adenylosuccinate lyase
  misc_feature (70)..(70): Xaa is any aa, unknown, or other
MADAPLDWAERSLEELRSLPDHDTFCLMALSPLDGRYDRFVKELMPFFSEFGLIRYRVLIEIKWLLKLSXIPEITEGASVQQGSAVLC

SEQ ID NO: 32603 - DNA, 699 bp, Zea mays
  misc_feature: Ceres CLONE 1409928-F
  misc_feature: Encodes the peptide sequence at SEQ ID NO. 32604
  misc_feature (420)..(420): n is a, c, t, g, unknown, or other
  misc_feature (489)..(489): n is a, c, t, g, unknown, or other
  misc_feature (495)..(495): n is a, c, t, g, unknown, or other
  misc_feature (496)..(496): n is a, c, t, g, unknown, or other
  misc_feature (639)..(639): n is a, c, t, g, unknown, or other
aaagctggagctccccgcggtggcggccgctctagaactagtggatcccccgggctgcaggaattcgcacgagaccattacctagaacatcctaatcgaaaaaggtcgcagctactccacggtgacggccgccatgagagccctcctctccctctcccgtctcgcccgacggcttccagcttctctcagccctgtaagggcgccgacaacattactcctccggcacatccgtagcggatgcccctccgccgccgccatctcatgactcgacgcccttcgtctcccgcatcctcgaatcggagccgtgcctgaccccgaacgacgagtcggagccggcatccgatccgaccctcgacgagttcctcgcgcgcttcgtggctgccttccgcccgcgactggcggctgccttccccaacctgnaccgtgacgtgctcgacgagatgctccgcctcgtcgcggacgccgtgctgtgccgcctcaccgggacgnaccggnnggggcgatgctattgagctcaatgacgacctctgggcggccggtatgggaggtcagcgcctccgtgcgcgggctatgcgcccgggatcaggtccgcgccgaccttcgccaatccttcactgcgacgaggtgagaaaaatgagncggtccccctgtcgatgtcggcatccgcggttccatgctccgggagctccgcttcagtgg

SEQ ID NO: 32604 - protein, 43 aa, Zea mays
  misc_feature: Ceres CLONE 1409928-F
MRALLSLSRLARRLPASLSPVRAPTTLLLRHIRSGCPSAAAIS

SEQ ID NO: 32605 - DNA, 684 bp, Zea mays
  misc_feature: Ceres CLONE 1409929-F
  misc_feature: Encodes the peptide sequence at SEQ ID NO. 32606
  misc_feature (311)..(311): n is a, c, t, g, unknown, or other
  misc_feature (312)..(312): n is a, c, t, g, unknown, or other
  misc_feature (314)..(314): n is a, c, t, g, unknown, or other
  misc_feature (315)..(315): n is a, c, t, g, unknown, or other
aaagctggagctccccgcggtggcggccgctctagaactagtggatcccccgggctgcaggaattcgcacgagaccattacctagaacatcctaatcgaaaaaacaaacaaccctaatccgtgaccgtggacacgccgcaagctccatcgcgcgaatagattggggggattcaatagaggctacgcggggattggtcgcgctcgagatctcagcaccctcgcgcctgaaatctttctattgttgtcgtggttcaggtgatgagatcttggggagcgcgactcgctcggtcctgagatgctggggtaaccgnngnnggcggtggccgcagcgtccatctctcctcccacaaggacctcctcctcggccgctgcggccggagcttcctcttcggcaacacgtggtttctcctctccacttacccggcgcgcctcctgcacaccacggaccgtcgcgctccctccgctttcgtcgccgccatcaaccggggtcccctgcgtgcggtcgcactgcacggggcagggcctgctgcagagaggcagcattgtcatggctgcctgcggctatgttcttaggcgaactgagctgggtgctgccaagcgccagcagccggataaggacccatctggcggaacacgcgcctctcgtattgcagccatggggtcactgggcagtgctgcgcggcc

SEQ ID NO: 32606 - protein, 45 aa, Zea mays
  misc_feature: Ceres CLONE 1409929-F
MAACGYVLRRTELGAAKRQQPDKDPSGGTRASRIAAMGSLGSAAR

SEQ ID NO: 32607 - DNA, 742 bp, Zea mays
  misc_feature: Ceres CLONE 1409933-F
  misc_feature: Encodes the peptide sequence at SEQ ID NO. 32608
  misc_feature (543)..(543): n is a, c, t, g, unknown, or other
  misc_feature (698)..(698): n is a, c, t, g, unknown, or other
  misc_feature (742)..(742): n is a, c, t, g, unknown, or other
tggagctccccgcggtggcggccgctctagaactagtggatcccccgggctgcaggaattcgcacgagaccattacctagaacatcctaatcgaaaagggagtcggcactcgggtctcgacgtctcgtctcgtctcgtctcgcctgcccgcagccccttggcttcgttccatccggcttctcggcggcggcggagaggagggggatggcgcaccggctgctgcgggacgcgcaggcggacgggtgggagcggtcggacttccccatcatctgcgagtcatgcctcggcgacaacccctacgtccggatgttaagagctgaatatgacgaagaatgcaaaatttgtgcacgtccttttactgtattccggtggcgtcctgggcgagatgcaaggtacaagaagactgagatctgccagacatgttgcaagctaaagaatgtctgccaggtctgcctgctggatcttgaatatggtctgcctgttcaggtccgagatacagcactctctatcaattccaatgatgcaattccaaggagtgatgtncatcgcgaatattttgcagaagagcatgataggagggccagagctggcatagactatgattcatcctatggggaggctcgccccaatgataccattctgaagcttcaaaggacagcaccatatttacagaggaacagagctcatgtttgcagttncttttgtgcggaggtgatggtacagaggagctgagtgcccttan

SEQ ID NO: 32608 - protein, 175 aa, Zea mays
  misc_feature: Ceres CLONE 1409933-F
  misc_feature (165)..(165): Xaa is any aa, unknown, or other
MAHRLLRDAQADGWERSDFPIICESCLGDNPYVRMLRAEYDEECKICARPFTVFRWRPGRDARYKKTEICQTCCKLKNVCQVCLLDLEYGLPVQVRDTALSINSNDAIPRSDVHREYFAEEHDRRARAGIDYDSSYGEARPNDTILKLQRTAPYLQRNRAHVCSXFCAEVMVQRS

SEQ ID NO: 32609 - DNA, 1049 bp, Zea mays
  misc_feature: Ceres CLONE 1409936-R2
  misc_feature (693)..(693): n is a, c, t, g, unknown, or other
  misc_feature (1049)..(1049): n is a, c, t, g, unknown, or other
tttttacgaattgggtacggggcccccctccaagtcgacggtatcgataagcttttttttttttttttttattccgcaacagaataccttgaccaattttccacaacagacgacgatcatacagctgatgcatgcacaacacaaccagtgaccagagtgcccagccacactagcaaagctcaaacattaccttccagacagacttatcacttattcccctagcaaaatatattcacatctacgacctggagcggggatgaaaagacaccgaaattcaactggagcggcgatgaacacactcgacgaacaccaggacatacgtaacacacactccgggggagaaatacgaacgacggaaggaccgtcacccacccctacaaaaaaaaagaattccgcggacaaaccttggtgggtgcccccacccgacaaaacacgcaaggggtgctatcaatagcaaaaaaccaaggcatgggatgaaatttcctttacccaagaaagaccatgatatgcccgcgggccaaacggcccggggcaccggggaccctccccccctgggggcccggggcctctatgaggggaccctgtgccccctggaaatagagccctcggacccttgtccccggccaccgtcctcatctctggtttgggcaccaattaatattgaccaacccacacacgactcaagtccctcgntccgtttctccatataggaaatgaattacccctttcatctgcccaatataataaactcctcgagcgccgtccctctcctcggtaaaagagtcccgaggcacccgcacgaccccagagcatggggggcaaaaaaccatacaaagaatatgataaaggaataaaaagacactcctataaaagagcgctcatagtatgtgctaacccgaatagcatcagagagataacaaacccacatggaaacgagccctgcccccctccaatactataacaatttcgctggtgtgtggataaaatcaagaaaatagatggctcctaactaaaacaacagacaatctctgcctcgctccaggtcaccn

SEQ ID NO: 32610 - DNA, 1020 bp, Zea mays
  misc_feature: Ceres CLONE 1409936-R
  misc_feature (1020)..(1020): n is a, c, t, g, unknown, or other
cattggggtacggggccccgccccggggcaagggtatcgataagcttttttttttttttttttgttccgcaagagaatacattgaccaattttccacaacagacgacgatcatacagctgatgcatgcacaacacaaccagtgaccagagtgcccagccacactagcaaagctcaaacattaccttccagacagacttatcacttattcccctagcaaagcatattcacatctacgacctgggagcggcgatgaaaagacaccggaattcaactggagcggcgatgaacacacacgacgaaacaccatgacatacgtaacacacactcggggggagaaaaacgaatggacggaaggaccgtcccccccacctacagggaaacacagcattcctgcacgaaccctggtgggctcccccaaaatgaaagaaaaccaggaggcgggaatctatgacataaacccatgtgatgagagagactttggtttcccagggaaagcacctgcccagcaccagaaagatgtcagggtaccttggtttcttggcccccggtggggcgggcctccctgggggccaccgtcccctgagaagagggcagggcccgtgccccgggggccgggaattgggagagagcgccccacttgggatcgcccactcgccgctccagggaagatccctttgagagaaggaggcccatccctctcccccctgtataatacccaacggtctatgcctctttatgaaacacccctcccaaaataaaccccttgtatttgagtgaacttttacaagtcacaggggaagggggggaagagcccccgtggagtacggcaggtctgtgttcagtcagaaagtttactaaaaaactcaacttatgcatgggacgctatcctagaaaaactcactctccgtcggcgtggtaccctctcatcttggtggtcattaaagtaagatattaaaatgcacaggggcgcatggttacttgttttctcgtcctaataacccctggcgtaggtcagattn

SEQ ID NO: 32611 - DNA, 673 bp, Zea mays
  misc_feature: Ceres CLONE 1409937-F
  misc_feature: Encodes the peptide sequence at SEQ ID NO. 32612
  misc_feature (310)..(310): n is a, c, t, g, unknown, or other
aagctggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctgaggagccaccaggaggtgtaccacccgggcgccctcaaggcggcgttcgctgagttcatctccaccctcatcttcgtcttcgccggncaggtctccgacatgaccttcagcaagctgaacggggggcggcccgacgaccccgggggggcctgattcgcgggggcggttggcccacgccgttccccgctgttcctggcgggggtctgtggggggagacattctccggggggacacgggaaccctggccgggaccttggggggcctttggggggggggaaaattccccctggtccggggggtcccctgaacggggtgggggcaaattggttgggggccccaccggggggggggttctcggcccccttttcccaacgggggggggagagccacggggccacccttggggttaaaagggggtgttcttgtggggggaaacccttttttctttaa

SEQ ID NO: 32612 - protein, 58 aa, Zea mays
  misc_feature: Ceres CLONE 1409937-F
MPINRIALRSHQEVYHPGALKAAFAEFISTLIFVFAGQVSDMTFSKLNGGRPDDPGGA

SEQ ID NO: 32613 - DNA, 663 bp, Zea mays
  misc_feature: Ceres CLONE 1409938-F
  misc_feature: Encodes the peptide sequence at SEQ ID NO. 32614
tggagctccccgcggtggcggccgctctagaactagtggatcccccgggctgcaggaattcgcacgagaccattacctagaacatcctaatcgaaaagacccaggcaagaggcaacacagcaagcagcagaaaacatctccgggagtccgaaccacccacaggcggcaggccacaccacaggttccgcttccgcacagctgctagctagctagcgttcgcaagtagcagtagcgttccatcgaggtcgaggcaatgacggtgatggccgaagtagtctcgaccaccggcgcggcgctccggagcccggcctcgcagccgctgccggccgcggtgaagaacgcagacgctgagaagctccagttcatcgaggagatgacctccaacgtggacgccgtgcaggagcgcgtgctgggggagatcctcgcccgcaacgccggcaccgagtacctcgccaagtacggcctcgccgccgctactacggaccgcgccaccttccgcgccaaggtgcccgatggcgacggacgacgacctgcagccgaacatccgccgtattgccgacggggaacggatcccccatcctgtacagagcccccgggtatccgcagtcctccccgggctccagcaaaacacctccggccgcgggcgcagctcaagtcccttag

SEQ ID NO: 32614 - protein, 136 aa, Zea mays
  misc_feature: Ceres CLONE 1409938-F
MTVMAEVVSTTGAALRSPASQPLPAAVKNADAEKLQFIEEMTSNVDAVQERVLGEILARNAGTEYLAKYGLAAATTDRATFRAKVPDGDGRRPAAEHPPYCRRGTDPPSCTEPPGIRSPPRAPAKHLRPRAQLKSL

SEQ ID NO: 32615 - DNA, 651 bp, Zea mays
  misc_feature: Ceres CLONE 1409939-F
  misc_feature: Encodes the peptide sequence at SEQ ID NO. 32616
  misc_feature (226)..(226): n is a, c, t, g, unknown, or other
  misc_feature (264)..(264): n is a, c, t, g, unknown, or other
  misc_feature (393)..(393): n is a, c, t, g, unknown, or other
  misc_feature (424)..(424): n is a, c, t, g, unknown, or other
caaagctggagctccccgcggtggcggccgctctagaactagtggatcccccgggctgcaggaattcgcacgagaccattacctagaacatcctaatcgaaaaagttcgccaccatcgtgctccgtacacgctccgctccggccatggccgccgccgcggcctccttttcggccctgccgttccttctacttttgctgctggtgccgtcgctcgacggcgcctccnatgtgacgtacgaccaccgctccctcatcatctccggncgccgccgcctcgtcatctccacctccatccactacccccgcagcgtccccgagatgtggcccaagctggtggctgaaagcaagggacgcggcgccgactgcatcgagacctacgtcttctggaacggncatgagatcgccccaaggcagtactacttcnaggaccggttgaactggtgcggttcggtgagggtcgtaaaaacgctgggctgctcctgatcttgggcatcgggccctaatgccgccgccgagtggattattggagcgtgcccggggggggttggacttacgggcaagaaacggtttccgggaaaacaacgggcctttcagaacccattgaaaggttcccggcctacttccgggaattgatgaaaaagaacagctctc

SEQ ID NO: 32616 - protein, 112 aa, Zea mays
  misc_feature: Ceres CLONE 1409939-F
  misc_feature: SWISSPROT Homolog: EC 3.2.1.23 Beta-galactosidase
  misc_feature (28)..(28): Xaa is any aa, unknown, or other
  misc_feature (94)..(94): Xaa is any aa, unknown, or other
MAAAAASFSALPFLLLLLLVPSLDGASXVTYDHRSLIISGRRRLVISTSIHYPRSVPEMWPKLVAESKGRGADCIETYVFWNGHEIAPRQYYFXDRLNWCGSVRVVKTLGCS

SEQ ID NO: 32617 - DNA, 777 bp, Zea mays
  misc_feature: Ceres CLONE 1409940-F
  misc_feature (203)..(203): n is a, c, t, g, unknown, or other
  misc_feature (233)..(233): n is a, c, t, g, unknown, or other
tggagctccccgcggtggcggccgctctagaactagtggatcccccgggctgcaggaattcgcacgagaccattacctagaacatcctaatcgaaaagtccctccactcctcccgtcgagcacttggcactgccaatggcggcagccgcccacaccccttcgatgcgcgcaagccgcctcctttcctcctgagatcgacgcanctcctcctctcgtactccattcccgctccnagtttgtttcttcggcaccgagccatcgcacggccgcccccgcatctcgtcctgctctcaggtccttgggctcccgccgtcttcgacaggggcgcgacccggtgcccactccgcggaatccgagtccctcgtgcagctccgtagggtgaaagagatccatcaggcggtgagcggtaggaagccgcccgtacaactgagggggcgggcaaatggccgccggggaaggccaattctgcacggggttcctggccccggggtttgcctgcggtttgggacccaaaaaagtacagctttacttttgtttccccgggaaaagggggttttggggggggtttttgttttgggcagggccccccccccggggggggggggtccgggtttgggccgcctcgaaagggataagtgggtgcccttaacacggcgaaaaaaggcttttttaaaaaaaaaaacccccttttcaccaaagggggggggttgtcccccgggggggggggagaaacaccctttgggcgcgagacccccccctttttataaaaaaattttt

SEQ ID NO: 32618 - DNA, 707 bp, Zea mays
  misc_feature: Ceres CLONE 1409941-F
  misc_feature (682)..(682): n is a, c, t, g, unknown, or other
cagagctggagctccccgcggtggcggccgctctattttctagtggatcccccgggctgcaggaattcgcacgagaccattacctagaacatcctaatcgaaaaccctcccccaccgtcattgatcaccaacaccacgaaagccacgcctgacagacagctgtctcatttctggccgctgccttgctgtggggacccctcgcactacgctgcccctaacacatacattcatacgcatgcgcacgacgtgctgctagtgccgctgatgcggaggctagctcccatgtgcagacgacctcgctcccagaccggcgcagtcgacggcctcacaccgcgcgctccgggttgttcgtccggagacaaacctgctcaaggtgatcctgacgcgacgacccttcatgtccgcgccgcgaaacctctgctagagctacggtgccatcttcaccatgcgtatggtccactccatacttcatcgtgctcacctcgacgtagctcctccacgagccgctgatgaagaccgcccgcatgttctcgacgcgctccaagaacagtcccacccgattcatcttcgaggctcgcagtacaccgtcgactcggggacctacaccccccagtgatgtgctctgctccgtaagtacgacgtcgagatcgtgtacatcacccgcgaacagtgcttctccagnatcagatagtgggccatggacgcgc

SEQ ID NO: 32619 - DNA, 764 bp, Zea mays
  misc_feature: Ceres CLONE 1409943-F
  misc_feature: Encodes the peptide sequence at SEQ ID NO. 32620
aaagctggagctccccgcggtggcggccgctctataactagtggatcccccgggctgcaggaattcgcacgagaccattacctagaacatcctaatcaaaaaatcttcgccgccgctaaacgttccccccacgccccaacctatccacgcgaaaccttctttcccccgggagacgattcgtcagggagaggaaagaggcaagaggggccatggacgctgccaagttggtgacgccggtcgctgtgtctcacattctggcgcacccgtcggcgggctccgacggcgcagtgaccgatctcgtcgttcaggtcctcgacctgaagtccgtcggcacgggcagccggttcagtttcacagcaactgacgggaaggataagatcaaggcgatgcttcccaccaacttcgggtcggaggtccgctctggcaacctgaagaacctcggcctcatccgcatcatcgactacacttgcaacgtcgtcaaaggcaaagatgacaaagtcttggttgtcatcaaatgcgagcttgtgtgcccagcgcttgacgccgagatcaacggcgaggccaaaaaagaggagcctcccattgtgctgaaaccctaaggacgaatggatgtgcgtgacatccccactcgctatgaagcccaggaaggagggggaagtctggcgtcccagatcgggaatggagcagcggggaaaatactgctcccggccaagccccctttccatggaaaagagagggcccatcctttggatcactcctgaacc

SEQ ID NO: 32620 - protein, 129 aa, Zea mays
  misc_feature: Ceres CLONE 1409943-F
  misc_feature (6)..(108): Pfam Name: Rep-A_N Pfam Description: Replication factor-A protein 1, N-terminal domain
MDAAKLVTPVAVSHILAHPSAGSDGAVTDLVVQVLDLKSVGTGSRFSFTATDGKDKIKAMLPTNFGSEVRSGNLKNLGLIRIIDYTCNVVKGKDDKVLVVIKCELVCPALDAEINGEAKKEEPPIVLKP

SEQ ID NO: 32621 - DNA, 557 bp, Zea mays
  misc_feature: Ceres CLONE 1409944-F
  misc_feature: Encodes the peptide sequence at SEQ ID NO. 32622
  misc_feature (247)..(247): n is a, c, t, g, unknown, or other
  misc_feature (342)..(342): n is a, c, t, g, unknown, or other
  misc_feature (343)..(343): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (351)..(351): n is a, c, t, g, unknown, or other
  misc_feature (356)..(356): n is a, c, t, g, unknown, or other
  misc_feature (360)..(360): n is a, c, t, g, unknown, or other
  misc_feature (366)..(366): n is a, c, t, g, unknown, or other
  misc_feature (367)..(367): n is a, c, t, g, unknown, or other
  misc_feature (385)..(385): n is a, c, t, g, unknown, or other
  misc_feature (386)..(386): n is a, c, t, g, unknown, or other
  misc_feature (406)..(406): n is a, c, t, g, unknown, or other
aaagctggagctccccgcggtggcggccgctctagaactagtggatcccccgggctgcaggaattcgcacgagaccattacctagaacatcctaatcgaaaagaccctcgcttcacttgtcacggactcgcgtccacaaaccacaaccagctcactcaagaacaaagaacccaacccatggcttctcccaagccgctcctcctgctcgccacctcgttcctgagctgcggcctcctggtggccgccngactacgccccaatgaccctgaccgtggtgaacaactgcccccctaccgtgtgcccggcatccagccaactccggcacgacgtcctggagggcgnngnnntctnctccngcgntctccnnacagtcttcccgggggcnngccacccctggtccggccgnatctggggccgccacggggcttgccggggggccgggccccaattccactgggcccaagggggatttggggggggcgtcccaaaggcgggggggttcggggggccggggcccccaaaccttggggcaagggaaaccccccccccggaaaaaa

SEQ ID NO: 32622 - protein, 99 aa, Zea mays
  misc_feature: Ceres CLONE 1409944-F
  misc_feature (28)..(28): Xaa is any aa, unknown, or other
  misc_feature (29)..(29): Xaa is any aa, unknown, or other
  misc_feature (30)..(30): Xaa is any aa, unknown, or other
  misc_feature (31)..(31): Xaa is any aa, unknown, or other
  misc_feature (33)..(33): Xaa is any aa, unknown, or other
  misc_feature (34)..(34): Xaa is any aa, unknown, or other
  misc_feature (36)..(36): Xaa is any aa, unknown, or other
  misc_feature (43)..(43): Xaa is any aa, unknown, or other
MTLTVVNNCPPTVCPASSQLRHDVLEGXXXXSXXLXTVFPGAXHPWSGRIWGRHGACRGAGPQFHWAQGGFGGGVPKAGGFGGPGPPNLGARETPPPEK

SEQ ID NO: 32623 - DNA, 592 bp, Zea mays
  misc_feature: Ceres CLONE 1409946-F
  misc_feature: Encodes the peptide sequence at SEQ ID NO. 32624
  misc_feature (320)..(320): n is a, c, t, g, unknown, or other
  misc_feature (400)..(400): n is a, c, t, g, unknown, or other
gctctagaactagtggatcccccgggctgcaggaattcgcacgagaccattacctagaacatcctaatcgaaaaacactcgtccactcccccagtcacccccgcgcccgtctttgctctgcctctccgcgccgcagagcagagcagagcatggcgcccccacgccctctcctcgccgccgtcttcctcgccgcggcggttccgctcctcctttctccggcagaggcggggacggtgggcgtgaactacggccgcgtggcgaacaacctgccgaacccagcggcggttgtgcagctgctgaagcagcagggcgtggcgcangtgaagctgtacgacgccgaccccaccgtgctgcgcgccctcgcaaacaccggcatcagggtgggtggtggcgctgcccnacgagcaggtcgcggcggcggcgtcgcgcgcgtcctacgcgctgctgtgggtgcgccggaacgtggcggcgtaccaccggggcacgcagatccggggcatcggcgggggcaacgagggggtcgcgtcgggcaagaacgggacgggccacctggtcccggcatgggcaacgtgcacgccgggctgggcaagtg

SEQ ID NO: 32624 - protein, 147 aa, Zea mays
  misc_feature: Ceres CLONE 1409946-F
  misc_feature: SWISSPROT Homolog: EC 3.2.1.39 Glucan endo-1,3-beta-D-glucosidase
  misc_feature (57)..(57): Xaa is any aa, unknown, or other
  misc_feature (84)..(84): Xaa is any aa, unknown, or other
MAPPRPLLAAVFLAAAVPLLLSPAEAGTVGVNYGRVANNLPNPAAVVQLLKQQGVAXVKLYDADPTVLRALANTGIRVGGGAAXRAGRGGGVARVLRAAVGAPERGGVPPGHADPGHRRGQRGGRVGQERDGPPGPGMGNVHAGLGK

SEQ ID NO: 32625 - DNA, 694 bp, Zea mays
  misc_feature: Ceres CLONE 1409947-F
  misc_feature: Encodes the peptide sequence at SEQ ID NO. 32626
tggagctccccgcggtggcggccgctctagaactagtggatcccccgggctgcaggaattcgcacgagaccattacctagaacatcctaatcgaaaagccgaagccgcgcgacggaaaccccaaacccaacctcatctcttttctcggcctctaccgccccctcgatcggtcggccggtcagctatgacgccgggaagctcggccgccggatccggcgtcgtcgttcctcggaacttcaggctcctagaagagcttgaacgtggagagaagggcattggagatgggacagtgagctatggaatggatgacgcagatgacatctacatgcgatcatggactggcactattattggccctcataataccgtccatgagggtcgcatctaccagctgaagttgttctgcgacaaggactaccctgagaagccaccatcagttcgatttcattcaagaataaacttaacatgcgctaatcatgaaaactgaagtggttgacccgaaaaagttccgcggttctgggtaactgggaagcggggattacccaaggggaaaaacatcctaaccccttttcaaagaaaggaaaaggaaatccccccacagaaacccgcaagggtatatttccaccccttccgggaaaggggaacttcccttcctaagagatgggggaagagaaacttcagggtgcccacaccg

SEQ ID NO: 32626 - protein, 100 aa, Zea mays
  misc_feature: Ceres CLONE 1409947-F
  misc_feature: SWISSPROT Homolog: EC 6.3.2.19 Ubiquitin--protein ligase
MTPGSSAAGSGVVVPRNFRLLEELERGEKGIGDGTVSYGMDDADDIYMRSWTGTIIGPHNTVHEGRIYQLKLFCDKDYPEKPPSVRFHSRINLTCANHEN

SEQ ID NO: 32627 - DNA, 707 bp, Zea mays
  misc_feature: Ceres CLONE 1409949-F
  misc_feature (373)..(373): n is a, c, t, g, unknown, or other
  misc_feature (374)..(374): n is a, c, t, g, unknown, or other
  misc_feature (467)..(467): n is a, c, t, g, unknown, or other
  misc_feature (475)..(475): n is a, c, t, g, unknown, or other
  misc_feature (486)..(486): n is a, c, t, g, unknown, or other
  misc_feature (500)..(500): n is a, c, t, g, unknown, or other
  misc_feature (501)..(501): n is a, c, t, g, unknown, or other
  misc_feature (580)..(580): n is a, c, t, g, unknown, or other
ggagctccccgcggtggcggccgctctagaactagtggatcccccgggctgcaggaattcgcacgagaccattacctagaacatcctaatcaaaaaaacaatccagttctcctttcgccggaatctgtccctcctccccctcctccccgcctctgcgggtactggaccaccgtggagcgggcattcatccaggctaggtccattccttcctttgctcgtaagtgaccctgatttttgctctacgagtttgtttcgtgctccattgaatctaaatcccactccgcatttgcggattcatgccctactactattacaacccctttcatccatccattcctcgactaggttctcttctccatcgcggaagctccannccgagtgacgccagaagagaaatcgtgccctaagggtgtctcgcagaattattttccagaagatttgcagatcgagtcgaaccctatgccccnacgtaagnctgggcgcggnctgcccccttacanncacggggcgctccctgcccccgggcagggtccagttcccacggaacatgggatgatgccaccgggaggtcggtgatcantacgggccgctggggcccgagatgcacttaacacggttggggcagggccccgttcgttcccttaagaatggtgcctccgtgcccccccggaagtctgggaaaaaagtttggggaaaaacggggaaaa

SEQ ID NO: 32628 - DNA, 652 bp, Zea mays
  misc_feature: Ceres CLONE 1409950-F
  misc_feature: Encodes the peptide sequence at SEQ ID NO. 32629
  misc_feature (652)..(652): n is a, c, t, g, unknown, or other
tggagctccccgcggtggcggccgctctagaactagtggatcccccgggctgcaggaattcgcacgagaccattacctagaacatcctaatcgaaaacgaaaaattcgaaagatccctccaggaaagatttttcttccctcctccgacgccccagcccaccaacacactctataaagcagccctcagtcacacacagaacgcacaagcgcaagccgggcaagaaaactccgtaggccagtctgcgagttggatggccttcttcttggccctcgtgtgcatcctcatcttgctagccatcgcctcctacgtccagtacactcgctggaaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctggcgagcccggaaggcggcgcggttcgtgctggtgacgcaggcgcacctgttcaagccgacctacccgcggagcaaggagcgcatgatcgggccgtcggctctcttcttccaccagggcgactaccacn

SEQ ID NO: 32629 - protein, 133 aa, Zea mays
  misc_feature: Ceres CLONE 1409950-F
  misc_feature: SWISSPROT Homolog: EC 1.14.13.93 (+)-abscisic acid 8'-hydroxylase
MAFFLALVCILILLAIASYVQYTRWKKGKGRFGGHGRSAPLKLPPGSMGWPYLGETLQLYSQDPSFFFASKQKRYGEIFKTHLLGCPCVMLASPEGGAVRAGDAGAPVQADLPAEQGAHDRAVGSLLPPGRLP

SEQ ID NO: 32630 - DNA, 696 bp, Zea mays
  misc_feature: Ceres CLONE 1409951-F
  misc_feature: Encodes the peptide sequence at SEQ ID NO. 32631
aaagctggagctccccgcggtggcggccgctctagaactagtggatcccccgggctgcaggaattcgcacgagaccattacctagaacatcctaaccaaaaaaacgagaaggaagccaccgctccccaatcgcctgcttgccttcccatcctcctcgtagatctccggcaccgggcaccatgagctcctactccggcgaccgctcctcctcctcctccttgcgccccaccaacacctccttcgactcctacaagttcgacttcggcatcaactcctcccgctcctccggctctcgccccctccgcgaccagcggccgggcgcggctaccaaccctccaacgaggcccgccaccggcgccacgtggatgcaccagcccgccagcgccaagccgtcgtggacccaccagccttcccccgccgcggcgtcggcgcccaccatggcggggcctggatccgggccaacctccatggtcggcgacatctttggccggagctggtcctccgccgcgccctcctctgggttcggcatccctcagggcaacaaccccggcctcttcagggatctcctcggctccgcgctcggctcctcccgctcccagttcaacgcgccgctcagatccgccgccgcgccacagggatccaggccagtcggggagaaggccagcgtcaacgctagcacttcccccttcccaaggg

SEQ ID NO: 32631 - protein, 86 aa, Zea mays
  misc_feature: Ceres CLONE 1409951-F
MAGPGSGPTSMVGDIFGRSWSSAAPSSGFGIPQGNNPGLFRDLLGSALGSSRSQFNAPLRSAAAPQGSRPVGEKASVNASTSPFPR

SEQ ID NO: 32632 - DNA, 702 bp, Zea mays
  misc_feature: Ceres CLONE 1409953-F
  misc_feature: Translation starting site: 228
  misc_feature (387)..(387): n is a, c, t, g, unknown, or other
  misc_feature (390)..(390): n is a, c, t, g, unknown, or other
  misc_feature (409)..(409): n is a, c, t, g, unknown, or other
tggagctccccgcggtggcggccgctctagaactagtggatcccccgggctgcaggaattcgcacgagaccattacctaaaacatcctaatcgaaaaagaggctaaacccccgtctaaccctgctgccgtgccgcttgccactactccgcttcgttctccgccgcctccccggacgtccggaaacttctagattgaagggggatagccattggcgtcaacgtgtgtgatggaggtcaggggactggggcagctcctggcggcgctggccgcggcgttcttcgtccgcgccatcgcgggacccggccccgccctccttccgccggcggaggacacggaggccgacgaggccgacgcggaggctggcgagggaggtgggtggtggtgtnccncccgggaccatccggtggnctcgcatcacctgcgcactgaagaacaagcgcgtggaagtggccagggttctgctgtcatgtgtgtcaggtgaggcgaaaccggggaggctgcttgcactaatgaggccatcggcctctgggaaaacatcgttgctcagtgtgctagcagggcagatcgccgcatcggctttcttgcacctttccgggtttctgtatataagtggcccgggctatctcgaagggggggctataaaattgcttttgtcaggcagggatacgtggctttctcacgaatccctggcgcctacaacc

SEQ ID NO: 32633 - DNA, 730 bp, Zea mays
  misc_feature: Ceres CLONE 1409954-F
  misc_feature: Translation starting site: 576
  misc_feature (535)..(535): n is a, c, t, g, unknown, or other
  misc_feature (556)..(556): n is a, c, t, g, unknown, or other
  misc_feature (570)..(570): n is a, c, t, g, unknown, or other
  misc_feature (611)..(611): n is a, c, t, g, unknown, or other
  misc_feature (655)..(655): n is a, c, t, g, unknown, or other
aagctggagctccccgcggtggcggccgctctagaactagtggatcccccgggctgcaggaattcgcacgagaccattacctagaacatcctaatcgaaaactgttttgttctccttctcattcgactctgatgatgacgagacggttatcgttccccttctggttcggtggagatcgccgccgttggcgtttcgatcgccatatttaaccaagtctccgaggtctgcatctaccctctcgttagcgtcacaacgtcgttcgtcgcggaggaagacgcgatcatcagtaaggccgtccgaggaaacagcagccagtgaggaggacgtggagaaagcctcccacgtgggctttgatccggagaccagcaatctgcatgcatctggccctgcaggtatggcagaatgcgtgaactcgtgatcccctacggagtgcgcagcagatccctctggcaggcaagggcggggcgagaagagggtacgtgccgtcggtcacgtcgggcttaatagtcggttccattctcggcctgcttcaggncgtcttcctggtcctttcggncagattcgtgtcancaatcatggggtggttaagtccggatccccgatgcaagggncctgcggtgcgctacctaacgataaggtcccttgggtgccccgnctgtgctgctgtctctgcccatggcagggggttttttccggggggttcaaggacaccaagacaccgttataccgt

SEQ ID NO: 32634 - DNA, 680 bp, Zea mays
  misc_feature: Ceres CLONE 1409957-F
  misc_feature: Encodes the peptide sequence at SEQ ID NO. 32635
aagctggagctccccgcggtggcggccgctctataactagtggatcccccgggctgcaggaattcgcacgagaccattacctagaacatcctaatcgaaaaaccaccagtgattttgcggacgacggtctatggttcccaaatcaccgaccgatcgacgacgtcatccttctccccggcaacataaggagacatatcaagttggttggtgataatggatccaaagcattcggctgaagtgtccaagcatttacacaagcaaaatcgagcactaatggaaacatatggagcaatgtcccatgagttgcataaactgcagggagaagaagagacaatcatgcgcaagttgtatgaactgatgtccgcggaaggacttcttccaaagcgcaagagagaaaagcagcatggggaaaatatagtggcttcaactgagagcaaagaacaggaaccataaattcttatgcgacgtgtaatgcgatatgacagcaatgccattttatctggagagctggtgcttgttaacttctgtatagcagttctctatcatcacaactctgcgaccactacatttaacttcacagctgaaaattgtacctgagtatgagttccgtgaggcattaaaaaaaaaaaaagaacagcttatcgataccgtcgacctcgaggggggggccggtacccaat

SEQ ID NO: 32635 - protein, 79 aa, Zea mays
  misc_feature: Ceres CLONE 1409957-F
MDPKHSAEVSKHLHKQNRALMETYGAMSHELHKLQGEEETIMRKLYELMSAEGLLPKRKREKQHGENIVASTESKEQEP

SEQ ID NO: 32636 - DNA, 635 bp, Zea mays
  misc_feature: Ceres CLONE 1409960-F
  misc_feature: Encodes the peptide sequence at SEQ ID NO. 32637
tccccgcggtggcggccgctctagaactagtggatcccccgggctgcaggaattcgcacgagaccattacctagaacatcctaatcgaaaaattacggctgaagggagtcgctcgccgccgcgttcgaggcgttccctcgtcgcgctcgcgccgtcgaccttcaccgctcgctgtcaggtctgcccgccacgacctcgccggccacactcgcagctcgccctcgctcctacgcctcgccggcgaggccttctgccttttcgcgccctctatctgctgcgatctttggagcatcgttctcttctctcacttgagatccagacccctaaaccctagagctcgccgcttccgctcgctcgctccgcgctggcggcgacaatggaggacgaggagatggagaagaaggtgcagcagtacttgcagcgcaagggtttccgcctcactgagcttgcgctccaggaggagtgcaaccgcctctccacctccgccatctccgacgttgcgcttgcacggtctgacaatgatccagcgagatactacgatggatatagcagattaagaacatgggcatacagttctcttgatcaatataagcacgaattacttcgcgtcctttatccagttttcatccatagct

SEQ ID NO: 32637 - protein, 86 aa, Zea mays
  misc_feature: Ceres CLONE 1409960-F
MEDEEMEKKVQQYLQRKGFRLTELALQEECNRLSTSAISDVALARSDNDPARYYDGYSRLRTWAYSSLDQYKHELLRVLYPVFIHS

SEQ ID NO: 32638 - DNA, 667 bp, Zea mays
  misc_feature: Ceres CLONE 1409963-F
  misc_feature: Translation starting site: 217
  misc_feature: SWISSPROT Homolog: EC 1.4.1.2 Glutamate dehydrogenase
aaagctggagctccccgcggtggcggccgctctagaactagtggatcccccgggctgcaggaattcgcacgagaccattacctagaacatcctaatcgaaaaatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgatccgtcagtgcagagtgacatgaagctatggccgttcaaggtcatcccagggcctggtgacaagcccatgattgtagtgaactacaagggcgaggagaagcagtttgctgctgaggagatctcctccatggtcctcatcaagatgaaggagattgctgaagcctaccttggttccccatcaagaacgcagtggtgacagtgccggc

SEQ ID NO: 32639 - DNA, 719 bp, Zea mays
  misc_feature: Ceres CLONE 1409964-F
  misc_feature: Encodes the peptide sequence at SEQ ID NO. 32640
  misc_feature (418)..(418): n is a, c, t, g, unknown, or other
  misc_feature (690)..(690): n is a, c, t, g, unknown, or other
ggagctccccgcggtggcggccgctctagaactagtggatcccccgggctgcaggaattcgcacgagaccattacctagaacatcctaatcgaaaaaaagcgttctgggggcccccgcgtcgcctccgcctgggcgacacgggcggcgccccgctccccttgccgccgtcgcccgcaaatcctctctccctttcccttgccgccgccggaggggtctgccggaggccggctcggcccctaggatggcgacggcggggtgtttcgcgcggatctggtgggagttagcgcagctcatcggcggtggagcgcgcgcagcacggtacctatgggtggccgtggccgtgctggggcgcgccgtggcacgcgccgcggagctcgccgggcggcggctgaggcccaggcggacaggcgtggcggngcgtccccgtgaggacgtcgtggactgcctccgcgcctcgctcgaggatctgctccggtcgccgctgtcgtgcgctgtctggtggcggcttgggcgacgccgagctgtgcttctgcgaggcgagtgccgacgacgtgtgcgtcagcgagcagatctgtgcggtggtcggcgcacggcggcatgggcgactcagcgtacccggtgcgctggctgccgcgaggagaccacctaggtgtggtgactgcggagaactcttggcagtgcggccgcanctgctgctgctgctccggcttaagtgtgg

SEQ ID NO: 32640 - protein, 94 aa, Zea mays
  misc_feature: Ceres CLONE 1409964-F
GAPRGGGRSRTSGSPGLQEFARDHYLEHPNRKKAFWGPPRRLRLGDTGGAPLPLPPSPANPLSLSLAAAGGVCRRPARPLGWRRRGVSRGSGGS

SEQ ID NO: 32641 - DNA, 711 bp, Zea mays
  misc_feature: Ceres CLONE 1409967-F
  misc_feature (497)..(497): n is a, c, t, g, unknown, or other
  misc_feature (498)..(498): n is a, c, t, g, unknown, or other
  misc_feature (569)..(569): n is a, c, t, g, unknown, or other
  misc_feature (672)..(672): n is a, c, t, g, unknown, or other
ggagctccccgcggtggcggccgctctagaactagtggatcccccgggctgcaggaattcgcacgagaccattacctagaacatcctaatcgaaaagcgaccgcgactcggatcggatctctctcctgtgtagagccatgctgtgctgtgctggtagtagcagcagcagtagcaatgagtagtccagtccacagctccaagaacacgtggccgtcctttccttgcctctccctatcggtattcggtaacgcagggggagggcgccaccggctttaaccatggcctgtcgcttttgcctcgtctggtcggctggtccctctgctctatcccatcccccttgagcaggctgttgagcaagctgaactcatacgaacctcgatttcttccgtccggcgtttttttttctctcagtttctgaggtatttctccccctttctttcttccctccctcccagtagattcttcactgggctcgggatttggaacaaaggccgtgnntcgaagctgggtgtggtcgtttcattgtgcggaaagaaggccagtgttatgtgtgaagtagtgaaggctancaggtaggctgctctcgctcgccgaggatggatctccaagtcggaagggggctggagtcccaagagaaaactcgtggagaacacttggtgctggtacaaaaanccgtggggtgggctacgggactcagaatctccccgtgga

SEQ ID NO: 32642 - DNA, 764 bp, Zea mays
  misc_feature: Ceres CLONE 1409969-F
aaagctggagctccccgcggtggcggccgctctagaactagtggatcccccgggctgcaggaattcgcacgagaccattacctagaacatcctaatcgaaaactctcttcttccaccaccacctcctactccgctgcaaccccaaatctctccttcctcgcatacgcgcgcagcggaggagctgagaccaacgaagaagaagaagaacaaccgagcaagcacaagcttagctagcgtgtaggtgtccaaggcgacgacggccgccgcgccagggtagccaaccagctgctcatcgctcctagctgcggagccgatatgcctggcgccgacgcccagcccgggctgcacgccctgtcctgcctggcgggggagcgcgcgaccgctcccagcgcgccgcggaagcggctggcaccactctcaccagcctcccggtccgcccgctgcccaacgacgggaaatccatgacatccggggccgcgcggcaggacgccggaatcccgaagtcgggcgagcgccccgctgcaggcccagtcaactccgcgccgcacaacccccgcgatgatgaaacccacacgaccgcccccggccccgggcgaacacgactaccgccacaaccaaaggctaccccgcctaaatgcatgcggcattctagtgttctcgccgcccgcaggcgcccacggacgcggctatagtagcgggctggagcccgggctcggcgccccaacggcgcctacgcaccgagccagcaccgcccctcccgaccg

SEQ ID NO: 32643 - DNA, 643 bp, Zea mays
  misc_feature: Ceres CLONE 1409971-F
  misc_feature: Translation starting site: 166
tccccgcggtggcggccgctctagaactagtggatcccccgggctgcaggaattcgcacgagaccattacctagaacatcctaatcgaaaaagtaccgcaccaccttccagctatcgtacccggagccggagctagaggaggcggagaggtggagggcttaggagatgaggaggacgacgaccgaccgtgggtccggctccgggagggcatcccgagggcgtacacatgagacgaggagcagcagctcaacgaggcggtcggctccgggccacgccatgacggacaaggagtcgcaggccgccgggttctgcgccgaggcgactatcgacgagttctagtccctctggtgcgacgccgccgacgtggagtgcgacacgctgcgtcggatcctggagacaacgcctgcgacgagtacctccgctgacgaggactctcgatccgcttggacgccttgtgcttcttcggctgcgtgacgctcttcatgcacgcctacgtgaagccctacattgcgtggatctgcgacgttaacacgtgccacgagctcaccgactagccgatcacctcattctctctcagctccgaaaccatataatggtaagcgcagggacctgccccttggacctgtggctcgtatagtccacg

SEQ ID NO: 32644 - DNA, 662 bp, Zea mays
  misc_feature: Ceres CLONE 1409972-F
  misc_feature: Encodes the peptide sequence at SEQ ID NO. 32645
tggagctccccgcggtggcggccgctctagaactagtggatcccccgggctgcaggaattcgcacgagaccattacctagaacatcctaatcgaaaaaaagaaaacccaacgcaaaagcaacaaacaactcccaaggtccaaagcccacccgtactcatccgcgatccccaaccatggccgtcggcgacgtggagacggaggcgccgctgctgcccccgccggcctctgccctggcggacgagccctccgcgggcccgcccccagacgaccggctcggcatcggctacctcatcttcttcaccctgggcgccggcttcctgctcccctggaacgccttcatcaccgccgtcgactacttcgacttcctctagcccggggcccccgtcgaccgcgtgttctccatatcctacatggtctccgacttactgcccctgctcgtcatcgtgctcttcttacccagtacagcgcccccatgcgcatcaacacggggctcactctcatcacgctcacgctcgtgctcgtgcccgcaatggacctcatctacgtcaaggggaggggcggcctgtacgaaacgttccatgtgactgtcacgacactgattttgtgcgggtcgccgactgctcgggaagggaggcgtatccggctacagtggggagctgcc

SEQ ID NO: 32645 - protein, 65 aa, Zea mays
  misc_feature: Ceres CLONE 1409972-F
MAVGDVETEAPLLPPPASALADEPSAGPPPDDRLGIGYLIFFTLGAGFLLPWNAFITAVDYFDFL

SEQ ID NO: 32646 - DNA, 660 bp, Zea mays
  misc_feature: Ceres CLONE 1409976-F
  misc_feature: Encodes the peptide sequence at SEQ ID NO. 32647
  misc_feature (643)..(643): n is a, c, t, g, unknown, or other
tggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgccccgggagatggcagcggaggttgccgccgctgcggcgctcggtgccgacgtggcggagctccaggtcggctgcctcgacagcttcgagccatgcagggacctgcccgtgcttctcgcccagccccgctcgctccccgtcatcgtcacctacaggccgatttgggagggaggccagtacgcangcgaagatgagccacgg

SEQ ID NO: 32647 - protein, 92 aa, Zea mays
  misc_feature: Ceres CLONE 1409976-F
  misc_feature (87)..(87): Xaa is any aa, unknown, or other
MATAASSTPAARQPTLVCASLTARVPREMAAEVAAAAALGADVAELQVGCLDSFEPCRDLPVLLAQPRSLPVIVTYRPIWEGGQYAXEDEPR

SEQ ID NO: 32648 - DNA, 719 bp, Zea mays
  misc_feature: Ceres CLONE 1409978-F
  misc_feature: Encodes the peptide sequence at SEQ ID NO. 32649
  misc_feature (719)..(719): n is a, c, t, g, unknown, or other
aaagctggagctcaccgcggtggcggccgctctagaactagtggatcccccgggctgcaggaattcgcacgagaccattacctagaacatcctaatcgaaaaatatttcagccgtcgctcgcggagccgtgactaatcaagactcacgtcctcacggaccatggatatggcctcgccgccatggtctctacttgagacttccctcctcatcatcctattctactactagcctcaagccgaggtggagtttacgccgtctctgggcgacagccacgtgggcgacgcccgcgagccgggtttcacgtacttagctgccagggttgcgatgccttatcgacgatcgccccgagctcgacttccaggagcaccgcaccaccgaggctcgtcaggtcgaagttcgacctcatggaggtgccctaccaggtggccgtcgcggcaaacggcgatcgtgccgaccactcgccggtagcaatgatggccccgttggcgccactcagaagcgacatggacgccgtacccatggaggaattggggagacttggaacaccaacacccaggacttgtgtaaaagaggtaggctttgggaacttggatgcctcacaacccggatgctttttttgggggagggtaaaattggcttcaatgcccaggaaagaaaaattttcaaccggcacccggggaaatatttggtttttcccggcccgcgggaaaatataccn

SEQ ID NO: 32649 - protein, 104 aa, Zea mays
  misc_feature: Ceres CLONE 1409978-F
MEVPYQVAVAANGDRADHSPVAMMAPLAPLRSDMDAVPMEELGRLGTPTPRTCVKEVGFGNLDASQPGCFFWGRVKLASMPRKEKFSTGTRGNIWFFPARGKIY

SEQ ID NO: 32650 - DNA, 785 bp, Zea mays
  misc_feature: Ceres CLONE 1409980-F
  misc_feature: Encodes the peptide sequence at SEQ ID NO. 32651
  misc_feature (1)..(1): n is a, c, t, g, unknown, or other
  misc_feature (15)..(15): n is a, c, t, g, unknown, or other
  misc_feature (41)..(41): n is a, c, t, g, unknown, or other
  misc_feature (46)..(46): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (785)..(785): n is a, c, t, g, unknown, or other
ngggggggtgggggntgtgcggggagagtggtggttgtgtnggttnattaaaannnnnncccaaagctgggactccccgcggtggcggccgctctagaactagtggatcccccgggctgcaggaattcgcacgagaccattacctagaacatcctaaaaaaaaaaagagctgagccgggacggagcagctagcgctagggataacgcacacccaccaccatggcgacgcccggagagcagccggcggaggtcgtgtccgacgagatgcccgcacccgacgggcggaccaagaagcttactcccttgacaggcgggagatctgagattggttttgctccaccaactggcgaggacattaagaaacagaggcaacttagtcaggacctagaggaacaccctggaaggccccgctgtttcagagtttgaatggggcaactggagaataccccaagggggtcctgttcggattagcgaggaagccccccgctatttcgatcgtcccaagaggtagaagaagaatcccgaaaagcgcaagcgggaacccccggcggccaagcacggggcggggcccagggccaaaaaagggcaacccccttgaagaccggaaaaaagcccaaaaaatggccggaaaccggggcaagagagcccacaagggaggcccccccaggggaaaaagtgccccaaaaagagggacgggggggtggcgaaaaaaaaaagccccggcttggcaaacggctcaacatcgcgcccccccgggccggaaacccgaaaaaacggcgcccaan

SEQ ID NO: 32651 - protein, 68 aa, Zea mays
  misc_feature: Ceres CLONE 1409980-F
MATPGEQPAEVVSDEMPAPDGRTKKLTPLTGGRSEIGFAPPTGEDIKKQRQLSQDLEEHPGRPRCFRV

SEQ ID NO: 32652 - DNA, 723 bp, Zea mays
  misc_feature: Ceres CLONE 1409981-F
  misc_feature: Encodes the peptide sequence at SEQ ID NO. 32653
  misc_feature (276)..(276): n is a, c, t, g, unknown, or other
  misc_feature (546)..(546): n is a, c, t, g, unknown, or other
  misc_feature (547)..(547): n is a, c, t, g, unknown, or other
  misc_feature (553)..(553): n is a, c, t, g, unknown, or other
  misc_feature (560)..(560): n is a, c, t, g, unknown, or other
  misc_feature (561)..(561): n is a, c, t, g, unknown, or other
aaagctggagctccccgcggtggcggccgctctagaactagtggatcccccgggctgcaggaattcgcacgagaccattacctagaacatcctaatcaaaaattccacctgtacggctgtaccccaccgtcaccacccacggaacgctgcgcgcccaagtaaaccagggagcgcggacgaccgaccagccggacctgcgcaatcgaaaccgatcgactcccctattattggaccccatccccatgggagcggagggtgagcgcgatcgccgccgcncgaggaggtcatctgcaggaaacgatcctcccgcaggcgctataatgagcgtcgctaataaatatgagggggtcgtcaatgtgctaaacagtttagaggagcccctgctgatcacttgggatgggattcaacagctcaagaattgctgggaggatggtgttctgggtaccatctgtcccataccgccaggttggaactggacctacaacttccaggttcaggatcagattgtcagcttcttctacttcccaccccttgatatgagcgtgnncgcggngggggcnntcggaggtatcactgtgatccaccgcgcggttcatctcgggtccattcgatacgcctcgatgaggacatcaagctccttcatcgaagaactgaccacaagatgaaccacatcgcacctgtaggaagatgctcgacgacgggcatgcaactggtgaatgccaa

SEQ ID NO: 32653 - protein, 140 aa, Zea mays
  misc_feature: Ceres CLONE 1409981-F
  misc_feature (14)..(117): Pfam Name: Cu-oxidase_3 Pfam Description: Multicopper oxidase
  misc_feature: SWISSPROT Homolog: EC 1.10.3.2 Laccase
  misc_feature (12)..(12): Xaa is any aa, unknown, or other
  misc_feature (102)..(102): Xaa is any aa, unknown, or other
  misc_feature (104)..(104): Xaa is any aa, unknown, or other
  misc_feature (107)..(107): Xaa is any aa, unknown, or other
MGAEGERDRRRXRRSSAGNDPPAGAIMSVANKYEGVVNVLNSLEEPLLITWDGIQQLKNCWEDGVLGTICPIPPGWNWTYNFQVQDQIVSFFYFPPLDMSVXAXGAXGGITVIHRAVHLGSIRYASMRTSSSFIEELTTR

SEQ ID NO: 32654 - DNA, 865 bp, Zea mays
  misc_feature: Ceres CLONE 1409981-R
ttgggtaccgggccccccctcgaggtcgacggtatcgataagcttttttttttttttttttataaaaaacagcattaccagtgtacgactgtacaacgctcatttacaaggacaattacggttcacaatttatacacacacatcatacaaaatcgctatcatacacaggcgttgaggtgtacacgcgcaacgctcccgtgccaacagccaggctcacgcgaaaaaaagcccttccacgatgaccgaaaaacaaagcacatccaaatccatccccaaaaagggcaaccgcgacatgcgaaacctctcaaaaacgaccatccggacgttggacacaggccacctctcttcttttcatcgccgtcttcttcacgagaagccgatggtcttaccgagcagccacaggaacagagtccactcgagcataaatatcgtgtgcaggtacgaacggtccagcgtgaaaccgaacacggtgatcccggctctgttgttttccaagtatgtcactagtgcctgtctcttctggaaggagatgacatgcgcgtgcggcatatgaatcttggtgttctccaggagatcttcgtcgccggtctcctcgctgtcctctgtgtcactgtcactctcgggttcttggtcgatcatggagttctggttggaccagggctccccttcctccagcacgggcttgatggtgcaccaggcatgccacttggtgggagtgaccggagaggggctggcgcctgggtgggtgaatcttggaaaaccctggctcagggataatgaaggaccccggaaattgaagcacaaacgtgaacaaaaaaccaaagtctccccgggggtgttgaagaaagaccctcccacaaggagt

SEQ ID NO: 32655 - DNA, 672 bp, Zea mays
  misc_feature: Ceres CLONE 1409982-F
  misc_feature: Encodes the peptide sequence at SEQ ID NO. 32656
aagctggagctccccgcggtggcggccgctctagaactagtggatcccccgggctgcaggaattcgcacgagaccattacctagaacatcctaatcaaaaaataatggcaaatttctcgtccccagcaaagtccctccattcggtctcatctcccatctctcttctctctctcccgcgacatcagcggcggcagcggtggggtggggggacggcattgcgagctcacagtctcacaccacccgccgcgtggtgattccgagaggttgctgtgccgctggctatgtagtgatgtggaccgtgatctcgacggctatccgcggctgagcgggcggcggcgatgaacgaagcgagcgccagcgctggcgtcgggaccggctctggcggggaggtgccgctggtatacaaggcctggaaggggaacaatgtgtttttactgaaggggagattcatatttggtcctgatgcaagatccttgtttgtcaccatgttccttattgttgcgccagtatcaatcttctgtccattagttgcgaaggaattgatggataaattctcttatggtctgggattaccggttatgattgcagcaggtctattcacagcatatgatctgagtcttctgcttctaacttctgggagagatccggggatcatacccccggtggtaagat

SEQ ID NO: 32656 - protein, 111 aa, Zea mays
  misc_feature: Ceres CLONE 1409982-F
MNEASASAGVGTGSGGEVPLVYKAWKGNNVFLLKGRFIFGPDARSLFVTMFLIVAPVSIFCPLVAKELMDKFSYGLGLPVMIAAGLFTAYDLSLLLLTSGRDPGIIPPVVR

SEQ ID NO: 32657 - DNA, 772 bp, Zea mays
  misc_feature: Ceres CLONE 1409983-F
  misc_feature (481)..(481): n is a, c, t, g, unknown, or other
  misc_feature (508)..(508): n is a, c, t, g, unknown, or other
  misc_feature (690)..(690): n is a, c, t, g, unknown, or other
  misc_feature (769)..(769): n is a, c, t, g, unknown, or other
  misc_feature (772)..(772): n is a, c, t, g, unknown, or other
ccgagctggagctcaccgcggtggcggccgctcttacaactagtggatcccccgggctgcaggaattcgcacgagaccattacctagaacatcctaatcgaaaaatcggatccatggtctcttttctcagccctctcagtctcacacaccacaccagagcagcgcagccgagcatgcactcatcacatcagctcctcgtctcctagctttcctattcctgccttgataattggccaattgttcgatctccttctttaccaccccctttgctttcgctgttgctactactactgttccaccccctaagtttctttgttgtccctgcccgccccccctgaccgacccggatccccccctgattttcatttctctgatctccaaaatcccgttttcttgtataccaacgcgcccgtgtagaacaccccccgtgccccttggggtgtacacgaacttaaccgcccccccagccgcatttccgtcncctgcatctcccggaccgcggccttancgtatactcatcacttaatttcccttcctccccttcccatgaggacccaccccggctaacccccgcgccgtaccccccccgccttcatccaactttacccgttgtcctttttgtgcccccccgcgcgcctttgacaagcggccgcccttatataccgcttttggatcctacaacaaactaangtaaaggagtggcacgcaatacccgcggtgtcgtcgcggactgtgcccgacgccaagagccccatatcctacgctcacntcn

SEQ ID NO: 32658 - DNA, 726 bp, Zea mays
  misc_feature: Ceres CLONE 1409985-F
  misc_feature (565)..(565): n is a, c, t, g, unknown, or other
  misc_feature (726)..(726): n is a, c, t, g, unknown, or other
tggagctccccgcggtggcggccgctctagaactagtggatcccccgggctgcaggaattcgcacgagaccattacctagaacatcctaatcgaaaaataattctagtattccaccgccgcgacacctcctgtcttccttcaccttcgtgctccgccggcgccgtcgattcgagctgctctcacccctaacctgtccaacatcgccggcgagggaagcactagaacaagctccccttacctcctgctatcacctgacgataaagtggggtctgtagggaagtcttaggcagaagcacaagggataagatatgcagagatgaatcaatcaatttcttcggccgacttcgcccctgcttacgtccccgctactaaccctaggagcattctgactgttctcgcttcttatcagactcttcttcgttttagtgcctatcacttctgagctggcacgacttcagaagcttctctactagattagcgcaaatattacacttggtcgagtttagcttgcctagaatatgaggctctggctcgtgcttatatctgctagcaataatggctgcnatgaactgaagagcattgactgaatggtgcaggaacataataatctcatgagaatgcgcgaccaccccactgcatatgctgctggcgtattctgaacctctgaatgcatcagcatactgaaaatgattctgctgctaggatcatcttgataataccgtagn

SEQ ID NO: 32659 - DNA, 680 bp, Zea mays
  misc_feature: Ceres CLONE 1409986-F
  misc_feature: Encodes the peptide sequence at SEQ ID NO. 32660
  misc_feature (680)..(680): n is a, c, t, g, unknown, or other
tcaccgcggtggcggccgctctagaactagtggatcccccgggctgcaggaattcgcacgagaccattacctagaacatcctaatcgaaaagattgattcacaagacgtcgatcccaaaccctaaccctttcaacggttccactccaccaccaacctcatgtgtcggcgcccgccgccgcacccaacccctccctcctccgtctgctcccggtcctcgcgtagccgcaacctccctcgttgccccacactacccacgtccctagcgtcatgcagatcaaaaccaaggggcaggcggcgacagtggttcagagtccgccgctgacggccctgcgaggaacgggtagattcgcttggtgtccgggcggctccgcgtcgccgaatccgatagcattgtggatctggaggtaggaaaagggcttggtggtagacgtggaggacgatggcgttcatggtcctagaagtaagcgcgatggtctcctcaggcatcggcttcgtggacggctggttctttccatcatagatcaaaagaagactcgagtcataaaaaagttcatcattgttgcttgaatcccaccaaaatggcccgctggattcttcctcatttcgttggaaacatgccctaagatctgtgaaaaagggtttggtttcccttccccttcgccttgaaatccccacaaan

SEQ ID NO: 32660 - protein, 54 aa, Zea mays; identical to SEQ ID NO: 24650
  misc_feature: Ceres CLONE 1409986-F

SEQ ID NO: 32661 - DNA, 676 bp, Zea mays
  misc_feature: Ceres CLONE 1409987-F
  misc_feature: Translation starting site: 390
  misc_feature (620)..(620): n is a, c, t, g, unknown, or other
aaagctggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgccccgggagatggcagcggaggttgccgccgctgcggcgctcgggtgccgacgtggcggagctccaggtcggctgcctcgacagcttcgagccatgcagggaacctgcccgtgcttctcgcccagccccgctcgctccccgtcatcgcactcaggnccccaaaattgtgggagggaggccagtacgcaggcgaagatgagccacggtttgag

SEQ ID NO: 32662 - DNA, 660 bp, Zea mays
  misc_feature: Ceres CLONE 1409991-F
  misc_feature: Encodes the peptide sequence at SEQ ID NO. 32663
gctctagaactagtggatcccccgggctgcaggaattcgcacgagaccattacctagaacatcctaatcgaaaaatgggccaccgacaagtcttcttcctcgccgcctcccgctccgttccggttcgtctctctcctcgcctcgggaacggtttcgatttcccgtatcgccgacgtcaggatggtcctacaacgtacgatcacgaacgctatccgatcgtgaacctcgtcaatgggtaaccctcccctgagtatgacgcgtacgaagacctcgatgacaacctcgtctgtgaaggaatattgaacccgcgaccgctctaccgtacccccgtcctcgaccagcacagcgctacaggggcctccaccgagacccgaaagcgccttctcaacaaggccgagggcggatgcatgatctgcgatgacccggtgtatgactgttggattgaaggacgaggacacgaacccttcggctgaggccagcaacacgaaggactcgtcgtcgatgaggtacctcattaggactgggacaagcaccaacaagaacggtaagataatgacagggggaggacgacgtgaagttcgatgtacaatcgtgatggtgacgtgatagatccaaatcaggatttcagctactctacgcgtgacggatgacatcggatgc

SEQ ID NO: 32663 - protein, 62 aa, Zea mays
  misc_feature: Ceres CLONE 1409991-F
MTRCMTVGLKDEDTNPSAEASNTKDSSSMRYLIRTGTSTNKNGKIMTGGGRREVRCTIVMVT

SEQ ID NO: 32664 - DNA, 764 bp, Zea mays
  misc_feature: Ceres CLONE 1409997-F
  misc_feature: Encodes the peptide sequence at SEQ ID NO. 32665
  misc_feature (510)..(510): n is a, c, t, g, unknown, or other
  misc_feature (595)..(595): n is a, c, t, g, unknown, or other
  misc_feature (635)..(635): n is a, c, t, g, unknown, or other
aagctggagctcaccgcggtggcggccgctctagactagtggatcccccgggctgcaggaattcgcacgagaccattacctagaacatcctaatcgaaaactccgtgctttctcagaggtgggttggcttctcctcccccaccggttcgtgttcaggttctggttcgtgggcgagagggaagagatggtggtgtcggacgttgagtaccgtcgcttcgctggcggcctcgcctgggccattgacgaccactccctcaacaacgccttcagcacctacggcgaggccctcgagtcgaagagcatcctggatcgggaaacgttcagggcccgcggtaacgggctgggcattttccccacgttaggacgctatgggcgagcggcgtgaaggggaccaacggccaggagttttggggggcccaaatttgccggtaacgttcccccacttccgcgatagcgcgagaagatccccacgtccggaagggaagggcgttctaatccgcctacagtganttcgcccaggtggactcggcaacatgaccgcggcagccgcgccggaaaatttcgccgcgagtaccgcccgccgccggacacacgnggttggtcgatttttaaattacaccgcctacaacggtatngtctgttagaggaaaacgccatgagcgggctgcggagccgcggggggcgtaaaagattgatgaggagctaatcacacatcccccaatccccacatacccccgcataaatcgcggcgcccgactcgagca

SEQ ID NO: 32665 - protein, 66 aa, Zea mays
  misc_feature: Ceres CLONE 1409997-F
MVVSDVEYRRFAGGLAWAIDDHSLNNAFSTYGEALESKSILDRETFRARGNGLGIFPTLGRYGRAA

SEQ ID NO: 32666 - DNA, 686 bp, Zea mays
  misc_feature: Ceres CLONE 1410003-F
  misc_feature: Encodes the peptide sequence at SEQ ID NO. 32667
ggagctccccgcggtggcggccgctctagaactagtggatcccccgggctgcaggaattcgcacgaaacattaactaaaacattccaatcaaaaaaaacacggctcgctaccccaccatgtgctgaagctagcccggaaaccaaccagaacaggccatgcccatgcactccccgatgccctctcaagccgttgaagactctggaccacatcgggtcgaacaacatcctggccatcgcgtccgcgccgcttgccaccgcgggcctgttcaaggtgacccccttcgggcccgaggatatcctggcgctccggccggcgcacctgttcctgggcgcgatcctgcctgccgcgaccacggtgctgcacctgatgctccggccgatcacggtgtacctagttggactacgctgtgcttccgcaccagccacaactgccgagtcgcgatcgcgacgttcctgcagcactcacgtgtgtgcgcggtcttcgacgagcgctatgctcaagttcatgacgcgcctgctgcagcggtcggggctacgatacttagacacgcctgccgtacgcacagcaatacatcgccgtcttgcgcttacctgaagtcatggcgcatcaagatatagctcgacatcttatcggtcatcgattacctgcttatctagacgagttcctgcacgtgaccctctacctg

SEQ ID NO: 32667 - protein, 197 aa, Zea mays
  misc_feature: Ceres CLONE 1410003-F
ELPAVAAALELVDPPGCRNSHETLTKTFQSKKTRLATPPCAEASPETNQNRPCPCTPRCPLKPLKTLDHIGSNNILAIASAPLATAGLFKVTPFGPEDILALRPAHLFLGAILPAATTVLHLMLRPITVYLVGLRCASAPATTAESRSRRSCSTHVCARSSTSAMLKFMTRLLQRSGLRYLDTPAVRTAIHRRLALT

SEQ ID NO: 32668 - DNA, 678 bp, Zea mays
  misc_feature: Ceres CLONE 1410005-F
  misc_feature: Encodes the peptide sequence at SEQ ID NO. 32669
  misc_feature (603)..(603): n is a, c, t, g, unknown, or other
tggagctccccgcggtggcggccgctctagaactagtggatcccccgggctgcaggaattcgcacgagaccattacctagaacatcctaatcgaaaaacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacattcccttggcatgaaggtcctcgtcctcgacccccaaaccgttgggatggtgagcgtggtgtacagccagtcggatctgctgcggaaggaggtcttcctcgtcgagaccattggacaacgcctccagctccagggagtccattggcgcacctcaaggccgtctactttcctccgaccctccgcttacaacgtccagaagcttccgcaggcacctcgccatgccgcgctttcgccgagtaccacctattcttctccagtatatttgaaggtcccgcagattcaaatacttgcttgactcggatggaacaggaggttgtgcangcaagttcaggagttctattgctgattttttgtgcctttgacccataccattttcacttctcaacatacaaaata

SEQ ID NO: 32669 - protein, 94 aa, Zea mays
  misc_feature: Ceres CLONE 1410005-F
MKVLVLDPQTVGMVSVVYSQSDLLRKEVFLVETIGQRLQLQGVHWRTSRPSTFLRPSAYNVQKLPQAPRHAALSPSTTYSSPVYLKVPQIQILA

SEQ ID NO: 32670 - DNA, 731 bp, Zea mays
  misc_feature: Ceres CLONE 1410006-F
  misc_feature: Encodes the peptide sequence at SEQ ID NO. 32671
  misc_feature (399)..(399): n is a, c, t, g, unknown, or other
  misc_feature (406)..(406): n is a, c, t, g, unknown, or other
  misc_feature (409)..(409): n is a, c, t, g, unknown, or other
  misc_feature (448)..(448): n is a, c, t, g, unknown, or other
aaagctggagctccccgcggtggcggccgctctagaactagtggatcccccgggctgcaggaattcgcacgagaccattacctagaacatcctaatcgaaaaatctttttcctcgtgtcactcccctgctgctgctgctgccgggaagatcaaatcccgtcaaaaggctccaaaggatcagagttctgtcaagatggcatgcccaagaggaaggacaccatttcccctttgtttctttctgatgatttgcctcatggctcagctgggagcttccaatgttgtactcatggcgaacaacactaccttgtcgttggatgatgtcgaggcaacttttagtgggtgttacacattattacactatctccatgtatctctgtacatgtcaattaaaaatctggntagctgntgnttttatcaaacacaaagtaggttgcatggcattatatangaaagatgaaaacagtataaggaaccgggtcattaaacccactcttcaggacattggtagttacccggttgaaggaatgaactggttttcttaaaaccacagtggccctggttttagggatattgaaaggccgggcttcctctttttttggccgggaaagaaaaagcccccccccggttcttcctaaaaaagggccccctttcttggattttaaacccccaaaaggggaaagggtcctttggggcccgacaccccctttcggtgttaggcgggtttttccccc

SEQ ID NO: 32671 - protein, 87 aa, Zea mays
  misc_feature: Ceres CLONE 1410006-F
  misc_feature (69)..(69): Xaa is any aa, unknown, or other
  misc_feature (71)..(71): Xaa is any aa, unknown, or other
  misc_feature (72)..(72): Xaa is any aa, unknown, or other
  misc_feature (85)..(85): Xaa is any aa, unknown, or other
MACPRGRTPFPLCFFLMICLMAQLGASNVVLMANNTTLSLDDVEATFSGCYTLLHYLHVSLYMSIKNLXSXXFYQTQSRLHGIIXER

SEQ ID NO: 32672 - DNA, 704 bp, Zea mays
  misc_feature: Ceres CLONE 1410008-F
  misc_feature: Encodes the peptide sequence at SEQ ID NO. 32673
  misc_feature (566)..(566): n is a, c, t, g, unknown, or other
caaagctggagctccccgcggtggcggccgctctagaactagtggatcccccgggctgcaggaattcgcacgagaccattacctagaacatcctaatcgaaaaaggtttgccccttttccttgcccttcttccgcattctgatgtcctccccgccaccctgcaccacctccctcagtcgccttccccattcgcaccttgtcagggatcaggttgtccacttcccagcctccctccccagtctacatcttcccctgcacacccattacaaacgagggagacaagtaccatggctttttctctcagggatcgattactggaaacgatgatcccactgattctgtcaacgacagactacccatctttcgatcgtcctttgctcgcacatgatcggcaacgggaaaccttgacctcgattttcagcaatcagcatgctaccttcccctaccttggcttgtactccggattacttcaacccgaagcagacatagctgaccagggacttcccctatggccctaacaatgcgtgttggagggcgtggcagagccagcaaacccactctacggnaaatgattttttgtgaaggtgcggatgattaggtatcgtatccgtggatatatacttctcgcgggcgatttgcgatgcgacccatacagaaagaatcagtaaactgcgaatgatgcgctctagctagttatcaatatc

SEQ ID NO: 32673 - protein, 76 aa, Zea mays
  misc_feature: Ceres CLONE 1410008-F
MAFSLRDRLLETMIPLILSTTDYPSFDRPLLAHDRQRETLTSIFSNQHATFPYLGLYSGLLQPEADIADQGLPLWP

SEQ ID NO: 32674 - DNA, 668 bp, Zea mays
  misc_feature: Ceres CLONE 1410009-F
  misc_feature: Translation starting site: 175
  misc_feature (593)..(593): n is a, c, t, g, unknown, or other
ccccgcggtggcggccgctctagaactagtggatcccccgggctgcaggaattcgcacgagaccattacctagaacatcctaatcgaaaagccgccgccgccgctcccgctcccagctcgtgttccgcttcttgcagccgacgccgcgaagcgctccagagaacttccgtcaacatgtcgaacacacgtggaatgggagccggacgcaagctcaagacccaccgcaggaaccagcggagggctgacaaggccatacaagaagagccatttgagcaatgagtggaagaaacccttcgctggttcatcccatgccaagggcattgtcctgcagaacattggaattgaggccaagcagaccaactccgctatccgcaagagtgctcgtgttcagcttgttaagaatgccaagaagattgctgccttcgcgtcaaatgacggatgcttgaactacattgaggacaatgataccgtcttgattgctggatttggtcgtaaggcacacgctgagagagataatccctggcgtcctggttcaggttcagccagggtcttccctcgacggcccctgcttgccctcttctccgacccgatcnccgaacccggggcctccgattcgcccctggataccttgaacagaccctatcgaggatggacaccggggaggggcc

SEQ ID NO: 32675 - DNA, 651 bp, Zea mays
  misc_feature: Ceres CLONE 1410010-F
  misc_feature: Encodes the peptide sequence at SEQ ID NO. 32676
  misc_feature (419)..(419): n is a, c, t, g, unknown, or other
  misc_feature (485)..(485): n is a, c, t, g, unknown, or other
tggagctccccgcggtggcggccgctctagaactagtggatcccccgggctgcaggaattcgcacgagaccattacctagaacatcctaatcaaaaaacggggccgccggccggactcttctgacttggcaaccgccgcgcagcgcgacgagcgccacctgcttgctgccgcgtgcctgcgtgcgtgtgcgtccaccactgaccccgcgcccgcccgccgcccctgcccctccactccacttgctcactcgtcggctcgtcgcggcccgcttcccccccggccaagggatggacgcgcttcgcctacggccgtccctcctccccgtgcggcccggcgcggcccgcccgcgagatcattttctaccaccatgttgttccatacaacgaaatggtgaaggacgaatttgcttttctagccnaaggacccaaggtcctaccttgcatcaccatcagaaattcttcgaatggaaatcctccctatgtangatatcacatcggtcattaaatacttctgttaatgctcgggggcacagctgcagtctgaacctgaacacatgattctacaaccatcttggaggcatatcatcttccctaaatgcatttttaacgattttcccggcccattactgcataggaacgctttagcctact

SEQ ID NO: 32676 - protein, 38 aa, Zea mays
  misc_feature: Ceres CLONE 1410010-F
  misc_feature (11)..(11): Xaa is any aa, unknown, or other
  misc_feature (33)..(33): Xaa is any aa, unknown, or other
MVKDEFAFLAXGPKVLPCITIRNSSNGNPPYVXYHIGH

SEQ ID NO: 32677 - DNA, 705 bp, Zea mays
  misc_feature: Ceres CLONE 1410011-F
  misc_feature (175)..(175): n is a, c, t, g, unknown, or other
  misc_feature (428)..(428): n is a, c, t, g, unknown, or other
  misc_feature (472)..(472): n is a, c, t, g, unknown, or other
ccccgcggtggcggccgctctagaactagtggatctccgggctgcaggaattcgcacgagaccattacctagaacatcctaatcgaaaagccaagctttcctcaaaaactcgaaaaaggaacggagaaggcgtcctcgacgactgcccatggccgccgcccggacctagccaggnattgttgtctcctgagtcccgacctaccaaggcggaaagggagagggggcgctgtggcgtcagaaaataactggaacccgagggctgagggcgagcgcaaattcggggggttatcggttttctttttcgtttccttttcccggagggaaaagtatttagggatgcccgttgctaagtttttttccccccccccccccggggggggggggggggggttaaaattgaaccccttttatattttcccccccaaaanacacaccaaaccccgtccttcggggggaaaggcggccgcccccnaataaaaaccgggggggggggaaagaaaggcgcttctattccccgggcggggtcggccatccgcggggtgaggtggggggaatcggccgggggctagaacaaccggcgcgcgcggggcgcaacagtgggggggggcgtcccaacattgggcgggggggggagaaaaaagggtgaggcgggggggcctaccgcgcaaatccccctcgcgcgggtgcccgaaaacaaccggcggg

SEQ ID NO: 32678 - DNA, 668 bp, Zea mays
  misc_feature: Ceres CLONE 1410012-F
  misc_feature: Encodes the peptide sequence at SEQ ID NO. 32679
  misc_feature (650)..(650): n is a, c, t, g, unknown, or other
aaagctggagctccccgcggtggcggccgctctagaactagtggatcccccgggctgcaggaattcgcacgagaccattacctagaacatcctaaaaaaaaccttaatcctatactttcatcgggcgcggcgtgccccctcgcctccaaggctccaacgcatcaatcaatagagcgagcgcgctgtggcatggagcacaaggatgggggcacagcttctgctggtggtctgcccgccggaagcagcttgtgctcgggctcgccgttgctcgacgcgccgatcctccgccgcctctacgccgggcaaatccttgccagatggggcgcgagacatcctctctcgtggtgctcggtcccgtggtggggacgctcgttggaagggccacataccttcaggttttgggcatctggctgctgtcgcaaagcatatccttgattgtcgctggaacctcggtgaccaccctgctcatgtatgccaacctgagagccacaagcttcccggcattcatggcgctggtcgccgttaccaacgtctccggcgctctagctgccctctcagctctcgccggcaccatactgatcgagagagaatgggtggtggtgatctcgagcgggcatcctccgtcggtgcggacggggatcaactcggtnggtccggcggatcgacct

SEQ ID NO: 32679 - protein, 117 aa, Zea mays
  misc_feature: Ceres CLONE 1410012-F
MGRETSSLVVLGPVVGTLVGRATYLQVLGIWLLSQSISLIVAGTSVTTLLMYANLRATSFPAFMALVAVTNVSGALAALSALAGTILIEREWVVVISSGHPPSVRTGINSVGPADRP

SEQ ID NO: 32680 - DNA, 535 bp, Zea mays
  misc_feature: Ceres CLONE 1410013-F
  misc_feature: Encodes the peptide sequence at SEQ ID NO. 32681
  misc_feature (237)..(237): n is a, c, t, g, unknown, or other
tccccgcggtggcggccgctctagaactagtggatcccccgggctgcaggaattcgcacgagaccattacctagaacatcctaatcgaaaaaaaaccctagatctcgtcttgtcgccccgttcctccgatcccatcctatccgatcctcatgggattcctcctcgtccagcctcagccagcagcccgagttcgactacctcttcaagctactccttatcggcgactccggcgtcggnaagagcagcctcctcctccgcttcaccggcgactccttcgatgacctctcccctaccataggtgatctctttgacttcgattatattccccgatctgaccgcttcaccgccgactccttcgatgacctctcccctaccataggtgttgactttcaggtggagatgggtagcattggtggcaaaaaactcaggcttggcatctgggacacagctggacaagagaggtttaggaaccttgaccaggtctactacggaggggccagggaatccttattggggaagatggcagccaacaaag

SEQ ID NO: 32681 - protein, 45 aa, Zea mays
  misc_feature: Ceres CLONE 1410013-F
MGSIGGKKLRLGIWDTAGQERFRNLDQVYYGGARESLLGKMAANK

SEQ ID NO: 32682 - DNA, 666 bp, Zea mays
  misc_feature: Ceres CLONE 1410014-F
  misc_feature: Encodes the peptide sequence at SEQ ID NO. 32683
  misc_feature (398)..(398): n is a, c, t, g, unknown, or other
  misc_feature (519)..(519): n is a, c, t, g, unknown, or other
  misc_feature (563)..(563): n is a, c, t, g, unknown, or other
  misc_feature (645)..(645): n is a, c, t, g, unknown, or other
tccccgcggtggcggccgctctagaactagtggatcccccgggctgcaggaattcgcacgagaccattacctagaacatcctaatcgaaaaacagatatatatgccgtgaccaaaccgtcgcttccatttttcgcccgccgcccccagtcccgatccgaagctgtgcctcgtaccatttcgatccaatggcgccgacgtcgaagctgtcgactggcatcaagcgcgcttcgcggtcgcacgcgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagcntcaggtcgaggaatcaaaacacgaggcagtatcctcattctcatgggtttgcaaacaccaacttcatcagtgtactcagctaatggaatttattgggtatgatgggagctatggacccggncttttggtatggatcgcacatgtataattctggatttatatggngggatggaattcactgtaatgatggaaaagacagaaccagaggaaaggtaacaaggggggattttatggttatgggaatggnaaaccatagatggctttaatg

SEQ ID NO: 32683 - protein, 119 aa, Zea mays
  misc_feature: Ceres CLONE 1410014-F
  misc_feature (1)..(49): Pfam Name: Ribosomal_L6e_N Pfam Description: Ribosomal protein L6, N-terminal domain
  misc_feature (71)..(71): Xaa is any aa, unknown, or other
MAPTSKLSTGIKRASRSHAYHRRGLWAIKAKNGGAFPKADKAAAAVEPKFYPADDVKPRVPSTRKPKPTKXQVEESKHEAVSSFSWVCKHQLHQCTQLMEFIGYDGSYGPGLLVWIAHV

SEQ ID NO: 32684 - DNA, 641 bp, Zea mays
  misc_feature: Ceres CLONE 1410018-F
  misc_feature: Translation starting site: 177
  misc_feature (383)..(383): n is a, c, t, g, unknown, or other
acccgcggtggcggccgctctagaactagtggatcccccgggctgcaggaattcgcacgagaccattacctagaacatcctaatcgaaaaatcacaattcactccactcatcttttctcgtttagaacctctaaaatttcccccactcgccagtcgcagcagcacctgtagcagtcatggacgccagcggagccggtagcaaggggaagaagggggcggccgggcgcaaggcaggcggccccaggaagaagtcggtgacgcggtccgtcaagggccgggctgcagttccccgtcggccgggatcgggcgctacctcaagaagggccggtacgcgcagcgcgtgggcactggcgcccccgtcaccctcgccgccggtcctgagntacctctccgtcgcttcagtcatgggcagaatggcaacctgagagggttctccaggtcgatgctaagcactatgattcctaagatgcaggagctgctggacaccgtgaaaaaactggaggagttcttcctaaaaagggggagagggtttttgagaaggttttaaggaaatgggcccccccaaaaaaactttctgaaggattttagggcgttaaggggtttggaaaaacccttctgcaatccaggaaaggaggaatttg

SEQ ID NO: 32685 - DNA, 541 bp, Zea mays
  misc_feature: Ceres CLONE 1410020-F
gctcaagaactagtggatcccccgggctgcaggaattcgcacgagaccattacctagaacatcctaatcgaaaatttcttccccccttctctcgtcacgtccaataaaaaggggggaaaacttctctctctttttttccctccccgcccgaatctgatgctaaaaccctcgccgggaggaggattcaatccccgaaggacaggccgcgcccgccactaaagccggggccgggatttcggcatgggcggcgggcgaaccaggcccaggcccggaaaaagggggatcccctggagctgaacctggcttgaaaaaaaccccccaaaagcaaaccgtaggggcggaacttttcgggtaggaaaaggggaaaagggaatggcccgggggggttcccttaaaacacaaaaggccccaaaaaaagtaatcttttccaaaaaactgaaaaaaccttttccccccccaaaagggggggggggcaaggcaaaacctcttttttgggggggaaaaaaaacccttgggggaggggggggaaatccccctttgg

SEQ ID NO: 32686 - DNA, 652 bp, Zea mays
  misc_feature: Ceres CLONE 1410031-F
  misc_feature (378)..(378): n is a, c, t, g, unknown, or other
  misc_feature (433)..(433): n is a, c, t, g, unknown, or other
  misc_feature (448)..(448): n is a, c, t, g, unknown, or other
  misc_feature (492)..(492): n is a, c, t, g, unknown, or other
  misc_feature (546)..(546): n is a, c, t, g, unknown, or other
cgcggtggcggccgctctagaactagtggatcccccgggctgcaggaattcgcacgagaccattacctagaacatcctaatcgaaaaactctcgctttcttctgtctcgcctcgccctcgcctttgttgatcttttcctttctcgcgttcccctcgccttcctcttcctcccccacacccaccggtcgccgcccccgtcgccccggcctcctcggtccagagacgagggggtccgcgccgttccgacgccacaccgcaaccgcatcacatcaccgcctgctcccaccgtccatccgccctccctcgatcgcgctccccggatcgctggtacctccgcgcgcggctccgacctcatcttcctccatcgactggcatcgngcagcggcggcgtgttcccggccaaccttcgaaagggtaatcaatcgccagactnttgggagctgtgttngggggggacccggggtgaagagccaagttactgcagagctaacnatttcgggttgtcgagtgatggcgcaaggcatcaacttccctgactcatccggnggccgtggtgggcatggatggggggcgtgggactttgggtgggaacttctgtgacatggccttctacagaaaggttaggggagggcacccacaatggtcggtcgac

SEQ ID NO: 32687 - DNA, 653 bp, Zea mays
  misc_feature: Ceres CLONE 1410032-F
aagctggagctccccgcggtggcggccgctctagaactagtggatcccccgggctgcaggaattcgcacgagaccattacctagaacatcctaatccaaaaagaggctggcgcacctgcgtcactcgctccgcgctgccgcgatctcctctgacgtcgaagtcgcccggtggatgacacagggggaaggggtggtgtggggaggggtgaacaggagctcggtgacttttgtgaggggcgcctgatggaggagcgccggctcgacacgccggtgatgaggagaatcagcgagtggtatatacgttcctagcttctcctaccttccctcctgcggctccttgctctacttttcattaagtggcatgtggctgctgatgtttcgcatgtgattcagacgatttcgcgtccgtaactggcgcagctgagagcttgctgagtccgattctgtgctgaaaagaacagctatggtcatgaagctagtgagacgtggactgtggtctcagatcttcacgtcttgtatgctgtgaaggagtcgctctacacgcctctgcaaaatgaagatttccctttgcatgagctggggctaaaaggtatcacgaggctttggctgatgttgatccagacttcccggggggtggttcctatcggggttcg

SEQ ID NO: 32688 - DNA, 616 bp, Zea mays
  misc_feature: Ceres CLONE 1410039-F
  misc_feature: Encodes the peptide sequence at SEQ ID NO. 32689
  misc_feature (36)..(36): n is a, c, t, g, unknown, or other
  misc_feature (361)..(361): n is a, c, t, g, unknown, or other
gcggtggcggccgctctagaactagtggatcccccngggctgcaggaattcgcacgagaccattacctagaacatcctaatcgaaaatttttccattccttgcgcccccttcagatccgatctgatccacgccggcgagacaccggaggaccgccatgacgctcagcctccgtcgcaagcagctcgatgttatcgtgcggatgctgcacctgaaccagcagcagttgccgaacggcggcgagggacagggagaggacgatgcgtacaagatcctggttatggatccgccctgtatctccatcctctcgcctgtgctcaagctcggcgacctccgccaccaaggtgtcaccctcaccctcgncatcgatcgtcccgcggcaggcggtgcccgatgcgccggccgtcttactcgtccggccaccccccgggaacgtggaccgagtagcgccgacgcccgccgcggggctctaacgggtctttccacggtcacttcttcaccttcggcccgggacccctggtggaaggggctcgaaccgcctgggccgccgtttccgcccgggggggggggccccgggggcccgcgtttcttaaaaaaaatcgaattcgggtggatggg

SEQ ID NO: 32689 - protein, 153 aa, Zea mays
  misc_feature: Ceres CLONE 1410039-F
  misc_feature (69)..(69): Xaa is any aa, unknown, or other
MTLSLRRKQLDVIVRMLHLNQQQLPNGGEGQGEDDAYKILVMDPPCISILSPVLKLGDLRHQGVTLTLXIDRPAAGGARCAGRLTRPATPRERGPSSADARRGALTGLSTVTSSPSARDPWWKGLEPPGPPFPPGGGGPGGPRFLKKIEFGWM

SEQ ID NO: 32690 - DNA, 652 bp, Zea mays
  misc_feature: Ceres CLONE 1410042-F
  misc_feature: Encodes the peptide sequence at SEQ ID NO. 32691
  misc_feature (496)..(496): n is a, c, t, g, unknown, or other
tccccgcggtggcggccgctctagaactagtggatcccccgggctgcaggaattcgcacgagaccattacctagaacatcctaatcgaaaaatcgagacaaaatatctaccggggatgtggtggtggatgctcgggcattcgtcaaaccactcatcatcccatcccatcccatccaagggaatccgatcaatcccggactcgtcctcccggccaaccctagcttcccttctcttcccctcccccgatggacccgccgcccaaccagggacagaaggggaggagctggagcctgaaacccgcgccttccccgacgccgacgacccggagacctcccgatctgaacgcgaagaaggtatccctccaccggcaccgccaccgcctctgcgccagagctcaatggggggcttgccgcgccgacgagcggctcagggcgctcctcaccctcaacgtctcctgcggggcagcggacgaccgactcatcgcacacctcggaanaaattcgaagggggtccgaagggtggcatgcctcgcggttggcctctgggttcccctcgtttccctgggggtggggaaggtcaaaaaggggaagggggccctcctctggccaaacaaattttaagggggagctggaaccttggtctttctgcatca

SEQ ID NO: 32691 - protein, 124 aa, Zea mays
  misc_feature: Ceres CLONE 1410042-F
  misc_feature (84)..(84): Xaa is any aa, unknown, or other
MDPPPNQGQKGRSWSLKPAPSPTPTTRRPPDLNAKKVSLHRHRHRLCARAQWGACRADERLRALLTLNVSCGAADDRLIAHLGXNSKGVRRVACLAVGLWVPLVSLGVGKVKKGKGALLWPNKF

SEQ ID NO: 32692 - DNA, 583 bp, Zea mays
  misc_feature: Ceres CLONE 1410043-F
  misc_feature: Encodes the peptide sequence at SEQ ID NO. 32693
  misc_feature (420)..(420): n is a, c, t, g, unknown, or other
  misc_feature (421)..(421): n is a, c, t, g, unknown, or other
  misc_feature (455)..(455): n is a, c, t, g, unknown, or other
  misc_feature (465)..(465): n is a, c, t, g, unknown, or other
  misc_feature (478)..(478): n is a, c, t, g, unknown, or other
  misc_feature (481)..(481): n is a, c, t, g, unknown, or other
  misc_feature (491)..(491): n is a, c, t, g, unknown, or other
  misc_feature (492)..(492): n is a, c, t, g, unknown, or other
tacccgcggtggcggccgctctagaactagtggatcccccgggctgcaggaattcgcacgagaccattacctagaacatcctaatcgaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctcccaccggggtccccgggtggcacgctccattggttccccggcggggcccgggggtttcccccccccccccgggggnnctttctctccctcggggggggggggggggggggncgggccccgnctcgcgcggccgnggngggcgctgtnngcccgcccgcgggcggggggggggggcggcccgcccgcgcggggggtgggggggggcgcctctcccttgtgggggtgcgcccccccccccc

SEQ ID NO: 32693 - protein, 145 aa, Zea mays
  misc_feature: Ceres CLONE 1410043-F
  misc_feature (92)..(92): Xaa is any aa, unknown, or other
  misc_feature (107)..(107): Xaa is any aa, unknown, or other
  misc_feature (111)..(111): Xaa is any aa, unknown, or other
  misc_feature (112)..(112): Xaa is any aa, unknown, or other
  misc_feature (116)..(116): Xaa is any aa, unknown, or other
MGALRSLAISYPEFLVAGLCFVSLSALRHAMRERRQRAPLSWPVVGMLPFVLANLGRLYDAITDALPPGSPGGTLHWFPGGARGFPPPPRGXFLSLGGGGGGGRAPXRAAXXGAVXPPAGGGGGRPARAGGGGGRLSLVGVRPPP

SEQ ID NO: 32694 - DNA, 639 bp, Zea mays
  misc_feature: Ceres CLONE 1410044-F
  misc_feature: Encodes the peptide sequence at SEQ ID NO. 32695
  misc_feature (150)..(150): n is a, c, t, g, unknown, or other
  misc_feature (156)..(156): n is a, c, t, g, unknown, or other
  misc_feature (180)..(180): n is a, c, t, g, unknown, or other
  misc_feature (195)..(195): n is a, c, t, g, unknown, or other
  misc_feature (201)..(201): n is a, c, t, g, unknown, or other
ggagctcaccgcggtggcggccgctctagaatagtggatcccccgggctgcaggaattcgcacgagaccattacctagaacatcctaatcgaaaaacacgcccagtctcctcaatcctcacatcctattggccacggcaactgccatcgncatggncgggaggcgtccggcaacgggggnccctctccctctcgncgtagncttcgctcccatctcctccggcggttggccagtctcccatgcgaccagatccgctgccgaggagatcttcgcttccctcgcccgaagggtcctttcgggattttgggaaacccatttgggcatggaaaaagttccaaaaatccggtttgggaaaaataaaaaatattttgggaaaggggggaaattttcccggggaaaactggtttccccgattcccccggaaaaatgttccccccaaccccgaataaaggggggctgtgtattgggggttataccccgcgattaaaatagttttttttcaaagccaagcgggggggtaaaaaaacccaaacccgcggggaaaaaaccattttggggggggggggggttatattccccggaaaggccgctctttgttggttttctttgtttgaaaaaaaaaatttttttccggttaaa

SEQ ID NO: 32695 - protein, 69 aa, Zea mays
  misc_feature: Ceres CLONE 1410044-F
MRPDPLPRRSSLPSPEGSFRDFGKPIWAWKKFQKSGLGKIKNILGKGGNFPGENWFPRFPRKNVPPNPE

SEQ ID NO: 32696 - DNA, 650 bp, Zea mays
  misc_feature: Ceres CLONE 1410049-F
  misc_feature: Encodes the peptide sequence at SEQ ID NO. 32697
cgcggtggcggccgctctagaactagtggatcccccgggctgcaggaattcgcacgagaccattacctagaacatcctaatcgaaaaaagtcccaatccaccgacgaattccaaaccctgcctaggacctcggcgccactcgccgcacgtcgtccacgtccgcctccaccccaatccgatggggtatgaagagagcaaaaaacatctcctcagtctcagctaccctgagctgcaatgtttgtgcaaaaggtataaccttcctgctaagaagacccactctcagttagcaagttcgctcgcctcgctgcttgaggcatctccatctcctgctcctccctcctgtcattagcaaatatgaaagaagcatccacatgcaatcatgctaacaacaaaagaggccatacaatggcagggatgatggaaaaccactggtgcctgcgaaacatcaaaaaggagatcagacccctggtgatgaaaactctaaaaaggggattggacctggaacgagaatcctcccggtttttatgaccctggggaaacccggaatatctggccctttatttttctgacctgggaaaggggtctaaatattcaggcccccaagggggcgggggaaatgccaaataaaaaaaaaaatctaaaaattgttg

SEQ ID NO: 32697 - protein, 56 aa, Zea mays
  misc_feature: Ceres CLONE 1410049-F
MGYEESKKHLLSLSYPELQCLCKRYNLPAKKTHSQLASSLASLLEASPSPAPPSCH

SEQ ID NO: 32698 - DNA, 657 bp, Zea mays
  misc_feature: Ceres CLONE 1410050-F
  misc_feature: Encodes the peptide sequence at SEQ ID NO. 32699
  misc_feature (581)..(581): n is a, c, t, g, unknown, or other
  misc_feature (657)..(657): n is a, c, t, g, unknown, or other
tccccgcggtggcggccgctctagaactagtggatcccccgggctgcaggaattcgcacgagaccattacctagaacatcctaatcaaaaaacatatccccactctagccaagtagtcagtcctctccaatctccactctcctctcgcaccaccaaaaaaccggtcccaccgttcgccatgagctccgaagccggatgctcagctccagccgccgccgcgccggatggggcgggtggcggcagggtggagatcgacacgtccgcgccgttcgagtccgtgcgggaggccgtcgaccgtttcggtggcagcgccgcctggagctccgacctcgtcaggcgcatgttcgcgccctccaagaaacatgaacactctgaccaagctgcagaggccatcaacgccgaggagcaagctgcacagctagagaacgagctggcagttaaagaaagggagactcttgatgtgctcaaggagctggaggcaaccaagaggatcatagcagacctgaaactgaagatacggaaggaagcactgaaactcccctgaagaggctgctgaccaggttttctggaggcgggagctncacagcagaaactgaaaccaacattgtggggggggtgggggaaatggaaagggggaagagaaaactttttggggtn

SEQ ID NO: 32699 - protein, 121 aa, Zea mays
  misc_feature: Ceres CLONE 1410050-F
  misc_feature (28)..(122): Pfam Name: DUF827 Pfam Description: Plant protein of unknown function (DUF827)
MSSEAGCSAPAAAAPDGAGGGRVEIDTSAPFESVREAVDRFGGSAAWSSDLVRRMFAPSKKHEHSDQAAEAINAEEQAAQLENELAVKERETLDVLKELEATKRIIADLKLKIRKEALKLP

SEQ ID NO: 32700 - DNA, 665 bp, Zea mays
  misc_feature: Ceres CLONE 1410053-F
  misc_feature (618)..(618): n is a, c, t, g, unknown, or other
  misc_feature (665)..(665): n is a, c, t, g, unknown, or other
tccccgcggtggcggccgctctagaactagtggatcccccgggctgcaggaattcgcacgagaccattacctagaacatcctaatcgaaaaacacacccggaccccggtctgcgtttgtccctgcgggctgcggccctgcctcttctcgtctcccgttcccctcgccgcgtgagctctctctctctctctctctcctctgtggtgacgactgggcgcccgcacccctggcagccgccgccgcccagtccccgtcgggcccttcggcaggtcttcttcggcctcttcgccggcgacgagccgcaccaggcgtacatgtgtacacccagcccaggcccttaactgcgcccgcccctgcgactggttttcctgctggtttctgtggatttggctgccggaggattggtgcagcctttaggatcacggtagattcgctgtgaaatccgaagggtgctcaggtcatgttgggggaccagcgcatgatactgggcttagactcggcaacctcatcaagcactgcccctgatttgacccgcgcctgaagaggatccttctgtgagcaggaagctgcgtgatcaccgcctgcaaggttggggtgggcgcaaaaggagaaacagggnggggagggggccttgggtgaaattgttataagcaagaagaaaacaan

SEQ ID NO: 32701 - DNA, 632 bp, Zea mays
  misc_feature: Ceres CLONE 1410054-F
  misc_feature: Encodes the peptide sequence at SEQ ID NO. 32702
  misc_feature (276)..(276): n is a, c, t, g, unknown, or other
  misc_feature (280)..(280): n is a, c, t, g, unknown, or other
  misc_feature (281)..(281): n is a, c, t, g, unknown, or other
  misc_feature (283)..(283): n is a, c, t, g, unknown, or other
  misc_feature (286)..(286): n is a, c, t, g, unknown, or other
tggagctccccgcggtggcggccgctctagaatagtggatcccccgggctgcaggaattcgcacgagaccattacctagaacatcctaatcgaaaaagatctcccgctccctccttcccttcatctctctgaatcctgctgcccacctcgccgtcctcgcattccgccgctcgctctcgcgatccggcagcttcctcttcgccgtcgttcttgcctcacctcgtccgctatcctgtaagctgctgctgggtcacccgtggttggactcgaccccgncggnngncgncctcggggggctgggttccgcggaatgttaatcggttcctgaatccatccggatcccggaatcggcgcaaaggcacgcccttttggaagttcctcccgggccatggaaagaagggggttttgcaatttccgggggggggagggcccctggggtttaaaactttggggtgggaaaaacccgcgaaaagttttccggaaaggggcacccgggggggggaaaagccccggagggggggactttggctcttccccggggggggtttcccccgggggggaaaattggggggtttccccggaaatccctcccctcggtggggggaaaagggtttttttttttttaacaaaaa

SEQ ID NO: 32702 - protein, 81 aa, Zea mays
  misc_feature: Ceres CLONE 1410054-F
MERRGFCNFRGGEGPWGLKLWGGKNPRKVFRKGAPGGGKSPGGGDFGSSPGGVSPGGENWGVSPEIPPLGGGKRVFFFLTK

SEQ ID NO: 32703 - DNA, 652 bp, Zea mays
  misc_feature: Ceres CLONE 1410055-F
  misc_feature: Translation starting site: 509
  misc_feature (632)..(632): n is a, c, t, g, unknown, or other
tccccgcggtggcggccgctctagaactagtggatcccccgggctgcaggaattcgcacgagaccattacctagaacatcctaatcaaaaaaatgagctcgctctcctgctcctacaggctgcagttgcgctgtgcctgtgcttccagttccatcgctttcccctcctccccagtccccactcccagatgcgatttccctctccaccgccacagcgcctagcttagccagccagccggcggccatcgccgccgcaatggcgaccgcgtcggaggacgaggccgcctcggaccgctgcagcggcagctacagccccagcgccgacgtcagcgagtccgaaacctccagtgactgctccgcgcccaccacgcgccgcttcgcctcctcctcctcggcctccgccaccgtctcccgcctcgcgtcctcctcctcgtcgctccccaccccggcatcggccaccgccttctacctctccaagccaaccccgaccctctccgagatcgacatgaatgaaggagcgcttcgcgaagctcctgctcggcgagggacatgtcggcaagcgggaaagggcgtctgcaccgcgctcgccatctccaatgccatcacacctctccgccaccgtgttccgggaantttgtggaaggctggaccgt

SEQ ID NO: 32704 - DNA, 730 bp, Zea mays
  misc_feature: Ceres CLONE 1410056-R
tttgttgggcggtggtgtggtttgtgtgtactttctctctaaagcatggtttgtttgcgtattggggtaccggtccccccctcgaggtcgacggtatcgataagcttttttttttttttttttgaattaagaaagtatcattagtgattacattatcggagtttcagaaataataaccataaattttaatgcagcggaaataactaacggagaagaaccgagtaacatggcgaagcctggccacgctactcctcctggtcctctccagcggaagcagtaacccactcgaccatctatcccggtggcagggatggaggccaagtcacaccagcaacaattcatcctaaggagtacctttaatttaacacttagagagtgtttgctggggaggtactcgcttggcgagcatccactggttacgtccaccattcttcaggttgtccaccaattgcatcttgtggtcggcaccacatcagttgctcgatcatcatctctcggtccataaacaaaaccaaacggcgtttgcaagaacgacggtgattccgatttgtgcatcgctacgaacatcgacgagcgtcgagcagcttgccttcttctccacgcaaaacacggggttctctcctccacaaaaataaaacagcacacatacacaattaatcgtatgacaataacatcgatgcggaaccaaacaaggagcgtcgcggtctcaccgagatgaacgacgtcgata

SEQ ID NO: 32705 - DNA, 663 bp, Zea mays
  misc_feature: Ceres CLONE 1410059-F
  misc_feature: Encodes the peptide sequence at SEQ ID NO. 32706
  misc_feature (204)..(204): n is a, c, t, g, unknown, or other
  misc_feature (206)..(206): n is a, c, t, g, unknown, or other
  misc_feature (322)..(322): n is a, c, t, g, unknown, or other
  misc_feature (325)..(325): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (386)..(386): n is a, c, t, g, unknown, or other
  misc_feature (389)..(389): n is a, c, t, g, unknown, or other
gctctagaactagtggatcccccgggctgcaggaattcgcacgagaccattacctagaacatcctaatcaaaactcgcgttccatttgcttcggctcatctcagatcaagctagcgcacctgacacccaccacctccctcccagatccaccaccccaggcatgggcaccgcctttgactccccgacctcctcccccgccgccgngnccttccacgacgaccctttcctccatttcgacggctcggcccccgccgccgccgacggcttcccgggctccccggacgcctacgcgccctcccccttcgggatgccccactccaanggngacctccatgatgaccccccccccggagggggggggggcgannnnnnnnccatcccttccnccnccccacgaaatggcccacaaagagggattcctgctccggggggggggccaaaaaaatggtattcccctttaaggaaaaagaaaaaaaaccgtaaggggctgcaggagcccaactctccgtgggagggggaaaaagttaaaaaagggtttttgttggaaaagagaaagctccggggggggagacaggaaaggcccccaacccggcgacaacggggagggtttttccaagggggcgcggggaaagattccgcggggggggccaaaaaatcccggcg

SEQ ID NO: 32706 - protein, 167 aa, Zea mays
  misc_feature: Ceres CLONE 1410059-F
  misc_feature (15)..(15): Xaa is any aa, unknown, or other
  misc_feature (16)..(16): Xaa is any aa, unknown, or other
  misc_feature (54)..(54): Xaa is any aa, unknown, or other
  misc_feature (69)..(69): Xaa is any aa, unknown, or other
  misc_feature (70)..(70): Xaa is any aa, unknown, or other
  misc_feature (71)..(71): Xaa is any aa, unknown, or other
  misc_feature (72)..(72): Xaa is any aa, unknown, or other
  misc_feature (76)..(76): Xaa is any aa, unknown, or other
  misc_feature (77)..(77): Xaa is any aa, unknown, or other
MGTAFDSPTSSPAAXXFHDDPFLHFDGSAPAAADGFPGSPDAYAPSPFGMPHSXGDLHDDPPPGGGGGXXXXIPSXXPRNGPQRGIPAPGGGPKKWYSPLRKKKKNRKGLQEPNSPWEGEKVKKGFLLEKRKLRGGRQERPPTRRQRGGFFQGGAGKDSAGGAKKSR

SEQ ID NO: 32707 - DNA, 650 bp, Zea mays
  misc_feature: Ceres CLONE 1410060-F
  misc_feature: Encodes the peptide sequence at SEQ ID NO. 32708
  misc_feature (271)..(271): n is a, c, t, g, unknown, or other
cgcggtggcggccgctctagaactagtggatcccccgggctgcaggaattcgcacgagacccattacctagaacatcctaatcgaaaagatctccccaatccgaccagaccggcaggcaccttcgactcgagcggagcaggcgaggcagagatggcgctgcgacgggcgctcctcagatcggtcaacttctcccccgacagcaaggctgcaattgagtacttttattctttctcaagggcacagtctgcttgttctctcaatggtgctggntcttgtcctgctagtagatcatttagcacccaggctgccactacgtcaaggaaaccaaaggctccacctccaccaccccctccagagaaaatcacttttgtggggctcaagaagaggatcgcattttccccaccctcaagggcgggaggaccctttttggaaggggggggaaaaaaagggccttgtaaaaaccccaggttttggggtaaagggggaaaatgggaatttatagaaaaaaaaaccgggcccggggggcgggggggggggggtttcccccggggggaaaaggggttttaagcccacgggttttggaggccccccttttttattttgttaaaagggggaagagagccccccccctccccaaaaaaaaaaaacc

SEQ ID NO: 32708 - protein, 138 aa, Zea mays
  misc_feature: Ceres CLONE 1410060-F
MALRRALLRSVNFSPDSKAAIEYFYSFSRAQSACSLNGAGSCPASRSFSTQAATTSRKPKAPPPPPPPEKITFVGLKKRIAFSPPSRAGGPFLEGGGKKGPCKNPRFWGKGGKWEFIEKKTGPGGRGGGGFPRGEKGF

SEQ ID NO: 32709 - DNA, 693 bp, Zea mays
  misc_feature: Ceres CLONE 1410064-F
  misc_feature: Encodes the peptide sequence at SEQ ID NO. 32710
  misc_feature (477)..(477): n is a, c, t, g, unknown, or other
acagctggagctccccgcggtggcggccgctctagaactagtggatcccccgggctgcaggaattcgcacgagaccattacctagaacatcctaatcaaaaaacatatccccactctagccaagtagtcagtcctctccaatctccactctcctctcgcaccaccaaaaaaccggtcccaccgttcgccatgagctccgaagccggatgctcagctccagccgccgccgcgccggatggggcgggtggcggcagggtggagatcgacacgtccgcgccgttcgagtccgtgcgggaggccgtcgaccgtttcggtggcagcgccgcctggagctccgacctcgtcaggcgcatgttcgcgccctccaagaaacatgaacactctgaccaagctgcagaggtcatcaacgccgaggagcaagctgcacagctagagaacgagctggcagttaaagaaagggagactcttgatgtgctncaggagctggagggcaccaagaagatcatagcagacctgaaactgaagatacggaaaggaagcactgaaacatcccctgaagaggctgctgaccagttttctgaggggggaggtccacaggagaaaactgaaaaacccaacattgatgggggggggaacctggaaggggaaaaggaaaacccttcgggttgggtcccggggaacccgagaagggaa

SEQ ID NO: 32710 - protein, 168 aa, Zea mays
  misc_feature: Ceres CLONE 1410064-F
  misc_feature (28)..(148): Pfam Name: DUF827 Pfam Description: Plant protein of unknown function (DUF827)
MSSEAGCSAPAAAAPDGAGGGRVEIDTSAPFESVREAVDRFGGSAAWSSDLVRRMFAPSKKHEHSDQAAEVINAEEQAAQLENELAVKERETLDVLQELEGTKKIIADLKLKIRKGSTETSPEEAADQFSEGGGPQEKTEKPNIDGGGNLEGEKENPSGWVPGNPRRE

SEQ ID NO: 32711 - DNA, 701 bp, Zea mays
  misc_feature: Ceres CLONE 1410065-F
  misc_feature: Encodes the peptide sequence at SEQ ID NO. 32712
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (598)..(598): n is a, c, t, g, unknown, or other
  misc_feature (599)..(599): n is a, c, t, g, unknown, or other
aaagctggagctccccgcggtggcggccgctctagaactagtggatcccccgggctgcaggaattcgcacgagaccattacctagaacatcctaatcgaaaaagtaatcactcctcagtgctcactagcccaagtcgccctaaacctagcccgggcacccgccagaccagccagcccaacaacgcaaaacgcgacgcggccaccgccttgtccatgggctcctcggcgcagctcaggcggctgaagcctctgtaccagctggtggtgaacaacatcctgaccatcgtggccgtgccgctcgccgccgcggtcctgctcaaggcggcggagctggggcccgaggagatcctggcccgggcccgcgcgctccggccggcgcacatgctcctggcggggttcctgccggccgtggcgacggttctgtacctgacgctccggccgcgcgcggtgtacctggtggactacgcgtgcttccgcaccaaccccaactgccgcgtcccgttcgcgacgttcctggagcactcccgcgtgtggccgggcttcgacgagcgcagcgtccggttcatgacgcgcctgctgagnnnnncccggggctggnngtaggagacgtgcctggcgtacgcgcagcactacatcccgccgtcgcgcgacctggagtcctcccgcgccgagggcgagctcgtcatctactcggccatcga

SEQ ID NO: 32712 - protein, 128 aa, Zea mays
  misc_feature: Ceres CLONE 1410065-F
  misc_feature: SWISSPROT Homolog: EC 2.3.1.119 Icosanoyl-CoA synthase
  misc_feature (123)..(123): Xaa is any aa, unknown, or other
  misc_feature (124)..(124): Xaa is any aa, unknown, or other
  misc_feature (125)..(125): Xaa is any aa, unknown, or other
MGSSAQLRRLKPLYQLVVNNILTIVAVPLAAAVLLKAAELGPEEILARARALRPAHMLLAGFLPAVATVLYLTLRPRAVYLVDYACFRTNPNCRVPFATFLEHSRVWPGFDERSVRFMTRLLXXXRGW

SEQ ID NO: 32713 - DNA, 672 bp, Zea mays
  misc_feature: Ceres CLONE 1410066-F
  misc_feature (357)..(357): n is a, c, t, g, unknown, or other
  misc_feature (469)..(469): n is a, c, t, g, unknown, or other
  misc_feature (541)..(541): n is a, c, t, g, unknown, or other
  misc_feature (583)..(583): n is a, c, t, g, unknown, or other
ggagctccccgcggtggcggccgctctagaactagtggatcccccgggctgcaggaattcgcacgagaccattacctagaacatctaatcgaaaatttttagtcccatcggctcggatccgcccgcccgccgtgcgcgcgtgcacgcacgcacgcctcgcgagcagatggggctggcagtggcggtgggcaggcggccgacgcagcggtccggtgtctcccgttctcgctgcgctggcaagagacccactgccgccgagccccgacaccaccggcaccgcacggagggaagaaaagaaagaaatcccgggggatcacgtcgttatcagcgaccagattcagacgcgagccgagcggnggaggcggaccacactagaactagaaccctctctacggctctactacgctacgccccatcccgcccggaccggaccggacccacctttctcacctctctgcccgccgccggncgacccgaatggggggcggaaccataatagcctgagcacggcgccgccgcagggcagcgcgcggacgacggnacacggtgttccgggcacggggtactcgcgctacggacacgntggcctcgcgctggggttcggggcatccatttaaaggcttcctgggcctggcttggtttccttttccgggcgggttccccactggggtg

SEQ ID NO: 32714 - DNA, 815 bp, Zea mays
  misc_feature: Ceres CLONE 1410071-R2
  misc_feature: SWISSPROT Homolog: EC 1.11.1.15 Peroxiredoxin
  misc_feature (1)..(1): n is a, c, t, g, unknown, or other
naatcatgtgtgactgtcgacattagttcagttgttatacaagtgaaactgaccatgacaaacaggaagatgctggtcgatcaaacaagccagaatcatgtgataaatagactcactgaaggatggaacaaaacatcaggtcatcagctcttggttacatacactacactactacatagtccggcacttttacacccacgaatgcagagcatggcccagaacactgaggaggttgatcagatcaaaaggaatgcaggatcttgaacttctcgccgatgtgctactcgggctagaactggatgtagaaaacttactgcaatactccctgatagtccaaaacttacgtatggcgccccgatacagatcccaaataagtccgaggggacacaccactccttgcgcacgctgttccactcgtcgcaaaccagagagaacggcaaccagtacttctgcacgaacgccttgtgcgacaccgcgtcgaccccgctgatgccgatcacctccttcccgaccttcttgaacttttcgtacgagtccctgaacgcgaacgcctgctttgtgaatacgggcgtctcgtcagctggataaaagtaaagcacgacgggattgcacttgaacttgttcagcgacacaggcttgccattatgatccttgagggtgaagttctaaggcacactctcattagcaaacttgcaacacactatgcccgaggacatcgcgaatctgctacatgcaccgttcggcgccagactattccggcaccctgaggatgacgaaaactgcaggtgagagtgcgtccataaaaaccgctccct

SEQ ID NO: 32715 - DNA, 700 bp, Zea mays
  misc_feature: Ceres CLONE 1410071-F
  misc_feature: Encodes the peptide sequence at SEQ ID NO. 32716
  misc_feature (421)..(421): n is a, c, t, g, unknown, or other
ggagctccccgcggtggcggccgctctagaactagtggatcccccgggctgcaggaattcgcacgagaccattacctagaacatcctaatcgaaaaaacccatgatgatagcttaccatatcctccgcccccgccgacatgacaaccagaggccctacatgcaacctaaagcgttggagagcatctgagcttgacatccaccacctctggcatgtcttgcacaatacggccttctgcgccgcttctgctgctacatcaaacgcgagttccacctgcacacacatccagcactcgaggacgtcgtgcttgtcacctccctctccgccgcaacgatcgtcaccatcttctccggccccgtctccgacgtcatcggtcgccgcccgatgctcatcgtgtcctcgctgctctacttcgccggcgnactcctcatgctatggtccccgagtgtgccgatgctcctcgtgacgcgccttgtggacggcttcggagtcgggctcgccgtcacgctcgtcctcgtctacatctccgagacggcgccccctgaaatccgaggtttcctcaacacactgacgaagttaacgagatccttgagcatgtctcttttcctattgcatgatcttctacatgacgctgggcgatagccccagttgtcgggtcatgctcggagtcctcatcgtgccctccctcgactacctcgagc

SEQ ID NO: 32716 - protein, 85 aa, Zea mays
  misc_feature: Ceres CLONE 1410071-F
  misc_feature (13)..(13): Xaa is any aa, unknown, or other
MLIVSSLLYFAGXLLMLWSPSVPMLLVTRLVDGFGVGLAVTLVLVYISETAPPEIRGFLNTLTKLTRSLSMSLFLLHDLLHDAGR

SEQ ID NO: 32717 - DNA, 828 bp, Zea mays
  misc_feature: Ceres CLONE 1410071-R
  misc_feature: SWISSPROT Homolog: EC 1.11.1.15 Peroxiredoxin
tttccgattgggtaccgggccccccctcgaggtcgacggtatcgataagcttttttttttttttttttggacgagctactacatgttagactgtcttccttaagctcatttgttatacaagtgaaactgaccatggaaaaacaggaagatgctggactatcaaacaagccagaatcttgtgatttattcacgctctgacggatggaacagatcatccggttatcagctcttggttacatacactacactactacataattcccgtacttttacaacccctaatgctcagcatggcccagaacactgaggaggttgatcagatcacaaggactgcaggatcttgaacttctcccccatgtgcttctcgtgctagaactggatgttgtgaacttactgcaatactccctcatagtccaaaacgtacgtatggcaccccgataccgatcccaatgactccgatgggacacccctctccttgagcactctgttcccctcgtccgatcccagtgtgaaaggtacccagtacttctgcacgaacgccttgtgcaacaccgcgtgctccccgcttatgacgatcacctccttcccggccttcttgaacttttcgtacgagatcctgaacgcgatcgcctgctttgtgaatacgggcgtctcgtcacctgggtaaaagtcatccacgacgggcttgcacttgaaattgttcaccgacacacgcttgtcattatgagtcctttcaggtcaagttctaaaggcccagtctacttagcagaacttgcaccacaatattgcccatgggaatccgggccatctggttacatgcacagcggt

SEQ ID NO: 32718 - DNA, 688 bp, Zea mays
  misc_feature: Ceres CLONE 1410074-F
  misc_feature: Translation starting site: 156
  misc_feature (408)..(408): n is a, c, t, g, unknown, or other
  misc_feature (431)..(431): n is a, c, t, g, unknown, or other
  misc_feature (474)..(474): n is a, c, t, g, unknown, or other
tggagctccccgcggtggcggccgctctagaactagtggatcccccgggctgcaggaattcgcacgagaccattacctagaacatcctaatcgaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgcccccttcgcgcccccgatcgcccgattccttcagggccaaagatattccagtgtttaccaacagagtttctcgtacgtaccgggcaaaatcagtgacagtttcagatcacnggagtgatgtgtgtccctttggnaataccaatgagttatgtcccctggcatgatggagcctatatnagcagcttgaagagcctggatacatctaggcatgaggatcttgaagtatttgccctcatggaaaaacggttgttttgtttggggccccctcaaaggcctccagaatcccataatggcccacaagcgaaataccgaggggggaaaatggcaaccttcccattttggtgaggccaagggagaaaaatttgggtgttaaaaggaaaattggggggtt

SEQ ID NO: 32719 - DNA, 725 bp, Zea mays
  misc_feature: Ceres CLONE 1410077-F
  misc_feature: Encodes the peptide sequence at SEQ ID NO. 32720
aaagctggagctccccgcggtggcggccgctctagaactagtggatcccccgggctgcaggaattcgcacgagaccattacctagaacatcctaatcgaaaaattattacaaccgaccaacgcgctttgtaacgcctccgctgcaatcagcccccgcggcgagcttgccctgcccctgaccctgagtgctagttctcgccgttacgtaaggcttcttggccttgcgtcctccgtctttcgttgctgatacatcgaggtattaaagaagctgcctgattccgggtagcagaggtcgccgccgcctgcagcaatggccgacttctcctggctcacggtgcttggtttcctattcctcacattcaactcaggcatggcgatttatcggtccaacggtgacgccggctccgtcgctttcgtcgtggtatcttatctcgacctgggtggccctggtcgcctgcttgcggtactacgagcaggtggatcagcaccaatcccaaaagggcgggagggtcaagcttggggtttgaagccctcccgaccctccttaatttatgttccgttacaaggggggtggaaataatccccctgccaatcaaaattttgttttctggtcaatggacccccccacccccccggggggggtttcaaccttttttttcgcccaaggaagaacacttttttggccaggggtgggcccccgggccccgccgcggcaaaaaaataaa

SEQ ID NO: 32720 - protein, 89 aa, Zea mays
  misc_feature: Ceres CLONE 1410077-F
MADFSWLTVLGFLFLTFNSGMAIYRSNGDAGSVAFVVVSYLDLGGPGRLLAVLRAGGSAPIPKGREGQAWGLKPSRPSLIYVPLQGGWK

SEQ ID NO: 32721 - DNA, 631 bp, Zea mays
  misc_feature: Ceres CLONE 1410079-F
  misc_feature: Encodes the peptide sequence at SEQ ID NO. 32722
  misc_feature (420)..(420): n is a, c, t, g, unknown, or other
aagctggagctccccgcggtggcggccgctctagaactagtggatcccccgggctgcaggaattcgcacgagaccattacctagaacatcctaatcgaaaaatctcctcgcgagcaccgctggcctcgcttaacggcctgatctcccagccgccgcttccgcctcgcgtcccaccggtctccatctacatgcagccgcgctcgccaccgccgtcggaggcgcctgcgccctccgacgccatcatgatgcccggcgtgggcggcgtggagccggccgtcacgttgggccaggtgccgcgctggagcgaccccgaccagcgcatcttcctcgcctccacgtccgaagaggcgtccgcggagggacgacggatcggcacgacctctgcgtctggtttcatctctttcttcgaaccgctcacgntcgacgacggggccgtcgggggtggccacgcccgggtggctcgggctcccccgcggacagggagatcacttctaggatctatctttggggggggcagcctgggaaccctagggtccaaggggtgggcaaatttaacaacgaaaggtttggaaaggggcaagaaaacccccgggtttcatgtggtttcccgtcaagggtcccccaagaaaag

SEQ ID NO: 32722 - protein, 147 aa, Zea mays
  misc_feature: Ceres CLONE 1410079-F
  misc_feature (78)..(78): Xaa is any aa, unknown, or other
MQPRSPPPSEAPAPSDAIMMPGVGGVEPAVTLGQVPRWSDPDQRIFLASTSEEASAEGRRIGTTSASGFISFFEPLTXDDGAVGGGHARVARAPPRTGRSLLGSIFGGGSLGTLGSKGWANLTTKGLERGKKTPGFHVVSRQGSPKK

SEQ ID NO: 32723 - DNA, 689 bp, Zea mays
  misc_feature: Ceres CLONE 1410082-F
caaagctggagctccccgcggtggcggccgctctagaactagtggatcccccgggctgcaggaattcgcacgagaccattacctagaacatcctaatcaaaaagaggcaaagccgttagccaatctgctgttgcgtgttgcaccgatcaacgtcggttcccagcgcttgctcgtcaagcgtgtcctgctgctgttctctgctcctgcttgccgcgagagctcctctcgctcatctacccaaggtccgacagcaacgacttcgtccagctgctatgggagaacggacaggcgccggtgcacgttaggaggaagcagcatccccaggccgccttcccgcccttcacctgcggagcggccagcagcagtacagctcaagaaaaccagccggttactaccgacccggtctcgctgttcaagacgagaggcctcttcgccgacttctcgtccggcctagacgccgcccgtggcaacggtgaccttgacgacaccgtgccctggatccactgccccatcgtcgaggaagacagcgccgcacccgcacctgccctcgcggagggctacagcccagatttcttctcgcatgctcatgcagcgccgttagcagcggcggcggtagagacgaacctcagccctcctgcaccaccggtccagcacaacagaagcacctcggttgccaccatcagcagagg

SEQ ID NO: 32724 - DNA, 726 bp, Zea mays
  misc_feature: Ceres CLONE 1410084-F
  misc_feature: Encodes the peptide sequence at SEQ ID NO. 32725
  misc_feature (337)..(337): n is a, c, t, g, unknown, or other
  misc_feature (368)..(368): n is a, c, t, g, unknown, or other
  misc_feature (405)..(405): n is a, c, t, g, unknown, or other
  misc_feature (413)..(413): n is a, c, t, g, unknown, or other
  misc_feature (431)..(431): n is a, c, t, g, unknown, or other
  misc_feature (432)..(432): n is a, c, t, g, unknown, or other
  misc_feature (457)..(457): n is a, c, t, g, unknown, or other
  misc_feature (467)..(467): n is a, c, t, g, unknown, or other
  misc_feature (483)..(483): n is a, c, t, g, unknown, or other
  misc_feature (489)..(489): n is a, c, t, g, unknown, or other
  misc_feature (493)..(493): n is a, c, t, g, unknown, or other
  misc_feature (494)..(494): n is a, c, t, g, unknown, or other
  misc_feature (496)..(496): n is a, c, t, g, unknown, or other
  misc_feature (497)..(497): n is a, c, t, g, unknown, or other
  misc_feature (501)..(501): n is a, c, t, g, unknown, or other
  misc_feature (521)..(521): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
aaagctggagctccccgcggtggcggccgctctagaactagtggatcccccgggctgcaggaattcgcacgagaccattacctaaaacatcctaatcgaaaaatcacaagcaatcgatagagctagcatggcggtgaaggtgtgggtgttcgccgtggctctgatgatgtgcgctggtgtacggcttggagctgacgacgacggcggcagccgccttattagccgctgtcgtctgagctcgcccaactaccgcggcgccctggcaaaggccatcctcttcttcgaggggcagcggtcggggcggctgccggcaaaccagagagtcaggtggcgcggngactcggcgctcaccgacggccaacccgaanacgtgaacttgacgggtggctactacgacgccggagnacacgtcnagttcggtttcccgatgnncgtcagcgtcaccctcctgagctgnagcgccgtcnagacccgcgacgaggntggcgncggnngnntcancttcgccacctccgggtcgnccatccaggggggcgccgactttctttctcggggcccacaccaggccgaccaccccttaatttaagggtggggacggcacggccgacacccatgcttggaagcgggcaagggaatggaacccccccggaaccttgaacaaattcccggagtttcccggatcagggcggnnnaaaaaggggggggggggnnnntttttcccctatt

SEQ ID NO: 32725 - protein, 152 aa, Zea mays
  misc_feature: Ceres CLONE 1410084-F
  misc_feature: SWISSPROT Homolog: EC 3.2.1.4 Cellulase
  misc_feature (81)..(81): Xaa is any aa, unknown, or other
  misc_feature (93)..(93): Xaa is any aa, unknown, or other
  misc_feature (96)..(96): Xaa is any aa, unknown, or other
  misc_feature (102)..(102): Xaa is any aa, unknown, or other
  misc_feature (110)..(110): Xaa is any aa, unknown, or other
  misc_feature (114)..(114): Xaa is any aa, unknown, or other
  misc_feature (119)..(119): Xaa is any aa, unknown, or other
  misc_feature (121)..(121): Xaa is any aa, unknown, or other
  misc_feature (123)..(123): Xaa is any aa, unknown, or other
  misc_feature (124)..(124): Xaa is any aa, unknown, or other
  misc_feature (125)..(125): Xaa is any aa, unknown, or other
  misc_feature (132)..(132): Xaa is any aa, unknown, or other
MAVKVWVFAVALMMCAGVRLGADDDGGSRLISRCRLSSPNYRGALAKAILFFEGQRSGRLPANQRVRWRGDSALTDGQPEXVNLTGGYYDAGXHVXFGFPMXVSVTLLSXSAVXTRDEXGXGXXXFATSGSXIQGGADFLSRGPHQADHPLI

SEQ ID NO: 32726 - DNA, 698 bp, Zea mays
  misc_feature: Ceres CLONE 1410085-F
  misc_feature: Encodes the peptide sequence at SEQ ID NO. 32727
  misc_feature (572)..(572): n is a, c, t, g, unknown, or other
  misc_feature (575)..(575): n is a, c, t, g, unknown, or other
aaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgacctccgggagaagtacgggcccatcttcaccatgcggatggggcagcgcaccctcatcgtggtcacctcggcggagctcatccacgaggcgctggtgaagcagggccccatgttcgcgagccggcccgaggacagccccacccgcctcctcttcagcgtncgnaagtgcacccgtcactcggcgccctacggccccctgtggcgtgctctgcgccgcaacttcgtcggcgagatcgtgtccccgcaccgcgtcagggcttctcccctggatcgggattggggccgg

SEQ ID NO: 32727 - protein, 156 aa, Zea mays
  misc_feature: Ceres CLONE 1410085-F
  misc_feature: SWISSPROT Homolog: EC 1.14.13.68 4-hydroxyphenylacetaldehyde oxime monooxygenase
MDVNDVLLVVLAAALAAMWWRRCSKTGGVDGLPPGPPGWPVVGNLFQVILQRRPFMYVVRDLREKYGPIFTMRMGQRTLIVVTSAELIHEALVKQGPMFASRPEDSPTRLLFSVRKCTRHSAPYGPLWRALRRNFVGEIVSPHRVRASPLDRDWGR

SEQ ID NO: 32728 - DNA, 723 bp, Zea mays
  misc_feature: Ceres CLONE 1410086-F
  misc_feature: Encodes the peptide sequence at SEQ ID NO. 32729
  misc_feature (433)..(433): n is a, c, t, g, unknown, or other
  misc_feature (449)..(449): n is a, c, t, g, unknown, or other
  misc_feature (450)..(450): n is a, c, t, g, unknown, or other
  misc_feature (508)..(508): n is a, c, t, g, unknown, or other
  misc_feature (509)..(509): n is a, c, t, g, unknown, or other
  misc_feature (538)..(538): n is a, c, t, g, unknown, or other
  misc_feature (540)..(540): n is a, c, t, g, unknown, or other
aaagctggagctccccgcggtggcggccgctctagaactagtggatcccccgggctgcaggaattcgcacgagaccattacctagaacatcctaatcgaaaaagaaaatacgcacctgctcctcactcttctttatatttttttctccatttggcaacttttgcttgtcgttcatgtatatgcatgaccctttcacacatatgatcagaagataagcacatgcaagacgatctcgcgtggatatgatgcatggatcagacctaacctctatatcatcaccaaacgctcgtagatgatgctatacaattccatgattaaattatatataagtaaaaaaaaaagaaccgtacgtgcatacataaaattaagaattaatggctgccaatggacgacatatgcatggacaggtaagctggtgatcccactgaacccnggagcgcccaacttcnnggtcatgatcgggatgatcgacgggaggaacgagctgaagccgttgccagccaggggnnggccaaaagaccggcgttgcaggtggggncnttttccgccggccccggatccggggggatgactactatttggaaacggggaaaagggaaacccgggggggccccttgggcaaaaaaaaaaaagagacggggggggttttccccctcccgacttttttggggttcaaggggagaatggaggccccccaaaaatccctaagaaaacccgcccaat

SEQ ID NO: 32729 - protein, 92 aa, Zea mays
  misc_feature: Ceres CLONE 1410086-F
  misc_feature (53)..(53): Xaa is any aa, unknown, or other
  misc_feature (73)..(73): Xaa is any aa, unknown, or other
  misc_feature (83)..(83): Xaa is any aa, unknown, or other
MMLYNSMIKLYISKKKRTVRAYIKLRINGCQWTTYAWTGKLVIPLNPGAPNFXVMIGMIDGRNELKPLPARGXPKDRRCRWGXFPPAPDPGG

SEQ ID NO: 32730 - DNA, 700 bp, Zea mays
  misc_feature: Ceres CLONE 1410090-F
tggagctccccgcggtggcggccgctctagaactagtggatcccccgggctgcaggaattcgcacgagaccattacctagaacatcctaatcgaaaaaagcaaattgcatttcaagtcttttgggtttatacagcacagataaaggcggcagcggcagcagcagagcagcctaccttttcccctctccacctcccgcaagcaaactcacggtcacggcaccgcccccgcacccactgccctctagcttcttcctccccgctttcatggcaggaaaggctgaggcgatgatgcccataggccatccagtttgatccatgccatcctgaacctctatacatactgccccagcccgggcactcgcgatctctacttctctaccgccgctgtgcctgtgctagctcctctctctgcttctgcttctgcttttgcctcactcagcctgctgcaagcttttgctttggtttaggtgcttcttttgcattcctttactgttcccccccactttcgctcgctttgccacgcacacgaaaagctcctgcctttaccttctcggaccttatctccgccccgtagtgggatttggtgggagctgcgctgcagctgcttgccccctcgcgtttctttgctcaattgggggtgtcgcgcgtgctcgtgagcggaattcggtggtcttgcttgcgcggccacgtccccgtcccc

SEQ ID NO: 32731 - DNA, 739 bp, Zea mays
  misc_feature: Ceres CLONE 1410091-F
  misc_feature: Encodes the peptide sequence at SEQ ID NO. 32732
  misc_feature (320)..(320): n is a, c, t, g, unknown, or other
  misc_feature (321)..(321): n is a, c, t, g, unknown, or other
  misc_feature (350)..(350): n is a, c, t, g, unknown, or other
  misc_feature (410)..(410): n is a, c, t, g, unknown, or other
  misc_feature (420)..(420): n is a, c, t, g, unknown, or other
  misc_feature (508)..(508): n is a, c, t, g, unknown, or other
aaagctggagctccccgcggtggcggccgctctagaactagtggatcccccgggctgcaggaattcgcacgagaccattacctagaacatcctaatcgaaaaatccaatccaatccaaaccgtcccttgtccctctcttcctcgaaacgcagctatggggactcggccgcagggggtcgtcctcgcgccatgggcggtggtgctggtgctggtgctcgcgcttcgtctggcaggcgcgtcgcatgtgatccaccgcagcctggaggccgaggcggcgccgtcggtcccggcctccattgtcagccccctgctcaggacgnngtaccatttccagccgccaatgaactggnatcacgaccctaacgctccgctgtactacaaaggatggtatcacctggtctaccagtacnaccccaaggncgcggtatggggcaacatcgtgtgggcgcactcggtgtcgcgcgacctgatcaactgggtggcggctggagccggcattaaccccagnattccgtccgaacaagtacggttgctggtcgggctccgggaacaatcctggaggaagggacgccggggatccttggacaccgggatcgaccgggcggaaaataaactaccggggggaggggggtggggtctcccaagggaaggttccgaaccgtttgtcccgaagggggaaaaaccggaggaaaaaaccccgggggggaaacccggggcccgggggaattaacgggagaaa

SEQ ID NO: 32732 - protein, 191 aa, Zea mays
  misc_feature: Ceres CLONE 1410091-F
  misc_feature (58)..(186): Pfam Name: Glyco_hydro_32N Pfam Description: Glycosyl hydrolases family 32 N terminal
  misc_feature: SWISSPROT Homolog: EC 3.2.1.26 Beta-fructofuranosidase
  misc_feature (56)..(56): Xaa is any aa, unknown, or other
  misc_feature (66)..(66): Xaa is any aa, unknown, or other
  misc_feature (86)..(86): Xaa is any aa, unknown, or other
  misc_feature (89)..(89): Xaa is any aa, unknown, or other
  misc_feature (118)..(118): Xaa is any aa, unknown, or other
MGTRPQGVVLAPWAVVLVLVLALRLAGASHVIHRSLEAEAAPSVPASIVSPLLRTXYHFQPPMNWXHDPNAPLYYKGWYHLVYQYXPKXAVWGNIVWAHSVSRDLINWVAAGAGINPXIPSEQVRLLVGLREQSWRKGRRGSLDTGIDRAENKLPGGGGWGLPREGSEPFVPKGEKPEEKTPGGKPGARGN

SEQ ID NO: 32733 - DNA, 770 bp, Zea mays
  misc_feature: Ceres CLONE 1410097-F
  misc_feature: Encodes the peptide sequence at SEQ ID NO. 32734
  misc_feature (444)..(444): n is a, c, t, g, unknown, or other
aagctggagctccccgcggtggcggccgctctagaactagtggatcccccgggctgcaggaattcgcacgagaccattacctagaacatcctaatcgaaaaagcacctccattcccagccacgagacgacgaaaccctagcctccctccccctctctcaccaggccaccacctcgccggaacccggcgcctcgaaggagcacgggatcatcggccgccgtcggccgcggctgcggaggagcggtgtaagatgttgaacggcggcggcggcggccagaagaagcggaacacgaagatcgagccctatcggcaccgcgtagagaccgaccccaagttcttcgacaagtcgtggcggaagctccatgacgccatccgcgagatctacaaccacaacgccagcggtctctccttcgagaaggtctacgggactgctttatacatggtnatgaaccaagtttgctcctccgctctatggaaaactcccggaagaactgaaagagcttcttggagagaaatgccaacatgaattgaggcttgcctcagggggtttgttcctgggaaaaattgtcccgaaaaaggggaaggcccaaaacaggggtttggaaaagggttaaagattccctggggggtatggggccgggacataattttcccccaaaaaaaaaaaaaccccttgttttccaaaaatgggaaaaaaaattttgggggggaaacaaattagggcggccctccaaagaatcaagggaggggggtttttccgcccctctcccc

SEQ ID NO: 32734 - protein, 91 aa, Zea mays
  misc_feature: Ceres CLONE 1410097-F
MLNGGGGGQKKRNTKIEPYRHRVETDPKFFDKSWRKLHDAIREIYNHNASGLSFEKVYGTALYMVMNQVCSSALWKTPGRTERASWREMPT

SEQ ID NO: 32735 - DNA, 693 bp, Zea mays
  misc_feature: Ceres CLONE 1410098-F
  misc_feature: Encodes the peptide sequence at SEQ ID NO. 32736
  misc_feature (525)..(525): n is a, c, t, g, unknown, or other
  misc_feature (540)..(540): n is a, c, t, g, unknown, or other
  misc_feature (552)..(552): n is a, c, t, g, unknown, or other
  misc_feature (593)..(593): n is a, c, t, g, unknown, or other
  misc_feature (618)..(618): n is a, c, t, g, unknown, or other
aaagctggagctccccgcggtggcggccgctctagaactagtggatcccccgggctgcaggaattcgcacgagaccattacctagaacatcctaatcgaaaaatcttcaaaaactacccacggcccgtctcctcgacctccccgaaaccccacttctcggatcgagactagggttagggtttcgtcactcccgccccgattcgaaccaatccgcctaggcccccgccgcgccatggccgccggttccattgtggtggacttcccctccatgggcgccgccctctgcttccccaacctcgaatcactcctccgagactccgcctcgggtttcctctccgccgtctccgccgccccggcccccggcgccgccgacctcaccaacttccaccgcgtcttctcgcgcgtcctcagcacctactcagacccgccgctcgaggtcgtctggttcttctccgcgctctccttccacgaccgccctgacgacctccgctcactgctccagctcctctccgccttcgccgcttncctcgctgggggcgncaagccgttcgncctcctcgcccccgtcgtctcggagcttttccactcagatnagccgcgcagggagaccgaggccgncgtcgaggttgtcctcagctacatcagcatctgcagcaggcgccccgccccttctcgactgaagcaaccaccgcc

SEQ ID NO: 32736 - protein, 153 aa, Zea mays
  misc_feature: Ceres CLONE 1410098-F
  misc_feature (98)..(98): Xaa is any aa, unknown, or other
  misc_feature (103)..(103): Xaa is any aa, unknown, or other
  misc_feature (107)..(107): Xaa is any aa, unknown, or other
  misc_feature (121)..(121): Xaa is any aa, unknown, or other
  misc_feature (129)..(129): Xaa is any aa, unknown, or other
MAAGSIVVDFPSMGAALCFPNLESLLRDSASGFLSAVSAAPAPGAADLTNFHRVFSRVLSTYSDPPLEVVWFFSALSFHDRPDDLRSLLQLLSAFAAXLAGGXKPFXLLAPVVSELFHSDXPRRETEAXVEVVLSYISICSRRPAPSRLKQPP

SEQ ID NO: 32737 - DNA, 590 bp, Zea mays
  misc_feature: Ceres CLONE 1410101-F
  misc_feature: Encodes the peptide sequence at SEQ ID NO. 32738
  misc_feature (231)..(231): n is a, c, t, g, unknown, or other
  misc_feature (295)..(295): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (316)..(316): n is a, c, t, g, unknown, or other
  misc_feature (325)..(325): n is a, c, t, g, unknown, or other
aagctggagctccccgcggtggcggccgctctagaactagtggatcccccgggctgcaggaattcgcacgagaccattacctagaacatcctaatcgaaaaaaaacccggtttcacactagttctgtattcgtgtcctctggtctctcgcaggccaaacaaaagcgccgctgccgccggcaatgttccgccgcctcctcccccaccgtcgctacatctccacctcgcccgncctcaactccaacccgaccctctactctgacggaaccatcccattctctatcctctcggggggnggnnnncggtggcgcttccgnacagctcgncggtggcaaggaggaggggcgctctacccatcccccgtcgcccactacttctccccaaacaaaacaacgctttggtcaacccccgaacgctttcccttttgaaaggaaaccctgggagggggggtgggaaccctttgggggccctttcccccccccccccccccccaaaagaagcccccgggtgggggggaaaagggaaaaagaacccccctcccgcccctgggaaaaaaaattttcccttttgggggcccgcgttaaaacccca

SEQ ID NO: 32738 - protein, 81 aa, Zea mays
  misc_feature: Ceres CLONE 1410101-F
  misc_feature (17)..(17): Xaa is any aa, unknown, or other
  misc_feature (40)..(40): Xaa is any aa, unknown, or other
MFRRLLPHRRYISTSPXLNSNPTLYSDGTIPFSILSGGGXRWRFRTARRWQGGGALYPSPVAHYFSPNKTTLWSTPERFPF

SEQ ID NO: 32739 - DNA, 701 bp, Zea mays
  misc_feature: Ceres CLONE 1410102-F
  misc_feature (470)..(470): n is a, c, t, g, unknown, or other
  misc_feature (490)..(490): n is a, c, t, g, unknown, or other
aagctggagctccccgcggtggcggccgctctagaactagtggatcccccgggctgcaggaattcgcacgagaccattacctagaacatcctaatcgaaaactctctcgcgcgtccgcgcccgcgcccgcggcctcgttcaatccgccagcgctcccccgccccccggtggtagcgggctctacggcagcgctcctctccggttcccctgcgctccgcgtcttcatctgtggcggccgacgctccgtcggtgtctcgtcggacggagcgagcggagctagggttccgtttcatgctcaggatcggcgagatctagggtctcgatttcagggtgattgtactggatagctgctgctgatattgcaagacaatgaaagctcatcagcagcaaggtaatgcatctggcacaggagcaaagaccaaatctttttttgataagatacaaagcctgaaagctggtgcacatatcancaaatcatcagggcatgtgnctgcaaagcgtaaaaaggtctctccttttgaatccctacccaaaggcagatagcatcaaagactggcagtcttattgaaagggccagcaaggggatgcttaagttggctgcctcgccacctatcccttgggaagacaaactccaatttttccataattgaaacctttcaggaattttgcggcaagaaaaccaattttttccctggtttgtt

SEQ ID NO: 32740 - DNA, 698 bp, Zea mays
  misc_feature: Ceres CLONE 1410104-F
  misc_feature: Encodes the peptide sequence at SEQ ID NO. 32741
tggagctccccgcggtggcggccgctctagaactagtggatcccccgggctgctggaattcccacaaaacctttacctaaaacttcctattcaaaaaaccaaaacaatcaataaactagcagaagtcagcgcctccctcctccgcccgtttcctcgagtgacaagaacccaaccactccgcgtcatcgtctgctgcccatgtaggaggagcgctgcttctccaactgggatctgcacgccgtcatgcgcttgggctgccgacgcctcctctccccgtcgcctgagaccgacccgttcgcttcgtttctcccgacgccgccgcagaatgataagcccgtggcgccagcgccgcctagagagccatagccacataccgcgcggcgcttccctgaccttggtgctgtcggcgtgcaagactgcgaagagctcctcagggccctgttagtcgaccagcctctcctgcatcagcctctgccaacgccagcgacaacgcctacgccaacgcctacggtaacgcctcccccaccatcacaacagcatcatgtacagccgactgtgacagccgtggacgtggctccaccccatgtgcgccccgctccgactaggtagcagcctagcgtgcgataggtgcccggtggcgtggctagatctaagagaatgacgtacctagagcaagaagtgctctggcacgttccgac

SEQ ID NO: 32741 - protein, 40 aa, Zea mays
  misc_feature: Ceres CLONE 1410104-F
MRLGCRRLLSPSPETDPFASFLPTPPQNDKPVAPAPPREP

SEQ ID NO: 32742 - DNA, 711 bp, Zea mays
  misc_feature: Ceres CLONE 1410105-F
  misc_feature: Encodes the peptide sequence at SEQ ID NO. 32743
  misc_feature (647)..(647): n is a, c, t, g, unknown, or other
  misc_feature (711)..(711): n is a, c, t, g, unknown, or other
aagctggagctccccgcggtggcggccgctctagaactagtggatcccccgggctgcaggaattcgcacgagaccattacctagaacatcctaatcgaaaagtccctgtccctccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcggccccgagccgtcgcgcggtcgcctccacatctcgtcgttcttcaaggtctttggcctccgccgttcttggacaggggcacaccactgtccaccggtgcccactacgcgaaatacgagtccctcgtgcggctccgtagggtggaagagatccatcaggcggtgagtgggaggggcgcgtccacaccccaaccggaggggaggggggcaatggcggccgtggcaggcccactctgcacgtggctcgtcgccgcgtgcttatctgcggcatgcgacgctgaagagcacaagcagaagcatttctgcgcaggcggaagccgcgctgggggcggtgtcatgctcggccagcgccgccgcctcggcgcgcggcgtcgcggcttggcgcgctctgnaatgactatggctgttgccttttacagctgaagaagtgtcattgaaaagaagaaacccgatatn

SEQ ID NO: 32743 - protein, 70 aa, Zea mays
  misc_feature: Ceres CLONE 1410105-F
  misc_feature (61)..(61): Xaa is any aa, unknown, or other
MAAVAGPLCTWLVAACLSAACDAEEHKQKHFCAGGSRAGGGVMLGQRRRLGARRRGLARSXMTMAVAFYS

SEQ ID NO: 32744 - DNA, 764 bp, Zea mays
  misc_feature: Ceres CLONE 1410106-F
  misc_feature: Translation starting site: 403
  misc_feature: SWISSPROT Homolog: EC 1.14.14.1 Unspecific monooxygenase
  misc_feature (542)..(542): n is a, c, t, g, unknown, or other
  misc_feature (576)..(576): n is a, c, t, g, unknown, or other
  misc_feature (577)..(577): n is a, c, t, g, unknown, or other
  misc_feature (609)..(609): n is a, c, t, g, unknown, or other
  misc_feature (688)..(688): n is a, c, t, g, unknown, or other
  misc_feature (689)..(689): n is a, c, t, g, unknown, or other
  misc_feature (695)..(695): n is a, c, t, g, unknown, or other
  misc_feature (739)..(739): n is a, c, t, g, unknown, or other
  misc_feature (749)..(749): n is a, c, t, g, unknown, or other
aaaagctggagctcaccgcggtggcggccgctctaaaactagtggatcccccgggctgcaggaattcgcacgagaccattacctaagaacatcctaatcgaaaacccccccccacccgcctttgctcagcagcagtagtaaagccacgcctgacagaacagctggttcatttctggttgctgccttgctggtggtagccctcggcgcaggcagccaagaacagagagagcgagatggatgtgaacgacgtgcttgctagtggtgcttggcggcggcgcttggctgccatgtggtggcgtcggtgctccaagaaccggcggtgtcgacggcctcccgccggggcctccgggttggccggtggtggggaacctgttccaggtgatccttcagcgacggcccttcatgtacgtggtgcgcgacctccgggagaagtacgggcccatcttcaccatgcggatggggcagcgcaccctcatcgtggtcacctcggcggagctcatccacgaggcgctggtgaagcagggccccatgttcgcgagccnggccgaagacagccccacccgcctcctcttcagnngtcgcaagtgcaccgtcaactttcgcgcctancgcccccctgtggcgtgctctgcgccgcaacttcgtcgccgagatcgtgtccccgcaccgcgtcagggctttctcctgnnatcggnagtgggccgtggacgcgcacttgcgccgcctctgcgcgagctcngcgcgaacgntgccgtgcgggtcat

SEQ ID NO: 32745 - DNA, 710 bp, Zea mays
  misc_feature: Ceres CLONE 1410107-F
  misc_feature: Encodes the peptide sequence at SEQ ID NO. 32746
  misc_feature (21)..(21): n is a, c, t, g, unknown, or other
aaagctggagctccccttggnggcggtcgctcagtcataatgtggcccccgggctgcaggaattcccacgagaccattacctagaacatcctaatcgaaaaatccgacccagtatcctttacaagtcaatgcgatgcgtctcctccttgctctatcgactatcgtagccgattccccgttgcaagtaactaaaactaagtctcaagtctgcagagtaaccggagtagcatagcactagcaagcaatggccgctctcacttccgctctcctcttcgccgccctcctcgtggccgcccagtacgtgctccgcttgctccactccttcctgtgggtcccgttccgcctggaacgccgcttccggcggcagggaatccggtggccaccacgaagcctggtctccggtaacgcagccgactaccgcgacctgctagccgccgccaggtccgcgcccctctcctccttccgccacaacggcgtcgtcgcccgcgccacgccgcaggacgcggtctggctggcgcggtacggccggccgttcgtgtactggttcggaacccggccgcgggtggcgatctccgacacggagctcgagaaggtcgggatgaccgactccacgaggggctttgataaggcggcctcgggcgggaacaacccgctcgacaggaagctcatcggcaggggcttcgtcgggatctcccgggagaacaagagca

SEQ ID NO: 32746 - protein, 155 aa, Zea mays
  misc_feature: Ceres CLONE 1410107-F
  misc_feature: SWISSPROT Homolog: EC 1.3.3.9 Secologanin synthase
MAALTSALLFAALLVAAQYVLRLLHSFLWVPFRLERRFRRQGIRWPPRSLVSGNAADYRDLLAAARSAPLSSFRHNGVVARATPQDAVWLARYGRPFVYWFGTRPRVAISDTELEKVGMTDSTRGFDKAASGGNNPLDRKLIGRGFVGISRENKS

SEQ ID NO: 32747 - DNA, 682 bp, Zea mays
  misc_feature: Ceres CLONE 1410108-F
  misc_feature: Encodes the peptide sequence at SEQ ID NO. 32748
caaagctggagctccccgcggtggcggccgctctagaactagtggatcccccgggctgcaggaattcgcacgagaccattacctagaacatcctaatcgaaaaacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcctgcgtccgagcgagcgggtcgaggtacggcggaaccgctacaaggtggcggttcacgcgtaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggttagtggggtttattcggatgataataaccttcagcttgaggccaccacacagttccgcaaattgctctctatagagaggagtccccccatcgaagaagttatcaaaacaggtgtagttccaagatttgtgcagtctctcaccagagaggatttcccccagctgcagtttgaagctgcatgggctctcacaaatattg

SEQ ID NO: 32748 - protein, 108 aa, Zea mays
  misc_feature: Ceres CLONE 1410108-F
  misc_feature (1)..(60): Pfam Name: IBB Pfam Description: Importin beta binding domain
  misc_feature (69)..(108): Pfam Name: Arm Pfam Description: Armadillo/beta-catenin-like repeat
MVEIRKSRREESLLKRRREGLQAQVPAPPSGVEKKLESLPAMVSGVYSDDNNLQLEATTQFRKLLSIERSPPIEEVIKTGVVPRFVQSLTREDFPQLQFEAAWALTNI

SEQ ID NO: 32749 - DNA, 718 bp, Zea mays
  misc_feature: Ceres CLONE 1410109-F
  misc_feature: Encodes the peptide sequence at SEQ ID NO. 32750
  misc_feature (595)..(595): n is a, c, t, g, unknown, or other
  misc_feature (614)..(614): n is a, c, t, g, unknown, or other
  misc_feature (681)..(681): n is a, c, t, g, unknown, or other
  misc_feature (684)..(684): n is a, c, t, g, unknown, or other
aaagctggagctccccgcggtggcggccgctctagaactagtggatcccccgggctgcaggaattcgcacgagaccattacctagaacatccatcgaaaactaactacttccctgtacgtggacgaggaccaaggagacagagagaaagcctggccgcgccgcccaccgtcgcctcgtcagtcgcctcctccatcctccctccccatcgacttcccaaatcccagccagatctcctcgtcctctggcccattctcttcatctccatgcatggatgaacaagagacggagggagacagatgcaaacatcgagactggggttgttatctgtctttgtagcagaagaaacagtcctaaaaaagaatggagagctcctcagataggagcaacgtttctcaggggaaccacctgggttatgcgagaagcacatccatggattccactggtcctcagttagctggtaggtctagctcaatgttgagtaggagaagtagcagacagggctcaaggggatccatcagcctctcaaggggagatgggggactccatactgagctcaatgaggcattctcttcaggtcggcgaatcatttgctangagacatcgatagctcagntctggctcaactcatcgaaaagtggtcgagttctatcacccgaagggcgatggtgatggagatacangtngaatctctgaacatcataagggtgggcccttgtt

SEQ ID NO: 32750 - protein, 102 aa, Zea mays
  misc_feature: Ceres CLONE 1410109-F
  misc_feature (78)..(78): Xaa is any aa, unknown, or other
  misc_feature (85)..(85): Xaa is any aa, unknown, or other
MESSSDRSNVSQGNHLGYARSTSMDSTGPQLAGRSSSMLSRRSSRQGSRGSISLSRGDGGLHTELNEAFSSGRRIICXETSIAQXWLNSSKSGRVLSPEGRW

SEQ ID NO: 32751 - DNA, 661 bp, Zea mays
  misc_feature: Ceres CLONE 1410111-F
  misc_feature: Encodes the peptide sequence at SEQ ID NO. 32752
  misc_feature (463)..(463): n is a, c, t, g, unknown, or other
  misc_feature (505)..(505): n is a, c, t, g, unknown, or other
tccccgcggtggcggccgctctagaactagttgatcccccgggctgcaggaattcgcacgagaccattacctagaacatcctaatcgaaaaagttaagtctcgttcactgcctgtgctgctcagtgctctgctcacacatcctcgtcgccaatggcggctcccgtccgggccatcccgctcccgtcgcccgtcctgtacccccgcatgtccttatggggccgcagcagctgcagccggcgacgtgcccccggagttcgcgcagcagtggaggcggcggagggtgcttcgcgggcgacggagcccgtggaggtggtcggcgtaagcagccgaaaggacgccgtcatcgacttctgcctgggctcacgcacgctgtcctccacccccatccgcttctggacagtacatgtgatggataatttctaagttcagttaatacaaaaaggtcatgaaactgatgcagtngtcagagacttggaacctcccttatttcttcatccctgcccnactgcggttattctttgttctagtgcaggacaggatgctgatcatattactgcaatggagttaactagcggtgtcaaatctgctggaaatctggctgcatcaaaattttgaagcccttctgcttccagggacaaagaagcaagtaaaggcagttga

SEQ ID NO: 32752 - protein, 90 aa, Zea mays
  misc_feature: Ceres CLONE 1410111-F
MAAPVRAIPLPSPVLYPRMSLWGRSSCSRRRAPGVRAAVEAAEGASRATEPVEVVGVSSRKDAVIDFCLGSRTLSSTPIRFWTVHVMDNF

SEQ ID NO: 32753 - DNA, 687 bp, Zea mays
  misc_feature: Ceres CLONE 1410116-F
  misc_feature: Encodes the peptide sequence at SEQ ID NO. 32754
  misc_feature (687)..(687): n is a, c, t, g, unknown, or other
gctctagatctagtggaggccccgggctgcaggaatcccacgagaccattacctagaacatcctaatcgaaaagccatgctcgtcgcaagtcccctgcgccaagtagccgccgccgggcatcccatccacctcccgtcctactccctgaaggaatgaacccccgttccaagcgccctataccgccgccatctcccgttcccctttcctttgttctctttcgtctgctgggcaaaccaacgccgccagccactggtcgatcacttccagccaaggagtggcggacgcgcagggcttggagtgtggcggacaggaggctcctgtagcggcagagacaggcacggacgagagaggtgagttctccgcacgatcggctgcgacaggggaacgacgcgcgcaactgtgcggactgggcgggcattaaacgcttaaacggcgatcaatcgtcgcttaatcgattgctgtcgggtactcctggcactccacaagaggttgacctccgatacagatattccatgaccggctgcatcggactgtgcgcggagcacaagacaaaggggggcggtcacttctcaacagatggactctcgcggggagaacaaatgaaccacaatctgcttgctggccccccaaatatgcaatgggcccaaaaccgccccaagggaggccacaatggccacaatttccan

SEQ ID NO: 32754 - protein, 57 aa, Zea mays
  misc_feature: Ceres CLONE 1410116-F
MTGCIGLCAEHKTKGGGHFSTDGLSRGEQMNHNLLAGPPNMQWAQNRPKGGHNGHNF

SEQ ID NO: 32755 - DNA, 676 bp, Zea mays
  misc_feature: Ceres CLONE 1410118-F
  misc_feature: Encodes the peptide sequence at SEQ ID NO. 32756
aaagctggagctccccgcggtggcggccgctctagaactagtggatcccccgggctgcaggaattcgcacgagaccattacctagaacatcctaatcgaaaaacctgattccttccgccttgtcagcgcagcgatccagacccacccgagccaacaacccatggccgccgcgacgccgcgtctcctgctcgcggacgcgggcctcaccctcgccgtcctcgccgccgcggtctcgccgtctctggcggaggggccgccggtgctgcaggacccggcggagctcctgcgccttgccaaggagccggccttcgcggactggatggtcggtgtgcggcggcggatccacgagaacccggagctggaatacgaggagttccagaccagcgagctcgtgcgccgggagctccacgccatgaggatcccctacaggcaccccttcgccgtcaccggcgtggtaacaacagtcggcaccggcggaccgcccttcgtagctctgcgggcggacatgaacgcgctgcccttgcaggaaagtgtgcagtgggaacacaagagcaaagtccctgggcagatgcatggatgtggacatgatgcacatgttgctatgctgttgagatctgctcacattcttcaggagcatcgagatgagttgaaggtacagtagttcttgactaccacc

SEQ ID NO: 32756 - protein, 166 aa, Zea mays
  misc_feature: Ceres CLONE 1410118-F
  misc_feature: SWISSPROT Homolog: EC 3.5.1.14 Aminoacylase
MAAATPRLLLADAGLTLAVLAAAVSPSLAEGPPVLQDPAELLRLAKEPAFADWMVGVRRRIHENPELEYEEFQTSELVRRELHAMRIPYRHPFAVTGVVTTVGTGGPPFVALRADMNALPLQESVQWEHKSKVPGQMHGCGHDAHVAMLLRSAHILQEHRDELKVQ

SEQ ID NO: 32757 - DNA, 775 bp, Zea mays
  misc_feature: Ceres CLONE 1410121-F
  misc_feature: Encodes the peptide sequence at SEQ ID NO. 32758
aagctggagctccccgcggtggcggccgctctagaactagtggatcccccgggctgcaggaattcgcacgagaccattacctagaacatcctaatctaaaagtgtctcttccccccaccactccgccaccggcgccgaagcagagcagccatgggccggctccgagcagcgcgtcgtcgccgtcatcatggtcggcggccccaccaaagggacgcggttccggccgctgtcgctgaacgtgcccaagccgctcttccctatcgccggccagcccatggtgcaccaccccatctccgcctgcagccggatcccccacctggcacagatatacctcatcgggttctatgaggagcgggagttcgcgctctatgtctcgtctatctcccacgagctcaggatccctgtcaggtacctacgagagggatagccctcacggtcagctggagggctctacagcttttagagatacatcatggaaggacagtccgtcacacataagtctgctgaatttgcgacggctggtctagcttcccttccttccaaaatgcttaaggccccttaaaagtatggaggaatgggtacttttctagccaacaagggatccggcaaagtccgcaaaccccttccggggatttgggacttgatcctgaaacaaaggaacgggtgcctatcgcggaaaacccgggaacttttggggaaaaccccaaaaatggggggaaaatattttttttcccccaattctttgggcccttgggggggttttaaaacaaaaaaa

SEQ ID NO: 32758 - protein, 79 aa, Zea mays
  misc_feature: Ceres CLONE 1410121-F
  misc_feature: SWISSPROT Homolog: EC 2.7.7.13 Mannose-1-phosphate guanylyltransferase
MVGGPTKGTRFRPLSLNVPKPLFPIAGQPMVHHPISACSRIPHLAQIYLIGFYEEREFALYVSSISHELRIPVRYLREG

SEQ ID NO: 32759 - DNA, 724 bp, Zea mays
  misc_feature: Ceres CLONE 1410126-F
  misc_feature: Encodes the peptide sequence at SEQ ID NO. 32760
  misc_feature (611)..(611): n is a, c, t, g, unknown, or other
  misc_feature (612)..(612): n is a, c, t, g, unknown, or other
  misc_feature (635)..(635): n is a, c, t, g, unknown, or other
  misc_feature (638)..(638): n is a, c, t, g, unknown, or other
  misc_feature (652)..(652): n is a, c, t, g, unknown, or other
  misc_feature (719)..(719): n is a, c, t, g, unknown, or other
caaagctggagctccccgcggtggcggccgctctagaactagtggatcccccgggctgcaggaattcgcacgagaccattacctagaacatcctaatcgaaaatccagtcttcgagtcctcgttgtgcctctcttgatctcctcgcgtccatggctcctgtgcgaggtgccaagaagaggaagcggccggagaagcccgccccggcgcctactccagggttgccgctgccgccgctgccggacggtagcgattggtggggcgtcttctaccgaagggttgcaggacattccccttttccaagagaacaccagaacatggagtctgtcctgaagatgtcaagaagaaccttcgactacatctgctcacttgttaagaaggacctgacaacaaagacatacggtttcagaaacttcaggtttggtgacaagaaagtccttggggtggaggatcaggtggcggtggctctgatgaggctgactactggtgagtcgctgcagaacataggaatgtggttttgcatgaaccactctgccatctcgaacatcacatggcggttcatcgagtccgtggaggagcgtgccatctgccacctgaaatggccgagccctgnnagagatgcgacatcaagacaggnttngacaagtttacggnctccctaactgctgcggcgcattgacacacacacatcctcatggtgtccctcgctcagcccaacagnaaggt

SEQ ID NO: 32760 - protein, 169 aa, Zea mays
  misc_feature: Ceres CLONE 1410126-F
  misc_feature (154)..(154): Xaa is any aa, unknown, or other
  misc_feature (162)..(162): Xaa is any aa, unknown, or other
  misc_feature (163)..(163): Xaa is any aa, unknown, or other
  misc_feature (168)..(168): Xaa is any aa, unknown, or other
MAPVRGAKKRKRPEKPAPAPTPGLPLPPLPDGSDWWGVFYRRVAGHSPFPREHQNMESVLKMSRRTFDYICSLVKKDLTTKTYGFRNFRFGDKKVLGVEDQVAVALMRLTTGESLQNIGMWFCMNHSAISNITWRFIESVEERAICHLKWPSPXRDATSRQXXTSLRXP

SEQ ID NO: 32761 - DNA, 872 bp, Zea mays
  misc_feature: Ceres CLONE 1410130-R
  misc_feature: Pfam Name: PHO4 Pfam Description: Phosphate transporter family
tttccaattgggtaccgggccccccctcgaggtcgacggtatcgataagcttttttttttttttttttcctgcagaggaatgagctcttattctaggatgattggcaatgaacaaagtcatgcgatatcattacaatttactagaataaatttgaccaaccacttacattacatctatatgtataacagctctacgagaagttacagtattcgaccttgtgatagacatacaaggtagtataaaaagttgaaaaaaataataattcaggagcctgtaccatgattatttgctgggaaacacttctaatttgctcagtttccaacaaaatggttatttggtcttggaaattcttgtaaatttctgggggaacgtgtggaaccaccccatctccttacctttgcgaaagaaaatcctttttccactgatcaaaattgtatgaagtgacaatgggctgtaccacttaaaagcagcccttttattttacaatccactcacatgaagtacgccagaattttggttaagatcaatgtgtagaagatagataggacagcaccaactgggattgtgaccaaccaggacgccacaatttcgcgaactgtctctgccctgactctatggagccctcctggaaaaccgacaaccattagcgcttcaacaaaatgtatccgtgggcaaatataggcaacccccacgctttggtggcaaacaaaactatctgaaaaggggtgggaaactctgcgggcaaaaccccccggggaggggggttaaattctcggggaatttttctttgccaactatgttggtcatattgaccccgtagatccccgccacttcgctggagagggtggggccaccatacacaaccacgaag

SEQ ID NO: 32762 - DNA, 847 bp, Zea mays
  misc_feature: Ceres CLONE 1410130-R2
  misc_feature (1)..(1): n is a, c, t, g, unknown, or other
  misc_feature (2)..(2): n is a, c, t, g, unknown, or other
nnggggggggggttagctcttattccaggatgattggcaatgaacaaagtcttgcgatatcattacaatttacaagaataaatttgaccaacccttacattacatctatatgtataacagctctacgagaagttacagtattcgaccttgtgatacacatacaaggtagtataaaaagttgaaaaaaataataattcaggagcctgtaccatgattatttgctgggaaacacttctaatttgctcagtttccaagaaaatggttatttggtcttggaaattcttgtaaatttctggtggaacttgtggaatcagtccatctctttacttttgcaaaagaaaatcctttttccactgatcaaaatttatgaagtgacaatgggctgtaccacttaaaagcagcccttttattttacaatccactcacatgaagtacgccagaattttggttaagatcaatgcgtagaagatagataggacagcaccaactggaattgtgaccaatcacgacgccacaatttcgcgaactgtctctgccctgactctattgagccctcttgcaaacccgacaccaatcaccgctccaacaagtgtatgcctggcagatatacgcaacccgagctttgatgcgaacaagactactgaagctgctgcaaactctgcggcaaagcccctggtaagtgttagttctgtgatccttctaccaattgttgatatcaccctgtatccccacattgttgaccccggaaactatccccaaaccacccccaagctagaacttccggggggtatgaacgatccccaccgctggctttgccacaccctttgaaggaatggacaaaacctta

SEQ ID NO: 32763 - DNA, 713 bp, Zea mays
  misc_feature: Ceres CLONE 1410134-F
  misc_feature (442)..(442): n is a, c, t, g, unknown, or other
  misc_feature (462)..(462): n is a, c, t, g, unknown, or other
  misc_feature (490)..(490): n is a, c, t, g, unknown, or other
  misc_feature (491)..(491): n is a, c, t, g, unknown, or other
  misc_feature (505)..(505): n is a, c, t, g, unknown, or other
  misc_feature (508)..(508): n is a, c, t, g, unknown, or other
  misc_feature (509)..(509): n is a, c, t, g, unknown, or other
aaagctggagctccccgcggtggcggccgctctagaactagtggatcccccgggctgcaggaattcgcacgagaccattacctagaacatcctaatcgaaaaaaggaaccaaacagcgcaacacacgaacacaccaggcggcaggctccaccccgtccttttcctgccttttccccccgtcgagttaatccatccagtcgccaaaagctttgctaaatttcacgtgtctcgcctcgagtcgtccctaatccgacgatgccttgttctactcctaaaaaaacccaaagatcctgactttctcttgctgctagcctcccttttcccttctcccttaatcgcactgtggaagctcttcgctgtcacccccaccaccctcggcgctcttttttagcattttcctgggctctggactccaaaatccagccttttgttgcttctctgnctctgctgaatgggtccccnggtccagactcttgattgctcctcgggnnggtccgtccatggncgnnactgccttgcaatggaaaccagttggggccaactcaatggaggggaaaaccccccctcaatcctgcccaggtggccgggaaaatgccacaaaaaggcccggttttgaaaaaacccgggaaaaaggcaaaaacccccccccacgcaaaaacccccccggggaagggaagtttttctttggttggccaaggaaaaaatttcccttt

SEQ ID NO: 32764 - DNA, 667 bp, Zea mays
  misc_feature: Ceres CLONE 1410136-F
  misc_feature: Encodes the peptide sequence at SEQ ID NO. 32765
  misc_feature (545)..(545): n is a, c, t, g, unknown, or other
  misc_feature (553)..(553): n is a, c, t, g, unknown, or other
aaagctggagctccccgcggtggcggccgctctagaactagtggatcccccgggctgcaggaattcgcacgagaccattacctagaacatcctaatcgaaaaaaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagcaaatggtttctggtgcgggtcatggtgggtacggcggcggcgacgacgggcaggccgtcgacttccggggcaacccggcggacaagtcgaggaccggaggctggctgggcgccgggctgatcctgggcacggagctggcggagcgcgtgtgcgtgatgggcatctccatgaacctggtgacgtacctcgtcggcgagctgcacctctccaactgcaagtccgccaccgtggtgaccaacttcatgagcacgctcaacctgctcgccctcgtcggcggcttcctcgccgacgccaagntcggacgntacctcatcatcgacatctccgacacaatcgccgacacgggcgtgagcttgctgactgtggacacgacggtgccgagcatgcgtcccgcggccgtgctggacgcctgcgggccc

SEQ ID NO: 32765 - protein, 139 aa, Zea mays
  misc_feature: Ceres CLONE 1410136-F
  misc_feature (99)..(99): Xaa is any aa, unknown, or other
MVSGAGHGGYGGGDDGQAVDFRGNPADKSRTGGWLGAGLILGTELAERVCVMGISMNLVTYLVGELHLSNCKSATVVTNFMSTLNLLALVGGFLADAKXGRYLIIDISDTIADTGVSLLTVDTTVPSMRPAAVLDACGP

SEQ ID NO: 32766 - DNA, 657 bp, Zea mays
  misc_feature: Ceres CLONE 1410140-F
  misc_feature: Encodes the peptide sequence at SEQ ID NO. 32767
  misc_feature (407)..(407): n is a, c, t, g, unknown, or other
  misc_feature (551)..(551): n is a, c, t, g, unknown, or other
  misc_feature (632)..(632): n is a, c, t, g, unknown, or other
  misc_feature (633)..(633): n is a, c, t, g, unknown, or other
tggagctccccgcggtggcggccgctctagaactagtggatcccccgggctgcaggaattcgcacgagaccattacctagaacatcctaaaaaaaacataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcngggacatggcccgcttcgcggacacgctgtcggacaccttcccgggctcgcccgcgcagcgcttcgtgtcggaggacggcgtcatcaactcgcgccccgcggtgctgggcggcggcagctgcatcaacgccggcttctacacgncggccagcgacgactacgtgcggggcgtcgggtgggacctgggcgccgccggaggcgcgtaccccgttggtgaagacctgnntgcttccaacccgaagctgggccc

SEQ ID NO: 32767 - protein, 171 aa, Zea mays
  misc_feature: Ceres CLONE 1410140-F
  misc_feature: SWISSPROT Homolog: EC 4.1.2.10 Mandelonitrile lyase
  misc_feature (89)..(89): Xaa is any aa, unknown, or other
  misc_feature (137)..(137): Xaa is any aa, unknown, or other
  misc_feature (164)..(164): Xaa is any aa, unknown, or other
MSGRSRHFTMSTLLATSFFFVLLCSSLQVRGVNYTFVKDAALAPSVSYYDYIIVGGGTAGCPLAATLSERFRVLLLERGASPYDDDRIXDMARFADTLSDTFPGSPAQRFVSEDGVINSRPAVLGGGSCINAGFYTXASDDYVRGVGWDLGAAGGAYPVGEDLXASNPKLG

SEQ ID NO: 32768 - DNA, 712 bp, Zea mays
  misc_feature: Ceres CLONE 1410141-F
  misc_feature: Encodes the peptide sequence at SEQ ID NO. 32769
  misc_feature (375)..(375): n is a, c, t, g, unknown, or other
  misc_feature (464)..(464): n is a, c, t, g, unknown, or other
  misc_feature (467)..(467): n is a, c, t, g, unknown, or other
  misc_feature (470)..(470): n is a, c, t, g, unknown, or other
  misc_feature (473)..(473): n is a, c, t, g, unknown, or other
  misc_feature (476)..(476): n is a, c, t, g, unknown, or other
  misc_feature (552)..(552): n is a, c, t, g, unknown, or other
  misc_feature (595)..(595): n is a, c, t, g, unknown, or other
  misc_feature (606)..(606): n is a, c, t, g, unknown, or other
  misc_feature (636)..(636): n is a, c, t, g, unknown, or other
aagctggagctccccgcggtggcggccgctctagaactagtggatcccccgggctgcaggaattcgcacgagaccattacctagaacatcctaatcgaaaaaagcgtgctagggtttcccccgtcttatcgcttcctcgttcccgcagccgccgcccaaaccctagcaaacccgtcctccgccatggccgacgaccactactcgtccaagcggaagtacgacgacccctcgccgccgccgcggcgcacggggttctcttctggcccgccgcctgcctcgccgcccgctggcggcgccccgtcgtacaacagcgttgcgccgccccccgatgagatccagctcgcgaagcagcgtgcgcaggagatcgcggcgcgnatctttaacgccgcagaggccaagcgccctcgcgtcgacaacggcgacgatgacgtcggcggcttcggtggaggaagttccctgggtgncancgntgntgntggtgggtgccgcatcgggggcgcaggacttggcttctcgtcctctgccggtggtgggcatggggcttctatcccnacgttatcttctcagagcagtgcaccacagtactcatatggtngaacatcaggntacaagcaaaaagatggatttccaatgggnagggttggtgtttattattggaaaggctggggaaactatagggatatccactttcatcaggagcaaagattcaggt

SEQ ID NO: 32769 - protein, 176 aa, Zea mays
  misc_feature: Ceres CLONE 1410141-F
  misc_feature (94)..(94): Xaa is any aa, unknown, or other
  misc_feature (95)..(95): Xaa is any aa, unknown, or other
  misc_feature (96)..(96): Xaa is any aa, unknown, or other
  misc_feature (97)..(97): Xaa is any aa, unknown, or other
  misc_feature (98)..(98): Xaa is any aa, unknown, or other
  misc_feature (138)..(138): Xaa is any aa, unknown, or other
MADDHYSSKRKYDDPSPPPRRTGFSSGPPPASPPAGGAPSYNSVAPPPDEIQLAKQRAQEIAARIFNAAEAKRPRVDNGDDDVGGFGGGSSLGXXXXXGGCRIGGAGLGFSSSAGGGHGASIPTLSSQSSAPQYSYGXTSGYKQKDGFPMGRVGVYYWKGWGNYRDIHFHQEQRFR

SEQ ID NO: 32770 - DNA, 719 bp, Zea mays
  misc_feature: Ceres CLONE 1410142-F
  misc_feature: Encodes the peptide sequence at SEQ ID NO. 32771
  misc_feature (169)..(169): n is a, c, t, g, unknown, or other
  misc_feature (379)..(379): n is a, c, t, g, unknown, or other
  misc_feature (411)..(411): n is a, c, t, g, unknown, or other
  misc_feature (719)..(719): n is a, c, t, g, unknown, or other
tggagctccccgcggtggcggccgctctagaactagtggatcccccgggctgcaggaattcgcacgagaccattacctagaacatcctaatcgaaaacccgttagttgcccagccccagacccagagaggagggcgacgaacacacggtgacggagagccgagtggcgnggacaggagcgcggagggaggaggaaacaaagcagaaaaagcaacccccgtcttccatcttcgcggaacgacgcccatctggcctgcccatctctttcgtgctcctaccccccgccttcttccgccctcaaggcttttccttccttctcatcttctgctcggaccggggacgggccgacggggacagggacaaaaggtggtgcgatctgnttcggcacagagagagagagagagcgacgganggtggcagggccgccgcgccggtgagccgacccccagccatggcattgccggctccccccgtccgcctggcgctgctgctgctcgtcgcgctgccattctgcgccgcgcatccccgggccgggggccttcaatgctcctcgccacttccagacggccgcgctccactctgatggatttggcttggtggcaaaaaggtcgattgctgaagctcctgctgacattcacgccctacgaatagttcctttgtggtggggggcgataggaactattcgaaggaccctttggatgggtttcaggaaataccggn

SEQ ID NO: 32771 - protein, 43 aa, Zea mays
  misc_feature: Ceres CLONE 1410142-F
MALPAPPVRLALLLLVALPFCAAHPRAGGLQCSSPLPDGRAPL

SEQ ID NO: 32772 - DNA, 719 bp, Zea mays
  misc_feature: Ceres CLONE 1410143-F
  misc_feature: Translation starting site: 203
  misc_feature (595)..(595): n is a, c, t, g, unknown, or other
  misc_feature (631)..(631): n is a, c, t, g, unknown, or other
  misc_feature (656)..(656): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (676)..(676): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (697)..(697): n is a, c, t, g, unknown, or other
  misc_feature (699)..(699): n is a, c, t, g, unknown, or other
  misc_feature (706)..(706): n is a, c, t, g, unknown, or other
  misc_feature (714)..(714): n is a, c, t, g, unknown, or other
aaactggagctccccgcggtggcggccgctctagaactagtggatcccccgggctgcaggaattcgcacgagaccattacctagaacatcctaatcgaaaaccgtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgactgggccagggacgatcactcgctctacaacgccttgagtacttacggcgaggaggtcgagtctaagatcatcctcgtatgctgagaaccagagatcccgcgacttcgacattcacacattctccagcgatgatgctgatgcgaaagccatcgagggaatgaacgggaagggaactggacgcccgcaaaatcaccgtcaacgaggcccaggtccggcggggggtcgtgcaggcggcgggggggggtatacggtgttggcccgtggaagctttgggtaacggaattggggggccgcccttaattgcatggggcccctaaacgttgtgggaggggggcaaacgcgggncggggggggatttaaattgggggggggggaaaaggnctaagggggggggaaacccgggggnggnnnnnnnnnnnnaaaacnccaaagnnnnatttggggggnancgggagngggggggnccccg

SEQ ID NO: 32773 - DNA, 784 bp, Zea mays
  misc_feature: Ceres CLONE 1410145-F
  misc_feature: Encodes the peptide sequence at SEQ ID NO. 32774
  misc_feature (425)..(425): n is a, c, t, g, unknown, or other
  misc_feature (434)..(434): n is a, c, t, g, unknown, or other
  misc_feature (449)..(449): n is a, c, t, g, unknown, or other
  misc_feature (467)..(467): n is a, c, t, g, unknown, or other
  misc_feature (483)..(483): n is a, c, t, g, unknown, or other
  misc_feature (487)..(487): n is a, c, t, g, unknown, or other
  misc_feature (521)..(521): n is a, c, t, g, unknown, or other
  misc_feature (668)..(668): n is a, c, t, g, unknown, or other
tggagctccccgcggtggcggccgctctagaactagtggatcccccgggctgcaggaattcgcacgagaccattacctagaacatcctaatcgaaaagcattgcattgcataaacctctcgtgggaagtgcaaacaccaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggcaccgtccccttctacccgtccgcggagtccgccgccgccgcgcactgcgacggcacgctgtacccggagctctgcctgtcgacactcgcggacatccccgacctacancagaagcgnctcccggacgtctcntggcgcggcgtgaaccgnaccgaaggaacggggntggnccgccacggtcagggactgctcgtactactgggnagaacaggtcccttggccggcgccgggaaccccctgggcattaagaatggcctggaaagtgttggcccaccaccaagggaaaaaaattccgggcaaaaaccgccaaactggggggcccccgcgccgggaggggggcgccgccccccnggggttttcccaaagggcccccggggccgccaaaaaaaggaacccgggatgagagggtttttttgggggaacatacaaacaaaaaaacctcccctagaagggtttctgaaaaaaaa

SEQ ID NO: 32774 - protein, 183 aa, Zea mays
  misc_feature: Ceres CLONE 1410145-F
  misc_feature (64)..(64): Xaa is any aa, unknown, or other
  misc_feature (84)..(84): Xaa is any aa, unknown, or other
  misc_feature (85)..(85): Xaa is any aa, unknown, or other
MPPIPKRGEHLLVLLIVACAATAATAAGTVPFYPSAESAAAAHCDGTLYPELCLSTLADIPDLXQKRLPDVSWRGVNRTEGTGXXRHGQGLLVLLGRTGPLAGAGNPLGIKNGLESVGPPPREKNSGQKPPNWGAPAPGGGRRPPGVFPKGPRGRQKKEPGMRGFFWGNIQTKKPPLEGFLKK

SEQ ID NO: 32775 - DNA, 747 bp, Zea mays
  misc_feature: Ceres CLONE 1410146-F
  misc_feature: Encodes the peptide sequence at SEQ ID NO. 32776
  misc_feature (371)..(371): n is a, c, t, g, unknown, or other
  misc_feature (379)..(379): n is a, c, t, g, unknown, or other
aaagctggagctccccgcggtggcggccgctctagaactagtggatcccccgggctgcaggaattcgcacgagaccattacctagaacatcctaatcgaaaaacctaatatcgatttccgccagcggttttcctcatttttttttctctccctctcttgcccggcgatcggtcgggatcgattcgagcagatggcggcggcatgggcagtgctggcggcggtgctcgtcgcagcgcaggtggcgtctgctgcgccggtcacggcgctcgcgttcctctgggcgcccaagaactacggattcctctctgatgatgctaacgaggtagtcgactatcacacaatctcaccaaagaacttagctaaatctgttncttggagnaaggtgactgggcaacctttatgtggtcacgggagaatatgagagcctggtgatgtgccctttgcttttaatgcctcaaggttccatcattcgacttatggaagagtaagcccgttgttcccagttttgccaaaactttggaagctcctttcacaaaaacaaagtttccgggggttccccctatgttccccccttcacggggggaaaacttagggggtttttgttccccgctttccggaaaaatgggaaagggggttttaaaaaaaaccttttcccaaaaaaaaggggggcgggggggggggaaatataaaaaattaaaccagggggtgtattttttggggggggggggggagaaaccccccgggggg

SEQ ID NO: 32776 - protein, 76 aa, Zea mays
  misc_feature: Ceres CLONE 1410146-F
  misc_feature (61)..(61): Xaa is any aa, unknown, or other
  misc_feature (63)..(63): Xaa is any aa, unknown, or other
MAAAWAVLAAVLVAAQVASAAPVTALAFLWAPKNYGFLSDDANEVVDYHTISPKNLAKSVXWXKVTGQPLCGHGRI

SEQ ID NO: 32777 - DNA, 748 bp, Zea mays
  misc_feature: Ceres CLONE 1410147-F
  misc_feature: Encodes the peptide sequence at SEQ ID NO. 32778
  misc_feature (205)..(205): n is a, c, t, g, unknown, or other
  misc_feature (594)..(594): n is a, c, t, g, unknown, or other
aaagctggagctccccgcggtggcggccgctctagaacaagtggatcccccgggctgcaggaattcgcacgagaccattacctagaacatcctaatcgaaaagtacacaagctcgtctcgcaccagaaacccgcgaatcaatcccgaatcccgatcgaccggcggcgcgggaggcgatgccggacaaggcggtggacaacgtctnggaggccgcggtgggggcccacttcagcggcctccgcctcgaggcgctgcgcctctccacctctgcgccctcttccccttcctcctcccccgccgccgcggagcacacgcactccaacggagccgtctacgccaacggcaccaccgagcttccctctcctgccgctgcccggcagccttccgtcatcggggtttctggagggacggcgtcggataagacgacgctgtgcagacatgatcatccagcagctgcacgaccaccgtgtcgtgctcgttaaccaggattcgttttaccgtgtccttactgctgaagagtctgcacacgcacaagactataattttgatcaccctgatgcatttgatacagagcaacttctagaatgcatggcncagctgagatgtgctcaacctgtaaatgttcctatatatgatttcaagaaacatcgacggtgttctgaaagctttagaaaggtcaatgcatcaaacgtcattattttggagggcattttactcttccatgaccaaagaggtcccaatctgatgt

SEQ ID NO: 32778 - protein, 103 aa, Zea mays
  misc_feature: Ceres CLONE 1410147-F
  misc_feature: SWISSPROT Homolog: EC 2.7.1.48 Uridine kinase
MIIQQLHDHRVVLVNQDSFYRVLTAEESAHAQDYNFDHPDAFDTEQLLECMAQLRCAQPVNVPIYDFKKHRRCSESFRKVNASNVIILEGILLFHDQRGPNLM

SEQ ID NO: 32779 - DNA, 732 bp, Zea mays
  misc_feature: Ceres CLONE 1410149-F
  misc_feature: Translation starting site: 257
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (308)..(308): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (398)..(398): n is a, c, t, g, unknown, or other
  misc_feature (399)..(399): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (431)..(431): n is a, c, t, g, unknown, or other
  misc_feature (436)..(436): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (444)..(444): n is a, c, t, g, unknown, or other
  misc_feature (445)..(445): n is a, c, t, g, unknown, or other
  misc_feature (459)..(459): n is a, c, t, g, unknown, or other
  misc_feature (464)..(464): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (489)..(489): n is a, c, t, g, unknown, or other
  misc_feature (498)..(498): n is a, c, t, g, unknown, or other
  misc_feature (500)..(500): n is a, c, t, g, unknown, or other
  misc_feature (516)..(516): n is a, c, t, g, unknown, or other
  misc_feature (517)..(517): n is a, c, t, g, unknown, or other
  misc_feature (519)..(519): n is a, c, t, g, unknown, or other
  misc_feature (520)..(520): n is a, c, t, g, unknown, or other
  misc_feature (530)..(530): n is a, c, t, g, unknown, or other
  misc_feature (539)..(539): n is a, c, t, g, unknown, or other
  misc_feature (543)..(543): n is a, c, t, g, unknown, or other
  misc_feature (546)..(546): n is a, c, t, g, unknown, or other
  misc_feature (551)..(551): n is a, c, t, g, unknown, or other
  misc_feature (552)..(552): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (568)..(568): n is a, c, t, g, unknown, or other
  misc_feature (572)..(572): n is a, c, t, g, unknown, or other
  misc_feature (573)..(573): n is a, c, t, g, unknown, or other
  misc_feature (578)..(578): n is a, c, t, g, unknown, or other
  misc_feature (579)..(579): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (602)..(602): n is a, c, t, g, unknown, or other
  misc_feature (603)..(603): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (627)..(627): n is a, c, t, g, unknown, or other
  misc_feature (632)..(632): n is a, c, t, g, unknown, or other
  misc_feature (640)..(640): n is a, c, t, g, unknown, or other
  misc_feature (642)..(642): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (651)..(651): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (671)..(671): n is a, c, t, g, unknown, or other
  misc_feature (676)..(676): n is a, c, t, g, unknown, or other
  misc_feature (677)..(677): n is a, c, t, g, unknown, or other
  misc_feature (679)..(679): n is a, c, t, g, unknown, or other
  misc_feature (682)..(682): n is a, c, t, g, unknown, or other
  misc_feature (684)..(684): n is a, c, t, g, unknown, or other
  misc_feature (691)..(691): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (704)..(704): n is a, c, t, g, unknown, or other
  misc_feature (706)..(706): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (729)..(729): n is a, c, t, g, unknown, or other
aagctggagctccccgcggtggcggccgctctagaactagtggatcccccgggctgcaggaattcgcacgagaccattacctagaacatcctaatcgaaaaacttctggtgaaattgcagatctcaccttagttgcctcctccgtcttcgctccctccgcagcgtcagatcggccgtcgctcgccgagccctagcggcgccgatctcagcccgtaccagtcttgcagatcggggtcgcgccgcggcggcaagaacgatggccgaggaggcaatgaccctggagacggcgcgnnnnnnnnnnncnnngngnnnnnnnnnnnnnnnnnngnnnnnnnnccnnnnnngnnnnnnnnnnnnnnnnnnnnnnnnnnngggggggggggnnnnnnnnnnnnngnnggnnnnnnggnnnnnnnnnnnnnggggggggnggggngnnnnngnngggggggggggggnggggnggggnnngggnnngggnnngggggnggggggggngngggggggggggggggnngnngggggggggnggggggggngggnggnggggnnggggnnnggggggggngggnnggggnnggggggggggnnnnnnggggggnnggnnngnnnnngggnnnngggggnggggngggggggngnggnnngggngnnnnnnggnnnngnnnngnggggnngnggngnggggggnggggggnnnnggngnggggnnnnnngggggnnnggggnggg

SEQ ID NO: 32780 - DNA, 757 bp, Zea mays
  misc_feature: Ceres CLONE 1410150-F
  misc_feature: Encodes the peptide sequence at SEQ ID NO. 32781
  misc_feature (326)..(326): n is a, c, t, g, unknown, or other
  misc_feature (442)..(442): n is a, c, t, g, unknown, or other
  misc_feature (473)..(473): n is a, c, t, g, unknown, or other
  misc_feature (474)..(474): n is a, c, t, g, unknown, or other
  misc_feature (497)..(497): n is a, c, t, g, unknown, or other
  misc_feature (526)..(526): n is a, c, t, g, unknown, or other
  misc_feature (527)..(527): n is a, c, t, g, unknown, or other
  misc_feature (529)..(529): n is a, c, t, g, unknown, or other
  misc_feature (530)..(530): n is a, c, t, g, unknown, or other
  misc_feature (541)..(541): n is a, c, t, g, unknown, or other
  misc_feature (542)..(542): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (555)..(555): n is a, c, t, g, unknown, or other
  misc_feature (602)..(602): n is a, c, t, g, unknown, or other
  misc_feature (623)..(623): n is a, c, t, g, unknown, or other
  misc_feature (639)..(639): n is a, c, t, g, unknown, or other
  misc_feature (687)..(687): n is a, c, t, g, unknown, or other
  misc_feature (715)..(715): n is a, c, t, g, unknown, or other
  misc_feature (718)..(718): n is a, c, t, g, unknown, or other
tggagctccccgcggtggcggccgctctagaactagtggatcccccgggctgcaggaattcgcacgagaccattacctagaacatcctaatcgaaaaaaaaataggaaacgagcaaaggtctggcgagctacctaccaataaactaccatctccacaaacaggctagcacgtagctatatgccagaactgacctagtagaggatcgatcgcagatggtgtttcctgccatcctccccaaggtggccgcacgatggctcttcacgttctaccgcgccgccagaaagctcaggcgccacgccttccagctctactaccgcaacaccgncgcccaagccggtcgtccgccgtctcgaacaacaaggggcccggggcggccgcccactgtcactggccgccgcccgccttcaagaaccggcgccgccatccctggacgccggcggncgggaaacggttgtgtgccgacattgcacgnngcgccctggctggcgctccaccngcgctcttcccctactttcatgctggggnncnntggggagaggnnggnnnagcctcgncccgcggccatggctgctggctctgcgccttccccccctcgtctggncggctcggggagcgccgccgncgcccggcgtccgggntgatggcgttcgtcccccttcgcggggctcaggccccggggacggggncctcgtgggcccgcgccctcctgccccngcnctacctggggcagctcagcgcgctggggtacggcagccc

SEQ ID NO: 32781 - protein, 142 aa, Zea mays
  misc_feature: Ceres CLONE 1410150-F
  misc_feature (38)..(38): Xaa is any aa, unknown, or other
  misc_feature (77)..(77): Xaa is any aa, unknown, or other
  misc_feature (87)..(87): Xaa is any aa, unknown, or other
  misc_feature (95)..(95): Xaa is any aa, unknown, or other
  misc_feature (105)..(105): Xaa is any aa, unknown, or other
  misc_feature (106)..(106): Xaa is any aa, unknown, or other
  misc_feature (110)..(110): Xaa is any aa, unknown, or other
  misc_feature (111)..(111): Xaa is any aa, unknown, or other
  misc_feature (112)..(112): Xaa is any aa, unknown, or other
  misc_feature (130)..(130): Xaa is any aa, unknown, or other
  misc_feature (137)..(137): Xaa is any aa, unknown, or other
MVFPAILPKVAARWLFTFYRAARKLRRHAFQLYYRNTXAQAGRPPSRTTRGPGRPPTVTGRRPPSRTGAAIPGRRRXGNGCVPTLHXAPWLALHXRSSPTFMLGXXGERXXXPRPAAMAAGSAPSPPRLXGSGSAAXARRPG

SEQ ID NO: 32782 - DNA, 789 bp, Zea mays
  misc_feature: Ceres CLONE 1410152-F
  misc_feature: Encodes the peptide sequence at SEQ ID NO. 32783
  misc_feature (386)..(386): n is a, c, t, g, unknown, or other
  misc_feature (404)..(404): n is a, c, t, g, unknown, or other
  misc_feature (405)..(405): n is a, c, t, g, unknown, or other
  misc_feature (422)..(422): n is a, c, t, g, unknown, or other
  misc_feature (423)..(423): n is a, c, t, g, unknown, or other
  misc_feature (488)..(488): n is a, c, t, g, unknown, or other
  misc_feature (556)..(556): n is a, c, t, g, unknown, or other
  misc_feature (557)..(557): n is a, c, t, g, unknown, or other
  misc_feature (575)..(575): n is a, c, t, g, unknown, or other
  misc_feature (690)..(690): n is a, c, t, g, unknown, or other
  misc_feature (691)..(691): n is a, c, t, g, unknown, or other
  misc_feature (761)..(761): n is a, c, t, g, unknown, or other
  misc_feature (773)..(773): n is a, c, t, g, unknown, or other
aaagctggagctccccgcggtggcggccgctctagaactagtggatcccccgggctgcaggaattcgcacgagaccattacctagaacatcctaatcaaaagacaaaatagtaaaaaactcgaccaggtgccccacggcggtgccggcgatggcaacccgctactggatcgtctctctccccgtgcagtctcccggcgccaccgcgacctcgctttggtcgcgcctgcaggatggcatctcccgccactccttcgacaccccgctgtaccggttcaacgtcccggacctccgcgtcggcaccctcgactccctcctcgcgctcagcgatgacctcgtcaagtcaaacgtgttccgtcgagggcgtttcgcacaagaatccggaggncagatcgaagacctgagnncgcggccggaggcgtcnnacagcggggccctcaaaccgggtcgatggggcgggttcccgtcgacacctacctcaccaaaaggnttccgtgggggggggattggaggggcaaggtacccccaccaatgtcgtcggccttccaagggagaatnncgtcggcagcatccccangtcgcagggtcgcccagggaatcgaggatgggacccttggaagggttcgaagcagcggaatataaacaaatggtaaggaggccagctttactgcaatcaaagaaaagcaaagggnnaagctttaaacagttcgtgaccttttcaatctggtaaacccaaagggatatggtctgctcagagatctantacctttctgtnatttggtccgagatcc

SEQ ID NO: 32783 - protein, 192 aa, Zea mays
  misc_feature: Ceres CLONE 1410152-F
  misc_feature: SWISSPROT Homolog: EC 3.6.3.14 H(+)-transporting two-sector ATPase
  misc_feature (85)..(85): Xaa is any aa, unknown, or other
  misc_feature (86)..(86): Xaa is any aa, unknown, or other
  misc_feature (92)..(92): Xaa is any aa, unknown, or other
  misc_feature (136)..(136): Xaa is any aa, unknown, or other
  misc_feature (142)..(142): Xaa is any aa, unknown, or other
  misc_feature (181)..(181): Xaa is any aa, unknown, or other
MATRYWIVSLPVQSPGATATSLWSRLQDGISRHSFDTPLYRFNVPDLRVGTLDSLLALSDDLVKSNVFRRGRFAQESGGQIEDLXXRPEASXSGALKPGRWGGFPSTPTSPKGFRGGGIGGARYPHQCRRPSKGEXRRQHPXVAGSPRESRMGPLEGFEAAEYKQMVRRPALLQSKKSKGXSFKQFVTFSIW

SEQ ID NO: 32784 - DNA, 809 bp, Zea mays
  misc_feature: Ceres CLONE 1410155-F
  misc_feature (300)..(300): n is a, c, t, g, unknown, or other
  misc_feature (301)..(301): n is a, c, t, g, unknown, or other
  misc_feature (354)..(354): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (378)..(378): n is a, c, t, g, unknown, or other
  misc_feature (380)..(380): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (420)..(420): n is a, c, t, g, unknown, or other
  misc_feature (421)..(421): n is a, c, t, g, unknown, or other
  misc_feature (425)..(425): n is a, c, t, g, unknown, or other
  misc_feature (428)..(428): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (498)..(498): n is a, c, t, g, unknown, or other
  misc_feature (508)..(508): n is a, c, t, g, unknown, or other
  misc_feature (509)..(509): n is a, c, t, g, unknown, or other
  misc_feature (522)..(522): n is a, c, t, g, unknown, or other
  misc_feature (615)..(615): n is a, c, t, g, unknown, or other
  misc_feature (619)..(619): n is a, c, t, g, unknown, or other
  misc_feature (620)..(620): n is a, c, t, g, unknown, or other
  misc_feature (705)..(705): n is a, c, t, g, unknown, or other
  misc_feature (706)..(706): n is a, c, t, g, unknown, or other
tggagctccccgcggtggcggccgctctagaactagtggatcccccgggctgcaggaattcgcacgagaccattacctagaacatcctaatcgaaaactagctgatcgcgcgcgcacagggcgagcggacaagaaagcttgctttgtgctcaccgggggcacggaccccctgcgatggaagccgtcagcgtcactcctgcccccggggcggcgcctgagaagaagaagctgcttgacctcagggaccccttccccgccgccgcgaacgagggagcctaggcgtcccttcctccatattcnntcattcaaacaaaagagacttagccagagggaccctggctataggattcagcnagtaccttcaaattcccnnnttcncntccnnnnnttttnnnnttaaagtaagggggggagagaggnncatnccncggaggggggaggagggcggaggaggctggaaggagtccccccnnnnagagagttnnnnnnnnnnntttnttgggggggnntagggtcctagantggggggtggggagggttggaggggggggcgggggggtggctggtggggggggggggggaggggggcgatttagttggaagggagaggagggntctnntaggggggggggctcagggcgggggggaggggggggatgggggcgcggaggaggagtgaacaaggggcgggagaggagggggggnngcgggcacccccggccgatgagtccgggggggggggggaggccggcttgtggggatcgtgggggggggggcaaagggggagaggtgggcggcaatgaggtgcg

SEQ ID NO: 32785 - DNA, 672 bp, Zea mays
  misc_feature: Ceres CLONE 1410157-F
  misc_feature: Translation starting site: 300
  misc_feature: SWISSPROT Homolog: EC 2.7.11.1 Non-specific serine/threonine protein kinase
  misc_feature (568)..(568): n is a, c, t, g, unknown, or other
  misc_feature (588)..(588): n is a, c, t, g, unknown, or other
  misc_feature (595)..(595): n is a, c, t, g, unknown, or other
  misc_feature (619)..(619): n is a, c, t, g, unknown, or other
  misc_feature (620)..(620): n is a, c, t, g, unknown, or other
aaagctggagctccccgcggtggcggccgctctagaactagtggatcccccgggctgcaggaattcgcacgagaccattacctagaacatcctaaaaaaaatcgatcagtcgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatgggagaagaagccgaccatcctcatgaacaggtacgagctcgggcgcacgctcgggcagggcaccttcgccaaggtgtaccacggccggaacctcgcgtccggcgagagcgtggccatcaagtcatcgacaaggagaaggtgatgcgcgtcggcatgatcgaccagatcaagcgcgagatctccgtcatgcgcctcgtccgccaccccaacgtcgtgcagctggcacgaggtgatggccagcaagagcaagaatacttcgccatggnagtacggtcccgggggcggngagctcnttcgccgcgtcggcccgcggcggnnttaagggagacgccccgcgagaaagtacttcaccaggttcgggcggggggcc

SEQ ID NO: 32786 - DNA, 759 bp, Zea mays
  misc_feature: Ceres CLONE 1410161-F
  misc_feature: Encodes the peptide sequence at SEQ ID NO. 32787
  misc_feature (267)..(267): n is a, c, t, g, unknown, or other
  misc_feature (305)..(305): n is a, c, t, g, unknown, or other
  misc_feature (399)..(399): n is a, c, t, g, unknown, or other
  misc_feature (437)..(437): n is a, c, t, g, unknown, or other
  misc_feature (445)..(445): n is a, c, t, g, unknown, or other
tggagctccccgcggtggcggccgctctagaactagtggatcccccgggctgcaggaattcgcacgagaccattacctagaacatcctaatcgaaaaacgacaaatcgacgatcgccgcttctcttggccattgtagagggagagagagagcgcgagcgacctaggtcagtcggtttcggttttgggcgtcagcttcagctatccgcgaccgcgacgatgggtctggcgcgtggccgccaccgcgccagctccggccggcgtgcggntgctcggcaggggcgccgcgcgcgtgacgccgcgacgntgggcggctgtcggcggcaggagacgcttctcccgtggcggatgtccgtcgcgaccaccgaggccacaccaccaatcggcgtggggcggctcgnaggaccagggcgctggagggtaggaactccaggacggntgggggcngtcattcctcgggggggggcgcccgggaaccagggtctttcccgctaaccaagacgcagggccaaagcccgggggggccattgggggggggcgtaaagggttcattcgacgtggccgatggacaaatggcataaaacggggggatcaacaggggcaaattccctcagggagtttaaattggaatccctaattcgccccctttccgaagccaaaattttccaaaagggggtgcccccttagagaagggatttctcggggggttttaaaaaacaccccaaggggggggaggggggggaaaaaggggtttttcctta

SEQ ID NO: 32787 - protein, 91 aa, Zea mays
  misc_feature: Ceres CLONE 1410161-F
  misc_feature (17)..(17): Xaa is any aa, unknown, or other
  misc_feature (30)..(30): Xaa is any aa, unknown, or other
  misc_feature (61)..(61): Xaa is any aa, unknown, or other
  misc_feature (74)..(74): Xaa is any aa, unknown, or other
MGLARGRHRASSGRRAXARQGRRARDAATXGGCRRQETLLPWRMSVATTEATPPIGVGRLXGPGRWRVGTPGRXGAVIPRGGAPGNQGLSR

SEQ ID NO: 32788 - DNA, 634 bp, Zea mays
  misc_feature: Ceres CLONE 1410162-R
  misc_feature (634)..(634): n is a, c, t, g, unknown, or other
caattggtgaccgggccccccctcgaggtcgacggtatcgataagcttttttttttttttttttgaaatatataaaaatattaatatttatagtatatatgatagatagatcattaaatctatttttaataaacttatttgaagatgctaatatttctacaaacctagtcaaaactttaaaaaaaacttgactgacacgacacttattctgaggcgagtgatcgagtaacttctatcgaccttcaagcatgatggttgtcgcactgtcaaacacgctgcagtcgggcttggtcgatgatgtgtctgtttccattagaactctcctagctgcgaagccaggttgcttaagagtcggcagtgatgcggcatcaggactagctaacatcagaagcacctgagacatcagcggacggtcgtctggattctcttgcacgcacagtagcccaaccctgacgcacttctgcacttcgtctgagttgaattgtccgatcattctctcatctgctaactctatgctcttctcctcgttccacaagctccatgcatggcctaaaaagctttgggtgtttgaacctggaaaaaatcccctgtttcctccctgccataaagaatctccaggaaatagtaccccctn

SEQ ID NO: 32789 - DNA, 686 bp, Zea mays
  misc_feature: Ceres CLONE 1410166-F
  misc_feature: Encodes the peptide sequence at SEQ ID NO. 32790
  misc_feature (456)..(456): n is a, c, t, g, unknown, or other
  misc_feature (461)..(461): n is a, c, t, g, unknown, or other
  misc_feature (546)..(546): n is a, c, t, g, unknown, or other
  misc_feature (642)..(642): n is a, c, t, g, unknown, or other
  misc_feature (674)..(674): n is a, c, t, g, unknown, or other
  misc_feature (675)..(675): n is a, c, t, g, unknown, or other
tggagctccccgcggtggcggccgctctagaactagtggatcccccgggctgcaggaattcgcacgagaccattacctagaacatcctaatcgaaaagtatcgtctcctctccttcctgacattggcactggtagctgcactcaccggaagccatggaagacttgctctactactccctcaccatagcctgctgcatcgcagtcatcgccctcctctccatccttcgttcgttcaccgctaccggaccgccgccggcgctcccgcccggcccgtcgctgctgtcgctgatcaccccgctcctcttcctcggccgaacgaacttcggcatcgagcggatcctctccccgccgcgcggtcccgctacggccccgtcttcacgctctacctgctcccgtcccgcccggccatcttcatcgccgaccactccgtggcgcaccgcgtggctggttgcaggncggcnccgtcttcgacgacagtccgccggccagcctccccttccgcctcttctccatggacagcgcaacatcacatccggagcctacggnaccggtctggggcgagctccgtacaactcaagggggcacgtggttcagccgcgatcaaggggcgggttccccccacccgcgcccaaaacttgggantttcccccgcgggggccggcccaaaggcgggnngggaacccccc

SEQ ID NO: 32790 - protein, 58 aa, Zea mays
  misc_feature: Ceres CLONE 1410166-F
  misc_feature (12)..(12): Xaa is any aa, unknown, or other
  misc_feature (44)..(44): Xaa is any aa, unknown, or other
  misc_feature (55)..(55): Xaa is any aa, unknown, or other
MDSATSHPEPTXPVWGELRTTQGGTWFSRDQGAGSPHPRPKLGXFPRGGRPKGGXGTP

SEQ ID NO: 32791 - DNA, 795 bp, Zea mays
  misc_feature: Ceres CLONE 1410167-F
  misc_feature (243)..(243): n is a, c, t, g, unknown, or other
  misc_feature (260)..(260): n is a, c, t, g, unknown, or other
  misc_feature (270)..(270): n is a, c, t, g, unknown, or other
  misc_feature (275)..(275): n is a, c, t, g, unknown, or other
  misc_feature (281)..(281): n is a, c, t, g, unknown, or other
  misc_feature (283)..(283): n is a, c, t, g, unknown, or other
  misc_feature (301)..(301): n is a, c, t, g, unknown, or other
  misc_feature (308)..(308): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (748)..(748): n is a, c, t, g, unknown, or other
  misc_feature (750)..(750): n is a, c, t, g, unknown, or other
  misc_feature (758)..(758): n is a, c, t, g, unknown, or other
tggagctccccgcggtggcggccgctctagaactagtggatcccccgggctgcaggaattcgcacgagaccattacctagaacatcctaatcgaaaaaaaaaagagggaagccgcaggcagcatctgcatctctcgcccacctccgctccgcctactgctgctggtggtagggaggcggagaaggaggcccttgcgcccgcccgccggccggatcagagccgtagcaaccacacccatggcgnacgtgcacgaacctttnggtgcgcgangaagnaagaangntttggtggactacttggntgaagtnccgatgaatcctcgggatccttcggggcccttccaattccacttctgaattaactcaaaatcttccggggggaaatggggtcccccctgaaaatcgaaaaaaaacggcccaaaacccccccccaaaaacggggaaaagggccggaaagggtctccagaaagaaacccaaaaaagggggttcttttttttaccgccccaaaaaccccttgtattttttttggtgtgggccaaggggggaaaaaaggggggggggtttttttggggggggatcttttcctttagggaaactctttgaaaaaaaaaaaggagggggtgtttaaagggggcccccccccttttggtggggaaaaaaaaaaaaaaactccgaaaaaaacattttggggggggggggnnnaaaaaaaaaaaaaaaattggtggggggggggcgccgaacgcnnncngngggggggntttcctttctttttttttttttctcacgcgggggggg

SEQ ID NO: 32792 - DNA, 737 bp, Zea mays
  misc_feature: Ceres CLONE 1410169-F
  misc_feature: Encodes the peptide sequence at SEQ ID NO. 32793
  misc_feature (325)..(325): n is a, c, t, g, unknown, or other
  misc_feature (420)..(420): n is a, c, t, g, unknown, or other
  misc_feature (428)..(428): n is a, c, t, g, unknown, or other
  misc_feature (515)..(515): n is a, c, t, g, unknown, or other
  misc_feature (516)..(516): n is a, c, t, g, unknown, or other
  misc_feature (570)..(570): n is a, c, t, g, unknown, or other
tggagctccccgcggtggcggccgctctagaactagtggatcccccgggctgcaggaattcgcacgagaccattacctagaacatcctaatcaaaaagcacaagccaaacgtgcagctgaggaatcgcaacggcagtgacgtgtgcgcgttgccaaataaagctactatactagtcaccgctcgattgccgtcgcagccgcccgccggccggagatgggtgcgccggcgctgtcgtccgtcgtcgtggtggcacggcggcagtggtttgcctgtgcggggcctttgcgcaggcgcaggacatggacagcgagtgggcgcggcggncctaccgcgggttcttcggcgccccggccgggtcgctgctgccgcagtcggacgtgggacctgctggagttcccgctgaacctggagtacctggnagacggangttcttctgctggtccgcttctggggtacggcctcgacgccatcgacgccacctcaaaccggcggcgggccgccctccatcggcggnncagtccgcgtccctcaccccgtcaaatccgcgacgtggccaacccagttctggntacaaagaagtcgggcaccctcagggcgatcaagcagaacggtgaggggctttcccgaggccgttgctggacatcagcgcggccaacttcggcaagatcatcgagcaagcgctgaacgcgacgctggacccgcccttcgacccctacgagaacagcctcaacttcct

SEQ ID NO: 32793 - protein, 104 aa, Zea mays
  misc_feature: Ceres CLONE 1410169-F
  misc_feature (9)..(9): Xaa is any aa, unknown, or other
  misc_feature (43)..(43): Xaa is any aa, unknown, or other
  misc_feature (72)..(72): Xaa is any aa, unknown, or other
MDSEWARRXYRGFFGAPAGSLLPQSDVGPAGVPAEPGVPGRRXFFCWSASGVRPRRHRRHLKPAAGRPPSAXQSASLTPSNPRRGQPSSGYKEVGHPQGDQAER

SEQ ID NO: 32794 - DNA, 767 bp, Zea mays
  misc_feature: Ceres CLONE 1410170-F
  misc_feature (557)..(557): n is a, c, t, g, unknown, or other
  misc_feature (577)..(577): n is a, c, t, g, unknown, or other
  misc_feature (588)..(588): n is a, c, t, g, unknown, or other
  misc_feature (649)..(649): n is a, c, t, g, unknown, or other
  misc_feature (688)..(688): n is a, c, t, g, unknown, or other
aaagctggagctccccgcggtggcggccgctctagaactagtggatcccccgggctgcaggaattcgcacgagaccattacctagaacatcctaatcaaaaaactctcgctttcttctgtctcgcctcgccctcgcctttgttgatcttttcctttctcgcgttcccctcgccttcctcttcctcccccacacccaccggtcgccgcccccgtcgccccggcctcctcggtccagagacgagggggtccgcgccgttccgacgccacaccgcaaccgcatcacatcaccgcctgctcccaccgtccatccgccctccctcgatcgcgctccccggatcgctggtacctccgcgcgcggctccgacctcatcttcctccatcgactggcatcggcagcggcggcgtgttcccggccaaccttcgaaagggtaatcaatcgccagacttttgggagctgtgttgggggggaccggggggaagagccaagttactgcagaggtaaccatttcggttgtcgagtgatggcgcaaggcatcaacttccctgactcatcggcngccgtgggtggccatggatnggtggcgtggnacttttggtggggaacttctgtgacatggccttctaccgaaggctaggggagggaccccancatggtcggtcgacagcctcaacagcatgcagacagaantgggctgtgggggggtcattcggccatggtctgtggacacaaaacagcagcgtttggctctaacagtgactcccgcatt

SEQ ID NO: 32795 - DNA, 735 bp, Zea mays
  misc_feature: Ceres CLONE 1410172-F
  misc_feature: Encodes the peptide sequence at SEQ ID NO. 32796
  misc_feature (320)..(320): n is a, c, t, g, unknown, or other
aaagctggagctccccgcggtggcggccgctctagaactagtggatcccccgggctgcaggaattcgcacgagaccattacctagaacatcctaatcgaaaaataaaaatttcgtttttctcctctcagtctccgacgccgccgcactcatccccccagacgaccaccctcctcctcctcccccacccacctcgccggaaccctagcgccgaccgcctgccgtgcccatcgacggcgatcgcattgctgcgccccgatggcgacccgcgcctccaagaattgcctctgcgcgggcagctcttcgtcgatgacccccgagntgggtcgaggtgtctccggcacgcgggttggtgggggggggggccctccggccacaacaggaggaggcggagccaggttgtaccgcaagaagtgattgaaatcgatgatgatgactcctgatggaggcataccttattggtgataaagcacaggtggaaaagaataagcaaactgctgtagtccccatggattgctcaagcatgccaagaaagtggttgggttcaggacatccctggtccaagcacatatgcttcaaaatataccaggttcctgggttggacctgaaagtgtttcaaggacgaggcagtttacaactattctgatggctaccccctttgatggatttgaagaagactatgcttatgatgaagatgagtttgaggattgatggttatgacactccactcattgaaa

SEQ ID NO: 32796 - protein, 52 aa, Zea mays
  misc_feature: Ceres CLONE 1410172-F
  misc_feature (22)..(22): Xaa is any aa, unknown, or other
MATRASKNCLCAGSSSSMTPEXGRGVSGTRVGGGGGPPATTGGGGARLYRKK

SEQ ID NO: 32797 - DNA, 744 bp, Zea mays
  misc_feature: Ceres CLONE 1410174-F
  misc_feature (298)..(298): n is a, c, t, g, unknown, or other
aaagctggagctccccgcggtggcggccgctctagaactagtggatcccccgggctgcaggaattcgcacgagaccattacctagaacatcctaatcaaaatacttatttcactgccttccctttgatgaaaaaattatcacatgaggtccaaattcgctccacctagagagccaaaagaggcggggatggctggcaggttaaatgcaccttggattgtgccgccgccgcctggaggtacgagacaagcgaacgtcggtcgccgcaatatttatgcgtgtactaggcagatcatgccnggcagccacgcgtacacttctgccgcaaagctaaacgcgccactccgcggcaagttgctctgctgctccctagcagcacgcaccgagtggcaatggcgactgcagcgagttcgacgccggcgggcgcggcagcctactctggtctggcgcgtactgaccgagcgggtgcccccgaagatgcaaaagggaggttgccccgctgcggcgttgggggccaaaggggcgaattttccaggtgggttggcttgaaaagttcgaaccatggaaggacgggcccgggttttcgcccaaaccggtttgtttccggtattgaaaaaaagggggaaattttggggggagcccctcccccggggaaaataaaccacgttttgggggctttttttgggaagaggggtggggaaaaaaatattttggtgccccctcttcggggggtcctcccccccccg

SEQ ID NO: 32798 - DNA, 762 bp, Zea mays
  misc_feature: Ceres CLONE 1410176-F
  misc_feature: Encodes the peptide sequence at SEQ ID NO. 32799
  misc_feature (374)..(374): n is a, c, t, g, unknown, or other
  misc_feature (375)..(375): n is a, c, t, g, unknown, or other
  misc_feature (407)..(407): n is a, c, t, g, unknown, or other
  misc_feature (477)..(477): n is a, c, t, g, unknown, or other
  misc_feature (486)..(486): n is a, c, t, g, unknown, or other
aaagctggagctccccgcggtggcggccgctctagaactagtggatcccccgggctgcaggaattcgcacgagaccattacctagaacatcctaatcgaaaagtctttctccccttcctgctttccctctccagctctcatacacaaacacacggagctagcagcacggatcgagagaacaatggaggaaacaagcaggatccctgggtacttcaagaacaagggcatcctgatcacgggcgcaacaggcttccttggaaagatcctcgtggagaaaatactgagggtccagccggacgtaaagaggatctacctccccgtgcgtgcgccggatgctgcatcaccaagaaacgggtggagactggagtgatcgnnaaaggagctgtttgggcttctccgagagacgnccgggcaagagggttcactcttcatcgagggagaaggtgggtccccgttggccggcgacatcatccacanaacctgggncgggggaggggccccagcttgaggcgggatgactcggggagctcaacggcttcggccaatggaactgccacaacaacttctacgaaagggacaacgggcccctggaacggaaagttgatggggagggaaacaattttggccggggggccagggggggccccattttgggggggcgccctcctggggcccgccccattgggggggggaaaaaaaacaggggaatatccctggaggcggggttccaaaagggggggacccctgggggagaaaaacgag

SEQ ID NO: 32799 - protein, 62 aa, Zea mays
  misc_feature: Ceres CLONE 1410176-F
MEETSRIPGYFKNKGILITGATGFLGKILVEKILRVQPDVKRIYLPVRAPDAASPRNGWRLE

SEQ ID NO: 32800 - DNA, 785 bp, Zea mays
  misc_feature: Ceres CLONE 1410177-F
  misc_feature: Encodes the peptide sequence at SEQ ID NO. 32801
  misc_feature (293)..(293): n is a, c, t, g, unknown, or other
  misc_feature (297)..(297): n is a, c, t, g, unknown, or other
  misc_feature (343)..(343): n is a, c, t, g, unknown, or other
  misc_feature (344)..(344): n is a, c, t, g, unknown, or other
  misc_feature (349)..(349): n is a, c, t, g, unknown, or other
  misc_feature (352)..(352): n is a, c, t, g, unknown, or other
  misc_feature (357)..(357): n is a, c, t, g, unknown, or other
  misc_feature (362)..(362): n is a, c, t, g, unknown, or other
  misc_feature (363)..(363): n is a, c, t, g, unknown, or other
  misc_feature (370)..(370): n is a, c, t, g, unknown, or other
  misc_feature (371)..(371): n is a, c, t, g, unknown, or other
  misc_feature (392)..(392): n is a, c, t, g, unknown, or other
  misc_feature (627)..(627): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (654)..(654): n is a, c, t, g, unknown, or other
  misc_feature (663)..(663): n is a, c, t, g, unknown, or other
  misc_feature (683)..(683): n is a, c, t, g, unknown, or other
  misc_feature (696)..(696): n is a, c, t, g, unknown, or other
  misc_feature (708)..(708): n is a, c, t, g, unknown, or other
  misc_feature (709)..(709): n is a, c, t, g, unknown, or other
  misc_feature (723)..(723): n is a, c, t, g, unknown, or other
  misc_feature (727)..(727): n is a, c, t, g, unknown, or other
  misc_feature (728)..(728): n is a, c, t, g, unknown, or other
  misc_feature (734)..(734): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (747)..(747): n is a, c, t, g, unknown, or other
  misc_feature (748)..(748): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (766)..(766): n is a, c, t, g, unknown, or other
  misc_feature (767)..(767): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (777)..(777): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
caaagctggagctccccgcggtggcggccgctctagaactagtggatcccccgggctgcaggaattcgcacgagaccattacctagaacatcctaatcgaaaaatccgcccgccgcttttctctctgctttggagagggagccgcacgcagtggtttctgctgctgctgccgctggtccgccagggtcccgggcgctgtgctcattccaccggtcggcggtgcactttcaggctacttcgacggtgacgagagtggaggaaatgtcgacgacggagtgcgcggaccctcgggnaggnagtctggctgccggaggactttttggacgacgacttcttctccganngaganaangcggncgtgnncgcccgnnacgagagcgacgaagagacancctggcgggggttctccgccggctcggggggcttccccgggaagggggaaaaaggaagggctcccgggcaaagggggaggggacggttgggtcctttaatccaaacttgggggccctgcccaaatcggggaaagaaaaccccagggggggggggtaaaagggaaattccccccctttttcccccctgagaaaaaaccccccccccccccgggatatctcttaaaaaagggggccnacaaagtgtgcgcnnnaannncccccncacaaaggnggcgcgggggggggcccccnaattttttttccngggaaagggganncccccccccccacnaaanncccccncccnnnnnnnncnnaccccccccccnnnnganncnnngggggngnnnaaat

SEQ ID NO: 32801 - protein, 95 aa, Zea mays
  misc_feature: Ceres CLONE 1410177-F
  misc_feature (11)..(11): Xaa is any aa, unknown, or other
  misc_feature (28)..(28): Xaa is any aa, unknown, or other
  misc_feature (30)..(30): Xaa is any aa, unknown, or other
  misc_feature (31)..(31): Xaa is any aa, unknown, or other
  misc_feature (34)..(34): Xaa is any aa, unknown, or other
  misc_feature (37)..(37): Xaa is any aa, unknown, or other
  misc_feature (44)..(44): Xaa is any aa, unknown, or other
MSTTECADPRXGSLAAGGLFGRRLLLRXRXXGRXRPXRERRRDXLAGVLRRLGGLPREGGKRKGSRAKGEGTVGSFNPNLGALPKSGKENPRGGG

SEQ ID NO: 32802 - DNA, 735 bp, Zea mays
  misc_feature: Ceres CLONE 1410179-F
  misc_feature: Encodes the peptide sequence at SEQ ID NO. 32803
  misc_feature (387)..(387): n is a, c, t, g, unknown, or other
  misc_feature (432)..(432): n is a, c, t, g, unknown, or other
  misc_feature (498)..(498): n is a, c, t, g, unknown, or other
  misc_feature (522)..(522): n is a, c, t, g, unknown, or other
  misc_feature (610)..(610): n is a, c, t, g, unknown, or other
  misc_feature (676)..(676): n is a, c, t, g, unknown, or other
aagatggctggagctccccgcggtggcggccgctctagaactagtggatcccccgggctgcaggaattcgcacgagaccattacctagaacatcctaatcgaaaaaaaaaggcactgctcatcgatccggcactacgccacagaatcctctcctactccggcagttctgctcgccgccgcctccacgatgacggaagacgtgcagatgaacgactcggagccccagcctgcggtctcagctcccgccgtcggggcgccggcgctctccacactacaccatctgaaggagatcgcgtccgtgatcgaggccggttctctggttccaaggaggtcctgccggatctcccgtgccttccgtctcaccgtcgctgctccgtgtcgctcttngcggggggttaggtctccgtcttcctcgccttcgcgctacccggntcctccgaagcgctacggacgcctcacgtgccctgtgggcccaagggagatgatactggaaagggnatggttgatgctgcagctccagcnaactcagatttcaatcaaagatgggctcccctgagattgaaatatattgctacttggctcgtactgatttttccttaatgatcataanaaaatatgatggaggctaaggaatgggcagagtgcgagcattgctcgcctgaagatctaaccgagnaaaagggggtgaggttttggaatcacactgaacttcaatactccttatggggaggagcc

SEQ ID NO: 32803 - protein, 122 aa, Zea mays
  misc_feature: Ceres CLONE 1410179-F
  misc_feature (67)..(67): Xaa is any aa, unknown, or other
  misc_feature (82)..(82): Xaa is any aa, unknown, or other
  misc_feature (104)..(104): Xaa is any aa, unknown, or other
  misc_feature (112)..(112): Xaa is any aa, unknown, or other
MTEDVQMNDSEPQPAVSAPAVGAPALSTLHHLKEIASVIEAGSLVPRRSCRISRAFRLTVAAPCRSXRGVRSPSSSPSRYPXPPKRYGRLTCPVGPREMILERXWLMLQLQXTQISIKDGLP

SEQ ID NO: 32804 - DNA, 789 bp, Zea mays
  misc_feature: Ceres CLONE 1410180-F
  misc_feature (402)..(402): n is a, c, t, g, unknown, or other
  misc_feature (438)..(438): n is a, c, t, g, unknown, or other
  misc_feature (439)..(439): n is a, c, t, g, unknown, or other
  misc_feature (510)..(510): n is a, c, t, g, unknown, or other
  misc_feature (555)..(555): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (573)..(573): n is a, c, t, g, unknown, or other
  misc_feature (582)..(582): n is a, c, t, g, unknown, or other
  misc_feature (583)..(583): n is a, c, t, g, unknown, or other
  misc_feature (600)..(600): n is a, c, t, g, unknown, or other
  misc_feature (689)..(689): n is a, c, t, g, unknown, or other
  misc_feature (718)..(718): n is a, c, t, g, unknown, or other
aaagctggagctccccgcggtggcggccgctctagaactagtggatcccccgggctgcaggaattcgcacgagaccatttacctaaaacatcctaatcgaaaagccatgctcgccgcaagtcccctgcgccaagtgccgccgccgggcatcccatccacctcccgtcctactccctgaaggcatgaacccccgttccaagcgccctataccgccgccatctcccgttcccctttcctttgttctctttcgtctgctgggcaaaccaacgccgccagccactggtcgatcacttccagccaaggagtggcggacgcgcagggcttggagtgtggcggacaggcggatcctgtagcggcaaagacaggtacggacgagaagaggtgagttctccgcacgatcgngctgggacaggggaacgacgcgcgcaactgtgtggnncttgggggggcattaaacgcttaaacggcgatcaatcgtcgcttaatcgatttgctgtcgggtactcctgncacctcagaagaggttgaactaagatagggtattcaatgacggtngatcnnnnnnngtggggntgtgataannaatagggggggggtggnctttctcaaggttgggtttttgggggggggacaatgattccaaatttgttgtttgtcccccaaactgtaatgcccaaaacccccctggntggcaatgcccagctcgaaaaaaaatggncttgtgggctgaccagctgcaaggcaaaaaaaatgttcgaatgtgaactggcatggaactttgaaagcgtc

SEQ ID NO: 32805 - DNA, 724 bp, Zea mays
  misc_feature: Ceres CLONE 1410186-F
  misc_feature (51)..(51): n is a, c, t, g, unknown, or other
  misc_feature (61)..(61): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (358)..(358): n is a, c, t, g, unknown, or other
  misc_feature (714)..(714): n is a, c, t, g, unknown, or other
aagctggagctccccgcggtggcggccgctctagaactagtggatcccccngggctgcagngaattcgcacgagaccattacctagaacatcctaatcgaaaaattgttgattgattgatcctccccgcctcactcctttgtctcctcgcctcgtgctcgctcgctcccctcgccctggagaggagggcagcagaaaccctagcggctcaggccgggcggtggttagatgctccaaggttcgagagggaagggtaggttagtggtgcgccatcgactatgggctgcgtcttcggccgggcggctgcgtcgtcctctgcagcgcctagaagaggcgnnnaagggggaaggtcctccagnttcccgctggagtgcgtccgacggcggacgaagacacgacagggtcttctcccatggcgtgacccattatgtcaatgccaagggcgaacctaccactgggaactggtcccccccacttctgcaaagaggaggtcccgggacctccccagggggagcctcccggcccccaagggaacccccaccgtgcggggccccaaccacccggtccggcgggggtccaaaaagggaaaacgtgtaaacccccggcctttgaaaaaaaaaggttggaaatccttccccccggggcaaagggaaggaggggggcaaaaaaccttgtggccctcttgggggggttttacgtttggagaacccctttntgtggggcgg

SEQ ID NO: 32806 - DNA, 747 bp, Zea mays
  misc_feature: Ceres CLONE 1410189-F
  misc_feature (265)..(265): n is a, c, t, g, unknown, or other
  misc_feature (380)..(380): n is a, c, t, g, unknown, or other
  misc_feature (443)..(443): n is a, c, t, g, unknown, or other
aagctggagctccccgcggtggcggccgctctagaactagtggatcccccgggctgcaggaattcgcacgagaccattacctagaacatcctaatcgaaaagcgtttctttaccctaagcttttagctggtccaacgaaaggcacacagcccgacagccgccgctgtttcttcatcttcctcgcagcgccggcgctccttcttccgctccctctccgattcgcgctcggacgcgatgcgacggcggcggacgctcgtgctcggcntctcagcgacgggggtgagcaccagactcgggtgtcgggcgtcagggggcccccttccgacggacaccaatcgccacgcgacctacgcctacaggacctacgcacaccgacaggntgcccatgagtgcacgactacaggtcccgcctggactgacgacggaccgtcaaaggcgatcgncacccgtgaggtaggactggcgcgacacgagaagagcgtcgcagagatgctcagccatgagccgactacgagagagccacaggttatacatacgaatgatctgtacacgatgagattacctattcatcggaatggaagcgagagatcagctggccatagttggagaacaggaaagatgacagctacgatgaaggaccatgatatgacgttggaaactcatcgagttgggaaatattggttctctccgaggcaagcgaacgcggcaagattaaatcaattgatgagccactggcaagaagggaag

SEQ ID NO: 32807 - DNA, 753 bp, Zea mays
  misc_feature: Ceres CLONE 1410190-F
  misc_feature: Encodes the peptide sequence at SEQ ID NO. 32808
  misc_feature (321)..(321): n is a, c, t, g, unknown, or other
  misc_feature (413)..(413): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (429)..(429): n is a, c, t, g, unknown, or other
  misc_feature (440)..(440): n is a, c, t, g, unknown, or other
  misc_feature (472)..(472): n is a, c, t, g, unknown, or other
  misc_feature (484)..(484): n is a, c, t, g, unknown, or other
  misc_feature (570)..(570): n is a, c, t, g, unknown, or other
  misc_feature (571)..(571): n is a, c, t, g, unknown, or other
  misc_feature (644)..(644): n is a, c, t, g, unknown, or other
  misc_feature (673)..(673): n is a, c, t, g, unknown, or other
  misc_feature (676)..(676): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
aaagctggagctccccgcggtggcggccgctctagaactagtggatcccccgggctgcaggaattcgcacgagaccattacctaaaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggntacgtgggaggagaacggggcttcgtgtggctccggcagcgcccgcaaggtggaccactacttcgccaaggccggcccgccacgtgcctaangnnnggccgaggtggntcggcggtggncccgacaagggcccggctcaagaagaatcacngggcgtcaaggnccaaggaagatgccttgctgtgggtcacccctccacgagatccttgcgtcgacgacccccgcccactggtaagctccactgcaagnngccatcggcggcctgtcccgcagcttcccccgtcgaggcccttcgaggccgaggagccggcgccgccgggaancccggcggtgtctttcccagggacgcganggnaaaaaggaagaannnnnnnnnnnnnnnnnnnnnnnnnnnnnnnnnnnnnnnnnnnnnnnnnnnnnnnnnnnnnnnnc

SEQ ID NO: 32808 - protein, 171 aa, Zea mays
  misc_feature: Ceres CLONE 1410190-F
  misc_feature (80)..(80): Xaa is any aa, unknown, or other
  misc_feature (81)..(81): Xaa is any aa, unknown, or other
  misc_feature (89)..(89): Xaa is any aa, unknown, or other
  misc_feature (100)..(100): Xaa is any aa, unknown, or other
  misc_feature (104)..(104): Xaa is any aa, unknown, or other
  misc_feature (132)..(132): Xaa is any aa, unknown, or other
  misc_feature (133)..(133): Xaa is any aa, unknown, or other
  misc_feature (157)..(157): Xaa is any aa, unknown, or other
  misc_feature (167)..(167): Xaa is any aa, unknown, or other
  misc_feature (168)..(168): Xaa is any aa, unknown, or other
MTLTIPDEVRAKAEVYVGDAAGQEKTRLLLQETGLPSGLLPLRDIIECGYVGGERGFVWLRQRPQGGPLLRQGRPATCLXXGRGGSAVXPTRARLKKNHXASRXKEDALLWVTPPRDPCVDDPRPLVSSTAXXHRRPVPQLPPSRPFEAEEPAPPGXPAVSFPGTRXXKGR

SEQ ID NO: 32809 - DNA, 737 bp, Zea mays
  misc_feature: Ceres CLONE 1410191-F
  misc_feature: Encodes the peptide sequence at SEQ ID NO. 32810
tccccgcggtggcggccgctctagaactagtggatcccccgggctgcaggaattcgcacgagaccattacctagaacatcctaatcgaaaagacgacgcttcccgagctctctccttcccgcgaccctctcctctgccccgctccgctagggttttgccgcagacctctcgctcgcttccggttccgcgaggcaaccgtccgaccggtcggaatggtggatgtggaggagaccgggaacaagttgcaatcgcagatgcgcctccacgcggagccggaggacgacgccgacgacctccccctccggtcctcttcgatagggcgtcgcggctccacgccctggcctccagctccgcccctcgacagatggatccggacgggggttgaactgctgcgacgctgcgagacttggtcagaaagttccggctcttctccccagggaaccgagggagacggtccccagcaaacctcagtactacggggcctattaccttggaaaaggcccgaaaattccccgggggttctgatcccggttttaaagacgcaggaccatttggaagggttcttggcctttgggaggaataaagctttccccaggggggggttattttttttgggaaaaaaccccattcttcctacaaaaaaagagggggaagagggccgggtcacaaccaaaggggggaaaaaaacttccccaaaaaaaaaaaaaaaaaaaggggggggcccttttataagaact

SEQ ID NO: 32810 - protein, 175 aa, Zea mays
  misc_feature: Ceres CLONE 1410191-F
MVDVEETGNKLQSQMRLHAEPEDDADDLPLRSSSIGRRGSTPWPPAPPLDRWIRTGVELLRRCETWSESSGSSPQGTEGDGPQQTSVLRGLLPWKRPENSPGVLIPVLKTQDHLEGFLAFGRNKAFPRGGLFFLGKNPILPTKKEGEEGRVTTKGGKKTSPKKKKKKGGGPFIRT

SEQ ID NO: 32811 - DNA, 739 bp, Zea mays
  misc_feature: Ceres CLONE 1410192-F
  misc_feature: Encodes the peptide sequence at SEQ ID NO. 32812
  misc_feature (425)..(425): n is a, c, t, g, unknown, or other
  misc_feature (475)..(475): n is a, c, t, g, unknown, or other
  misc_feature (517)..(517): n is a, c, t, g, unknown, or other
  misc_feature (608)..(608): n is a, c, t, g, unknown, or other
tggagctccccgcggtggcggccgctctagaactagtggatcccccgggctgcaggaattcgcacgagaccattacctagaacatcctaatcaaaaaattgtcagccatcctcaggcagcttcgagttccacgacgagagcaccggcagccgcacacgcgtttgtctcctcgccggaccttcccggcaccgccgccggctctccctcacggtccactacactccacagcaccgccgtcgcacaacgacatggcctcctccgctacctatctcatgctcgccagcgcccacgctcccctcgctcctctcataaggccaccgccgatggcccttgtcgcgagaaccgccgcaacctccatcataggcgcgaaagagcagtgtccctctgttagcaaccccgctgcgtgccggccggactggcggcgnccgtggctgggcccatatctgcagagactcgtccctccagggcccttcgnggcgccgattctcctgctcaggagcaagaggatctgaagagnagcgaggcggtgtcagaggctgccggctcggattgccggaggcactggcgggacgttaagcgatgggagcacgtcggtgctcatcttcggnatctgagcgggactcatgtactacgtcttcctgctcgcgcctaaccagacaccataccgagaacatacttcttgcagaagcttttaatctgaaggggggagatggctttcgaaagaacgatgttcttgttt

SEQ ID NO: 32812 - protein, 87 aa, Zea mays
  misc_feature: Ceres CLONE 1410192-F
  misc_feature (76)..(76): Xaa is any aa, unknown, or other
MASSATYLMLASAHAPLAPLIRPPPMALVARTAATSIIGAKEQCPSVSNPAACRPDWRRPWLGPYLQRLVPPGPFXAPILLLRSKRI

SEQ ID NO: 32813 - DNA, 754 bp, Zea mays
  misc_feature: Ceres CLONE 1410193-F
  misc_feature: Pfam Name: UPF0131 Pfam Description: Uncharacterised protein family (UPF0131)
  misc_feature (405)..(405): n is a, c, t, g, unknown, or other
  misc_feature (422)..(422): n is a, c, t, g, unknown, or other
  misc_feature (423)..(423): n is a, c, t, g, unknown, or other
  misc_feature (487)..(487): n is a, c, t, g, unknown, or other
  misc_feature (535)..(535): n is a, c, t, g, unknown, or other
  misc_feature (538)..(538): n is a, c, t, g, unknown, or other
  misc_feature (540)..(540): n is a, c, t, g, unknown, or other
  misc_feature (541)..(541): n is a, c, t, g, unknown, or other
  misc_feature (544)..(544): n is a, c, t, g, unknown, or other
  misc_feature (557)..(557): n is a, c, t, g, unknown, or other
  misc_feature (567)..(567): n is a, c, t, g, unknown, or other
  misc_feature (571)..(571): n is a, c, t, g, unknown, or other
  misc_feature (586)..(586): n is a, c, t, g, unknown, or other
  misc_feature (598)..(598): n is a, c, t, g, unknown, or other
  misc_feature (601)..(601): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (623)..(623): n is a, c, t, g, unknown, or other
  misc_feature (628)..(628): n is a, c, t, g, unknown, or other
  misc_feature (655)..(655): n is a, c, t, g, unknown, or other
  misc_feature (699)..(699): n is a, c, t, g, unknown, or other
  misc_feature (700)..(700): n is a, c, t, g, unknown, or other
  misc_feature (715)..(715): n is a, c, t, g, unknown, or other
  misc_feature (716)..(716): n is a, c, t, g, unknown, or other
  misc_feature (719)..(719): n is a, c, t, g, unknown, or other
  misc_feature (720)..(720): n is a, c, t, g, unknown, or other
  misc_feature (724)..(724): n is a, c, t, g, unknown, or other
  misc_feature (725)..(725): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
aaagctggagctccccgcggtggcggccgctctagaactagtggatcccccgggctgcaggaattcgcacgagaccattacctagaacatcctaatcgaaaaacagacagattaatcaacgcccgcacctcctatgggcacgaccggcgacgctccggctccggcgggggatccgcaggaccgccaccgtacccaccccccggcggcgaagcagcggacgacgcttgtgttcacgtacgggacgctgaagcgcggcttctccaaccaccgcctcctggaggagctcttcgcgagcggggacgcgtcgctggggggcccccgcggtgacgtcggcgcggctgccgctggtgtgcgggccgtaccgggtgccgttcctgctgaacctccctggcgccggcgccgggncgcaccgcgtgcgcggnnaggcgtacgcggggacggcccgcgggcttgcgcggctgggcgagctgggaggcgtggagacggngcactacgagcggctggccggggccggggaccccgagggcgggcggcncgncnncgnccccccggggaancccaacgccnaacncgcgggcccaccgcncggctttttcgnccnccccccgcaccccccannnggnccccngggccgcccccggcccccggcggggcnggggggcggcccccccccgcgggggggcaccgcaacagcagggnnaaaacgggccggggnnaannggannaannnncnnnnnnnnacacgnnnannnnt

SEQ ID NO: 32814 - DNA, 753 bp, Zea mays
  misc_feature: Ceres CLONE 1410194-F
  misc_feature: Translation starting site: 160
  misc_feature: SWISSPROT Homolog: EC 3.6.4.3 Microtubule-severing ATPase
  misc_feature (355)..(355): n is a, c, t, g, unknown, or other
  misc_feature (364)..(364): n is a, c, t, g, unknown, or other
  misc_feature (395)..(395): n is a, c, t, g, unknown, or other
  misc_feature (396)..(396): n is a, c, t, g, unknown, or other
  misc_feature (410)..(410): n is a, c, t, g, unknown, or other
  misc_feature (411)..(411): n is a, c, t, g, unknown, or other
  misc_feature (520)..(520): n is a, c, t, g, unknown, or other
  misc_feature (582)..(582): n is a, c, t, g, unknown, or other
  misc_feature (597)..(597): n is a, c, t, g, unknown, or other
  misc_feature (642)..(642): n is a, c, t, g, unknown, or other
caaagctggagctccccgcggtggcggccgctctagaactagtggatcccccgggctgcaggaattcgcacgagaccattacctagaacatcctaatcgaaaatcttccgccgcaagccagacagagttgactgtcaccgtgttccctcggggtgggcgatggggtcgtcggagccgtcgtcgcgttccgtgcagaacctcgtgctgtacgccgccagcgccgcgctcagctgcctcgtcctcttggccggccttcgccacctcgatcccaaccgcgccgcctctcagaaggcgcagcagcagaaagaaggagatcgccaagcgcctcggccggcccctcgtctccaccacgccntatgaggancgtgattgcgtgcgacgtcatcaaccccgcnnagcattcgacgtcnngaattcgattccatcggcggccttcgacaaggtcaagcaagcgctctacgagctcgtcatcctgcccctgcgccgccctgagctcttcgcctccggcaagctcctcggncccccagaagggcgtccttctctatggcccgcccggcacaggaaagaccatgctcgccaggncatttgcaggggagntccggtgccgtctttcatcaatgtcaggatctcaatctcatgagnaaagggggttcggggacgcgcagaagctcgtggtctgctgtatttagtctcgctcacaagctccagcctgctatatcttcatttgacgagggttgatagtttcttggggca

SEQ ID NO: 32815 - DNA, 750 bp, Zea mays
  misc_feature: Ceres CLONE 1410195-F
  misc_feature: Encodes the peptide sequence at SEQ ID NO. 32816
  misc_feature (694)..(694): n is a, c, t, g, unknown, or other
caaagctggagctccccgcggtggcggccgctctagaacaagtggatcccccgggctgcaggaattctgaccagaccatgacctagaacgtcctaatagaaaaaggagaattgttagggaaataaggaacgcgatgaaagtacacttccgtctgactatcccacactccctgcgcgacgacgacacacggagctcttcttgcggcccaggtactgttcgctgccgtcctacccaagaagacccagacgtcttcccacccttcaacgacaattaggactaccacttagatgaagatggaaaataaagaggagtgcaagaagctaagggcaaatgcttatactcgctgtactgcaccaagaatgtgatgacggtgactgtccgatatgcatgcaccatctcggcacaatgctggtgcttctgtagagcagctcccatgacaaaggatgcagatcctatatatgtgatacaagcaataggcattcagattgcctacatcagttcaagaagatgatagtgaatgatgagaacagtcctatcagagatccagctccgccatgcctaggaggaccggaaaccagcatgctgtacagagatctcagcttggtcccactatcagagagcgacgggctacacatacacatatgctgtacgcgatgaaactatcagatcagtcagatgtcaggcacagtactgntgccattacttcggagaacagggagaagacatctacaatgaaggcccagatttgac

SEQ ID NO: 32816 - protein, 30 aa, Zea mays
  misc_feature: Ceres CLONE 1410195-F
MLILAVLHQECDDGDCPICMHHLGTMLVLL

SEQ ID NO: 32817 - DNA, 749 bp, Zea mays
  misc_feature: Ceres CLONE 1410197-F
  misc_feature: Encodes the peptide sequence at SEQ ID NO. 32818
  misc_feature (544)..(544): n is a, c, t, g, unknown, or other
  misc_feature (552)..(552): n is a, c, t, g, unknown, or other
  misc_feature (554)..(554): n is a, c, t, g, unknown, or other
  misc_feature (557)..(557): n is a, c, t, g, unknown, or other
  misc_feature (558)..(558): n is a, c, t, g, unknown, or other
  misc_feature (561)..(561): n is a, c, t, g, unknown, or other
  misc_feature (562)..(562): n is a, c, t, g, unknown, or other
  misc_feature (564)..(564): n is a, c, t, g, unknown, or other
  misc_feature (566)..(566): n is a, c, t, g, unknown, or other
  misc_feature (578)..(578): n is a, c, t, g, unknown, or other
  misc_feature (603)..(603): n is a, c, t, g, unknown, or other
  misc_feature (610)..(610): n is a, c, t, g, unknown, or other
  misc_feature (612)..(612): n is a, c, t, g, unknown, or other
  misc_feature (619)..(619): n is a, c, t, g, unknown, or other
  misc_feature (639)..(639): n is a, c, t, g, unknown, or other
  misc_feature (650)..(650): n is a, c, t, g, unknown, or other
  misc_feature (656)..(656): n is a, c, t, g, unknown, or other
  misc_feature (660)..(660): n is a, c, t, g, unknown, or other
  misc_feature (676)..(676): n is a, c, t, g, unknown, or other
  misc_feature (689)..(689): n is a, c, t, g, unknown, or other
  misc_feature (698)..(698): n is a, c, t, g, unknown, or other
  misc_feature (701)..(701): n is a, c, t, g, unknown, or other
  misc_feature (707)..(707): n is a, c, t, g, unknown, or other
  misc_feature (713)..(713): n is a, c, t, g, unknown, or other
  misc_feature (714)..(714): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (727)..(727): n is a, c, t, g, unknown, or other
  misc_feature (728)..(728): n is a, c, t, g, unknown, or other
  misc_feature (732)..(732): n is a, c, t, g, unknown, or other
  misc_feature (734)..(734): n is a, c, t, g, unknown, or other
  misc_feature (735)..(735): n is a, c, t, g, unknown, or other
  misc_feature (738)..(738): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
caaagctggagctccccgcggtggcggccgctctagaactagtggatcccccgggctgcaggaattcgcacgagaccattacctagaacatcctaatcaaaaacatgccacattgccaccaagccacagttccacctttcgattcatgcacgctcagtcatgggcgccctccggagtttagccatctcctacccggagttcctcgtggccggactgtgcttcgtctccctctcggccctgcgccacgcgatgcgtgagcggcggcaacgcgcccccctgagctggcctgtggggctgatgctcccgttcgtgctcgcgaacctcgggcgcctctacgacgccatcaccgacgccctccacgggtccgggtgaacgctcgtgttccgcggaccgtgactcgcccgcacgaacttactgctgacgtgcgacccggcggccgtccagcactgcctggcgtccaaccacgggggctacgacaggggccgagactttgcggagatgttcgacctcctgggcgacgggctgctggttgcggacgccccgncgtggggncnccnncgnnangnctcccccaccgncttacggaacgccggggtgccggancgttacncnatgggcnacagggacgggcaaaagganccggtggttcntgcccntctnggaaagggggaggcgnttatataggcaanggggacggnggnaataantgaatnntnnnnnnnggggnngggncnnatntnnntnnnaat

SEQ ID NO: 32818 - protein, 70 aa, Zea mays
  misc_feature: Ceres CLONE 1410197-F
MGALRSLAISYPEFLVAGLCFVSLSALRHAMRERRQRAPLSWPVGLMLPFVLANLGRLYDAITDALHGSG

SEQ ID NO: 32819 - DNA, 763 bp, Zea mays
  misc_feature: Ceres CLONE 1410200-F
  misc_feature: Encodes the peptide sequence at SEQ ID NO. 32820
  misc_feature (129)..(129): n is a, c, t, g, unknown, or other
  misc_feature (390)..(390): n is a, c, t, g, unknown, or other
  misc_feature (403)..(403): n is a, c, t, g, unknown, or other
  misc_feature (404)..(404): n is a, c, t, g, unknown, or other
  misc_feature (431)..(431): n is a, c, t, g, unknown, or other
  misc_feature (461)..(461): n is a, c, t, g, unknown, or other
  misc_feature (530)..(530): n is a, c, t, g, unknown, or other
  misc_feature (537)..(537): n is a, c, t, g, unknown, or other
aaagctggagctccccgcggtggcggccgctctagaactagtggatcccccgggctgcaggaattcgcacgagaccattacctagaacatcctaatcgaaaaacagaaccctgcaactgcaagctaagngagagtgtgatcaccaacagctagtgctagtcccccttccttccatccatccatggcatgcgtcagcaccttccagagctgccccattgccagaagagcaaagatcaacacgaggtccaggggctgcagcagtagcgtggcgaaggggtcatcaccaccagccttccagttccagtgcagggcgtcgactttcgcggcggacaccagcctccggctcgagctggacgagaaacctcgagcgatcatctcggggggcgtggncccgggaactgcnntcctctcagctacgacgacctccgcgncctactcgagtcgcaagaagacgcggcccnagcagacggtccagcagcgcggcgttgccgctcctgagcgagaccatggccaaacccccggctgggggncaacagnaaaacaaaccggggagggaagtcaagggccactttcgaggccggggtcggggttttcggggcggcaaagggggcctaaaaaggggtcggggggggtattcaaaaaaaaaccggggaaaagaccccctcgggggccccaaaaaaaaaatatccgagaggggaaaacttcccccatttaaaatttattgtggaaaaaaacgggggggggggcgtgcgtttcccagcgc

SEQ ID NO: 32820 - protein, 177 aa, Zea mays
  misc_feature: Ceres CLONE 1410200-F
  misc_feature (70)..(70): Xaa is any aa, unknown, or other
  misc_feature (75)..(75): Xaa is any aa, unknown, or other
  misc_feature (84)..(84): Xaa is any aa, unknown, or other
  misc_feature (94)..(94): Xaa is any aa, unknown, or other
  misc_feature (117)..(117): Xaa is any aa, unknown, or other
  misc_feature (119)..(119): Xaa is any aa, unknown, or other
MACVSTFQSCPIARRAKINTRSRGCSSSVAKGSSPPAFQFQCRASTFAADTSLRLELDEKPRAIISGGVXPGTAXLSATTTSAXYSSRKKTRPXQTVQQRGVAAPERDHGQTPGWGXTXKQTGEGSQGPLSRPGSGFSGRQRGPKKGSGGVFKKKPGKRPPRGPQKKNIREGKTSPI

SEQ ID NO: 32821 - DNA, 750 bp, Zea mays
  misc_feature: Ceres CLONE 1410204-F
  misc_feature: Encodes the peptide sequence at SEQ ID NO. 32822
caaagctggagctcaccgcggtggcggccgctctagaactagtggatcccccgggctgcaggaattcgcacgagaccattacctagaacatcctaatcgaaaaattccgcgccgcatctgggaaggtctcgtcttgctcgcccccgtccgtcgccgcaccctgcgtcgtcgccatggccacgacgcagggtgcggcggcggccggagtgttcgtctcttgctccgccgggaactccggcccatccggatccaccgtctcaaactccgctccgtgggtcgccaccgtcggcgccgggacactggaccgcgacttcccggcatacgtgatgctccccacgggtgcgcgcctggccggcgtgtccctctacgcggagccttctccctccccacgccccgacatgctcccgctcctctacggaagcgggcgtgacaacgccagcaagctctgcctctccgggacgctcgacccggacgccgtgcgcggcaaaatagatgtgtgcgaccgcagcgtcaacacgagcgtgtagaaggacgacgccatgaaggcatccaccggcaccagcatgatactgcgaaacacgtgatcaagcgcagaagagctcgagaagtacaccaacggctcccaaaattgactacgagtaccagggtagccagacaagatacgtcagtaaacgccacacggtgcgtgtagacccatggtaatactgagctgcggggggaggaatactggctaccgacaccctcgggcgg

SEQ ID NO: 32822 - protein, 117 aa, Zea mays
  misc_feature: Ceres CLONE 1410204-F
  misc_feature: SWISSPROT Homolog: EC 3.4.21.25 Cucumisin
MATTQGAAAAGVFVSCSAGNSGPSGSTVSNSAPWVATVGAGTLDRDFPAYVMLPTGARLAGVSLYAEPSPSPRPDMLPLLYGSGRDNASKLCLSGTLDPDAVRGKIDVCDRSVNTSV

SEQ ID NO: 32823 - DNA, 735 bp, Zea mays
  misc_feature: Ceres CLONE 1410206-F
  misc_feature: Encodes the peptide sequence at SEQ ID NO. 32824
  misc_feature (502)..(502): n is a, c, t, g, unknown, or other
  misc_feature (503)..(503): n is a, c, t, g, unknown, or other
  misc_feature (688)..(688): n is a, c, t, g, unknown, or other
  misc_feature (702)..(702): n is a, c, t, g, unknown, or other
caaagctggagctccccgcggtggcggccgctctagaactagtggatcccccgggctgcaggaattcgcacgagaccattacctagaacatcctaatcgaaaacttcgtcttctgtcactgtcccacactcctatcattctcgccttcgacttcccaggagcgcccagcgccgcggagcttctagaacacgcgactggggcgagctagacgaagctaaggaggcgcgaggggtgacgatgcggggcaggtgacggtgcggcgtggtggaggcgggacagaggccgggggatggtggcggcggagggtgggcccgtcgaggagggcgtcggggagagctcgtccccgccgcgcgtagacgcagccccagcgccctctggctccgtatgggagcgggaggcagaggaggcgccagcgactcctggcgccgaggtgctcgagcgcctcgtcgccgacggacacagcggaggcgtccgaccccgagtttccgcgacaggctcgcgnncacatttcgggcggctcccgcacagctatcagctgggatatcaatgttgacagagcaaccgatgtcttggtccaccagaatgtcttagcggaagcaaaggatcctgataggcgccctgcattctatgttcgtattcttgaggattggagatattgatcctgcaaacgactccgagcatctgaacnaagggaatggggancgatgatgatctctctgaagggcaggacgcacc

SEQ ID NO: 32824 - protein, 87 aa, Zea mays
  misc_feature: Ceres CLONE 1410206-F
  misc_feature (72)..(72): Xaa is any aa, unknown, or other
MVAAEGGPVEEGVGESSSPPRVDAAPAPSGSVWEREAEEAPATPGAEVLERLVADGHSGGVRPRVSATGSRXHFGRLPHSYQLGYQC

SEQ ID NO: 32825 - DNA, 750 bp, Zea mays
  misc_feature: Ceres CLONE 1410207-F
  misc_feature: Encodes the peptide sequence at SEQ ID NO. 32826
  misc_feature (614)..(614): n is a, c, t, g, unknown, or other
  misc_feature (704)..(704): n is a, c, t, g, unknown, or other
  misc_feature (714)..(714): n is a, c, t, g, unknown, or other
  misc_feature (715)..(715): n is a, c, t, g, unknown, or other
aatagctggagctccccgcggtggcggccgctctagaactagtggatcccccgggctgcaggaattcgcacgagaccattacctagaacatcctaatcaaaaaatattttggttccaaatcgaataacccaatgccgccgtagccgtctgcctcctcgctttcctttcgtccgtacgccgccggctcgcaccgccgacagtcctcagtccagaactccagatcgagcctctctcttcccagatcgggtcctagggtacagcagccgccgcatccgtcaccttcacaccgcgtgcgtgctctctctcccccctccccctctccgtgcgacgactgggtgggctaccgccgccttacgcaaggtgccgagaacttcgccaaaatctgcgccggagaagagcgcccaccagatcaggagctgagaaggcgcgctggtcggtggatgacgatggcgggtggcgggggactgaaccggtcttcatcgagggggcagctgccgccgcaagagctgcttgacgatctctgcagccggttccttctgaatgtgcccaaggaggaactggagtcgttcgagaggatcctgttcctgctggagcaggcgcactggttctatgangacaactccgttgagcaaaccccaacctcaagtccctctccttcaaggacttcacttccctcatgttcaagagctgcactgctctccggncctacatcgnngcactggatgatatctacaaggacttcaacactat

SEQ ID NO: 32826 - protein, 101 aa, Zea mays
  misc_feature: Ceres CLONE 1410207-F
  misc_feature (19)..(96): Pfam Name: DCP2 Pfam Description: Dcp2, box A domain
  misc_feature (56)..(56): Xaa is any aa, unknown, or other
  misc_feature (90)..(90): Xaa is any aa, unknown, or other
MAGGGGLNRSSSRGQLPPQELLDDLCSRFLLNVPKEELESFERILFLLEQAHWFYXDNSVEQTPTSSPSPSRTSLPSCSRAALLSGPTSXHWMISTRTSTL

SEQ ID NO: 32827 - DNA, 718 bp, Zea mays
  misc_feature: Ceres CLONE 1410209-F
  misc_feature: Encodes the peptide sequence at SEQ ID NO. 32828
  misc_feature (623)..(623): n is a, c, t, g, unknown, or other
caaagctggagctccccgcggtggcggccgctctagaactagtggatcccccgggctgcaggaattcgcacgagaccattacctagaacatcctaatcgaaaagtcgcacggattggcattggctgccctccgggcctgttcctcgtcctcctcatcaaatcccgtctcctcagtcctcccaataatggtggcgtggtgagaaatccttccgtccggccgtcgtcttagaagatgaactgttcctcttgctgcgccgctgccactccatcttctccggcgcttctcgccaggccgcggtggggtttagctgctagctgctccacgacgacagcaaatcagaaggtgcttttcctgggctcaaaacagtttccacggatcacgtatagccgtgcgtcgtcacggttgtcgcggagagaggtaatagcttttgccgggcaacaaccttgggacatcgggagatttgtcaagacgctgtatttcttcaacgggcctccaaaccttctcaagattgtagaatctatcatcagcagtttcactggacctgcttctagtgaagcgccgaagaaatgaaacatcagatgtgttgctgatactgagccaccggttgtggtggctgacgaanggatgcacttctgcaaaagaagggagacctgttccagaatggcttaaatggaaacaggcagtagcatgttgggcccgaatgacttctaaccaagg

SEQ ID NO: 32828 - protein, 112 aa, Zea mays
  misc_feature: Ceres CLONE 1410209-F
MNCSSCCAAATPSSPALLARPRWGLAASCSTTTANQKVLFLGSKQFPRITYSRASSRLSRREVIAFAGQQPWDIGRFVKTLYFFNGPPNLLKIVESIISSFTGPASSEAPKK

SEQ ID NO: 32829 - DNA, 729 bp, Zea mays
  misc_feature: Ceres CLONE 1410211-F
  misc_feature: Encodes the peptide sequence at SEQ ID NO. 32830
  misc_feature (254)..(254): n is a, c, t, g, unknown, or other
aaaagctggagctccccgcggtggcggccgctctagaactagtggatcccccgggctgcaggaattcgcacgagaccattacctagaacatcctaatcgaaaagactctcccactcctctgtcgcttccgccgacacctgagtcttgtcgctgccgccgggatggccggagtcaccgccaccgggatggccggagttcccgccaccttctcctcagccaccgctcagatcgggggcttcctctcgaagaagctnacgcgccgccgttgtgggccacgcacctctcccccatgccttgccataccttctcgctcggccatttcccaacaccgattcacaagtggaatctgcccaatttgccggaaggaacggaagtgtggatcaagcgagacgatttatcaggcatgcagttgagtggaaacagggtccggaagctggagttcttgatggcagatgccgtagtacaagggcgcagctgcgttattaactggtgggggtatacagagtaaccactggcgtgccacagccgttggctgctaagatctcaatcttgattgctacctgatactacgtactcccagcttcttgtggataggacccttgggtttgtttgcaatcttcttgccagagacaagtggggcacacgtttgatctgtggaaaagaaaaaaggaaaaattggaaggggggtttactgaccggctaaaaaaggctttcgaaaaaaggaggaac

SEQ ID NO: 32830 - protein, 72 aa, Zea mays
  misc_feature: Ceres CLONE 1410211-F
  misc_feature: SWISSPROT Homolog: EC 4.4.1.15 D-cysteine desulfhydrase
MPCHTFSLGHFPTPIHKWNLPNLPEGTEVWIKRDDLSGMQLSGNRVRKLEFLMADAVVQGRSCVINWWGYTE

SEQ ID NO: 32831 - DNA, 736 bp, Zea mays
  misc_feature: Ceres CLONE 1410214-F
  misc_feature: Encodes the peptide sequence at SEQ ID NO. 32832
  misc_feature (405)..(405): n is a, c, t, g, unknown, or other
  misc_feature (421)..(421): n is a, c, t, g, unknown, or other
  misc_feature (519)..(519): n is a, c, t, g, unknown, or other
  misc_feature (547)..(547): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (591)..(591): n is a, c, t, g, unknown, or other
  misc_feature (593)..(593): n is a, c, t, g, unknown, or other
  misc_feature (602)..(602): n is a, c, t, g, unknown, or other
  misc_feature (604)..(604): n is a, c, t, g, unknown, or other
  misc_feature (627)..(627): n is a, c, t, g, unknown, or other
  misc_feature (628)..(628): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
aaagctggagctccccgcggtggcggccgctctagaactagtggatcccccgggctgcaggaattcgcacgagaccattacctagaacatcctaatcgaaaaaacaaagaaagtcgcggcggagcaatgtgctgcaacgcgaaggtctcgccactgccggttgagatggacacctccgcctccaaagtgctcaccaacgacgatctccttcacgacatccttctccgcctaggatgcccgagctgcctcgtcagtgccgcgctcaccagcaagtgctggctgcgtggcgcctccgatcaggtcttcgcgcgcgacttctgcgcggaccaccagccgcgcctacttgggatctacgtctccagcggcggcatctcctggggtcggagttcatcccattcaggcaancctgctggtggctctnagggccggagccgtcctaacttcccggagtaccctcacgcgatgctcctccctaccgacaaaggcgacgacgccttgtgtacccggcgtcgacgtcgncatctgggagtcgcacaacaagcgcggnactgtggggggggnnnccccggggggcccccnnnncccggggcncntcccctggntngccccgggggtggttcctcgccnnggtcgcccggcccggatccctgccggattaccgtggcttcggcgggggggnnnggatctacgttggcggaccccaggcggggggtaacttcctgggggaactgggacc

SEQ ID NO: 32832 - protein, 203 aa, Zea mays
  misc_feature: Ceres CLONE 1410214-F
  misc_feature (93)..(93): Xaa is any aa, unknown, or other
  misc_feature (99)..(99): Xaa is any aa, unknown, or other
  misc_feature (141)..(141): Xaa is any aa, unknown, or other
  misc_feature (146)..(146): Xaa is any aa, unknown, or other
  misc_feature (152)..(152): Xaa is any aa, unknown, or other
  misc_feature (156)..(156): Xaa is any aa, unknown, or other
  misc_feature (159)..(159): Xaa is any aa, unknown, or other
  misc_feature (160)..(160): Xaa is any aa, unknown, or other
  misc_feature (168)..(168): Xaa is any aa, unknown, or other
  misc_feature (185)..(185): Xaa is any aa, unknown, or other
MCCNAKVSPLPVEMDTSASKVLTNDDLLHDILLRLGCPSCLVSAALTSKCWLRGASDQVFARDFCADHQPRLLGIYVSSGGISWGRSSSHSGXPAGGSXGRSRPNFPEYPHAMLLPTDKGDDALCTRRRRRHLGVAQQARXCGGGXPGGPPXPGAXPLXXPGGGSSPXSPGPDPCRITVASAGGXGSTLADPRRGVTSWGNWD

SEQ ID NO: 32833 - DNA, 733 bp, Zea mays
  misc_feature: Ceres CLONE 1410216-F
  misc_feature: Encodes the peptide sequence at SEQ ID NO. 32834
  misc_feature (425)..(425): n is a, c, t, g, unknown, or other
  misc_feature (547)..(547): n is a, c, t, g, unknown, or other
  misc_feature (681)..(681): n is a, c, t, g, unknown, or other
  misc_feature (686)..(686): n is a, c, t, g, unknown, or other
  misc_feature (731)..(731): n is a, c, t, g, unknown, or other
aaaagctggagctccccgcggtggcggccgctctagaactagtggatcccccgggctgcaggaattcgcacgagaccattacctaaaacatcctaatcgaaaaacaccgcctctcgcccacacgcgaaggcacctagcagccgccactcgccgaactgaggaacacgccgggcgacgggatacagcagcagcgcgcccctctatgcccgacgcgacggcgccctgcagctgcagataaacctgttccaatgaccaaacaaaaagagggtgtggacaaaagaactgctaggaagacgatccgatctacggaaggctgtgcaaagagcattactttcgagaggaacaacaaatcagacgctgtgcagcttcacgatctgccgaatgacatcctaggtagcatactatcacggttgacattcagaganatcctcacagatgggccttgtttctcatacctggcggcggctgtgggagaagctgttgccggaaactggtcttcaccagtgccaccatgttccaacccggaaataggagcatcaaacatacnaggaccaactttgccagggagagtcaacagtttcttgcgtcagctacacactcatccactctttaataagtttgtaataaagttcggggctgcgcaggaagcacactcgccatgtcaacagatggattcgcttnctgcntccgtgtcgcgagcaagacacatcactattaatttcactcctggnag

SEQ ID NO: 32834 - protein, 161 aa, Zea mays
  misc_feature: Ceres CLONE 1410216-F
  misc_feature (59)..(59): Xaa is any aa, unknown, or other
  misc_feature (100)..(100): Xaa is any aa, unknown, or other
  misc_feature (145)..(145): Xaa is any aa, unknown, or other
MTKQKEGVDKRTARKTIRSTEGCAKSITFERNNKSDAVQLHDLPNDILGSILSRLTFRXILTDGPCFSYLAAAVGEAVAGNWSSPVPPCSNPEIGASNIXGPTLPGRVNSFLRQLHTHPLFNKFVIKFGAAQEAHSPCQQMDSLXASVSRARHITINFTPG

SEQ ID NO: 32835 - DNA, 641 bp, Zea mays
  misc_feature: Ceres CLONE 1410221-F
  misc_feature: Encodes the peptide sequence at SEQ ID NO. 32836
tggagctccccgcggtggcggccgctctagaactagtggatcccccgggctgcaggaattcgcacgagaccattacctagaacatcctaatcgaaaaactgagatgtggtcctctcctcctatcacctgacctccacacacacagacagagagacaggcacgcgcaagcaaaaattcattcatatatgcacgctcgttcgttgtcgatctcccccatcactgcacggcgcggcgcaacaagagcgagggattggagctcagctagtcgtctaatcagctagtaggtacgtgtagctaggctgcgctgcaccagctgccgtgcatgcagtgcatggcgcacgagggctctgaggcctccgtcgccagctccccgccgccccagccgccgccgtcggactcctcctggtggcgcgacatgcagcacccggctgcctacggcgcgtggtctccgtcccccgcggcgaggtggccgcccccggtatcgatggcgccggcagcgacgcatcagcagcatcagcacggcgtccggtcgactacgtcctccgacggtctctcggcctccgacgccaccgtagcgtccttcacaagcactccggagtagggctcagcctgaactccacggtgtactttgatgcccgccc

SEQ ID NO: 32836 - protein, 92 aa, Zea mays
  misc_feature: Ceres CLONE 1410221-F
MQCMAHEGSEASVASSPPPQPPPSDSSWWRDMQHPAAYGAWSPSPAARWPPPVSMAPAATHQQHQHGVRSTTSSDGLSASDATVASFTSTPE

SEQ ID NO: 32837 - DNA, 723 bp, Zea mays
  misc_feature: Ceres CLONE 1410223-F
  misc_feature: Encodes the peptide sequence at SEQ ID NO. 32838
  misc_feature (1)..(1): n is a, c, t, g, unknown, or other
  misc_feature (136)..(136): n is a, c, t, g, unknown, or other
  misc_feature (351)..(351): n is a, c, t, g, unknown, or other
  misc_feature (375)..(375): n is a, c, t, g, unknown, or other
  misc_feature (376)..(376): n is a, c, t, g, unknown, or other
  misc_feature (398)..(398): n is a, c, t, g, unknown, or other
  misc_feature (413)..(413): n is a, c, t, g, unknown, or other
  misc_feature (426)..(426): n is a, c, t, g, unknown, or other
  misc_feature (427)..(427): n is a, c, t, g, unknown, or other
  misc_feature (457)..(457): n is a, c, t, g, unknown, or other
  misc_feature (458)..(458): n is a, c, t, g, unknown, or other
naaagctggagctccccgcggtggcggccgctctagaactagtggatcccccgggctgcaggaattcgcacgagaccattacctagaacatcctaatcgaaaaacatccgtcttcctcctgtaaccagatctgggnaaatcccgcggcgacagaaacaaacgctcgctcgctcgttcgttgtccgttcattgtcttcgccggcgccgagggaccctgagagggcaggcgggcgagatggcgtgcggcggcgttgaggacgtgtacggcgaggaccgcgctaccgaggagcagctgatcacgccgtgggccttctccgtcgcaagcgctacaccctgctgcgcgacccgcgnacaacaagggctggccttctcggnnagtggagggggacggacttacntcgggggctgttgcnccgggggtttggnntccaaggactttcggaaaaaattctctggnnaacctgggccggaaaaaaaacccttggccgttaatttccaagggggccctgggggaggcaaaaagggggtttttaaaggccccttaaaaaaggggggggggggttcccgggtttaaaccccccgggggggggggtgcaaaaaaaaggggtctcccccccgcccggggggggggtcttcccccgggggaggaggaaatccctggggggtataatggggcggggagagcttttttttttttcccggggggggaatacttctctttgt

SEQ ID NO: 32838 - protein, 112 aa, Zea mays
  misc_feature: Ceres CLONE 1410223-F
  misc_feature: SWISSPROT Homolog: EC 1.1.1.40 Malate dehydrogenase (oxaloacetate-decarboxylating) (NADP(+))
  misc_feature (39)..(39): Xaa is any aa, unknown, or other
  misc_feature (47)..(47): Xaa is any aa, unknown, or other
  misc_feature (55)..(55): Xaa is any aa, unknown, or other
  misc_feature (60)..(60): Xaa is any aa, unknown, or other
  misc_feature (64)..(64): Xaa is any aa, unknown, or other
  misc_feature (75)..(75): Xaa is any aa, unknown, or other
MACGGVEDVYGEDRATEEQLITPWAFSVASATPCCATRXQQGLAFSXSGGGRTYXGGCCXGGLXSKDFRKKFSGXPGPEKKPLAVNFQGGPGGGKKGVFKGPLKKGGGGSRV

SEQ ID NO: 32839 - DNA, 559 bp, Zea mays
  misc_feature: Ceres CLONE 1410224-F
aaagctggagctccccgcggtggcggccgctctagaactagtggatcccccgggctgcaggaattcgcacgagaccattacctagaacatcctaatcgaaaagtgtcgtttcttccctttcccgtttcccccgttcagttcagcttcggttggctcgccgtactcgggtttgttcctcgcctcgcttcgcttccttccctcgcaagtcctcgtctcgaattcgctcgcggtgggagaaatcggggcgcgaggatggaccgggatcgacatcctcaccccgggtgaaccgcaatctggccaaaaataacaaaaggggaacaaacgcccaaaaaaatttaaagggggggggaaaaaaggcccccggaaaaaaacccgttttcccccgcccttttagggggggggggggggggggggaaataaacagggggggttaaaaaggggaaaagggaaaaaaaaaaaaaaaccgggcccggggggggtggggttaaaaacagaaaaaggcgggcaaaaaagaaaaatttccccgggggagggacccccccccgggggggggggcccc

SEQ ID NO: 32840 - DNA, 690 bp, Zea mays
  misc_feature: Ceres CLONE 1410226-F
  misc_feature (432)..(432): n is a, c, t, g, unknown, or other
  misc_feature (433)..(433): n is a, c, t, g, unknown, or other
  misc_feature (645)..(645): n is a, c, t, g, unknown, or other
caaagctggagctccccgcggtggcggccgctctagaactagtggatcccccgggctgcaggaattcgcacgagaccattacctagaacatcctaatcgaaaaaaactagctgttagcctacctttcccctcccagccgtgggacgcaccaccctcagcctcccagctgccgcacacgtggaggctccacgcgaccacgcggcagcggcacgccggcacgcgcgccgcccggcgcccctcagcctcgcgccctcgccggccacgcgcctcagtcttgcgctctcgccgcgttaagccggtcagccttgcgggttgcggtctcgccgccgacgccgggcgccgggattgccggctgcccgccttgccggagacgggagacgccatgtccttgctgctcctgcccctctgtcgaacctccgcggaccgcgccgnntccctggttgtcgtaggacgtcggcaggagtccctccgccgtcacccgtcagacgcgccaccgcggcgccgcctccccaggctcccctgctctgctccacagcttcagtggctcccgtggtgcgatatcacctgtccatgctgaagcaagagctggaagactcttccagtaatcatgggtgcatgtgcctctttcatcttgtggtcgacccnaccatggcaggaaccagaaatcagcaaaggtcgcggcaattcatg

SEQ ID NO: 32841 - DNA, 704 bp, Zea mays
  misc_feature: Ceres CLONE 1410238-F
  misc_feature: Translation starting site: 297
  misc_feature (614)..(614): n is a, c, t, g, unknown, or other
caaagctggagctccccgcggtggcggccgctctagaactagtggatcccccgggctgcaggaattcgcacgagaccattacctagaacatcctaatcgaaaaaaaaccgaaaaggaggacaaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgatctccggcgaggtgccggacgagccggtcgtgtcgaagaagtcggggctactcttcgagcggcggctcatcgagcgctacattgaggaccatggcaagtgtcccgccaccaaggaggactccacatggatgatatcgtggcggtcagaccaacacgatcgtgaagcccaggcctttgcaggctgcagcattccagacttctttgggattttcaaaaacgagtgggagctctcatgctttccaatttttgcttgggagcagcacttcacacagcaggacagaaacttagtcatgccctctaacaanatgacctttgctgccgggttaaaccagattaaaaaaggaggagtggcccttaagaatttttggtcaggtgaaaacagattccggggcagg

SEQ ID NO: 32842 - DNA, 716 bp, Zea mays
  misc_feature: Ceres CLONE 1410239-F
  misc_feature: Encodes the peptide sequence at SEQ ID NO. 32843
  misc_feature (616)..(616): n is a, c, t, g, unknown, or other
aaagctggagctccccgcggtggcggccgctctagaactagtggatcccccgggctgcaggaattcgcacgagaccattacctagaacatcctaataaaaaaacctagccgagtccactgtccacaccaccaccgggaggaccactaaaaaaacaagagcattaccggaaccaatcattcaatttggcagtggagagacagcggcggcaaaaccacacccacgcggtggcggacccgatcgcccgatagatctcccgccgctctcccaccaggccctcttcgccgctcgtccgatactccgacgcgcccgccatccgcacggtcctggacgacaccgaggtgtcgtccaactctttgtccgcgctcgccgactctcacacgtaggccgtcgacaacgtgctgtacgttgccgcagagatcttctgctaatagggcatgaatgtcctcctccctctctacaaattccattcagccaactcttgctcacgacttgacctcaacgccttcaatgtcatcgccaagctgcaccacatggtgcgctgtcaaagacgtcttgaagcactgcccatgactctcatgagcatggactcctgctgcgtaggcagcactactcggntgatcgcaggatcactcgtacgctgatgatcgcatactgacgctgatgatagctgcatgagagtgcgcgtatactgagaaacatccctacatagtgtgca

SEQ ID NO: 32843 - protein, 68 aa, Zea mays
  misc_feature: Ceres CLONE 1410239-F
  misc_feature (61)..(61): Xaa is any aa, unknown, or other
MNVLLPLYKFHSANSCSRLDLNAFNVIAKLHHMVRCQRRLEALPMTLMSMDSCCVGSTTRXIAGSLVR

SEQ ID NO: 32844 - DNA, 697 bp, Zea mays
  misc_feature: Ceres CLONE 1410262-F
  misc_feature: Encodes the peptide sequence at SEQ ID NO. 32845
  misc_feature (697)..(697): n is a, c, t, g, unknown, or other
tggagctccccgcggtggcggccgctctagaactagtggatcccccgggctgcaggaattccacgagaccattacctagaacatcctaatcgaaaaaaaccgagcggacgccgccatggatcgcgagtggggctccaagcccggcagcggcggcgccgcctccgcgcagaatgaggccatcgaccggcgggagcgcctccgccgcctggccctcgagaccatcgacctcgccaaggacccctatttcatgcgcaaccacctcggcagctacaagtgcaagctgtgcctgacgctgcacaacaatgagggggaactacctggcccacacgcaggggaagcggcaccagaccaacctcgccaagcgcgccgcccgcgagggcaaggacgcacccgcgcagcctcagcccaacaagcgcaagctggccccccgcaagtctgttaagattggcagacctgggtataaagtacccaaacaatatgatcctgagatggaagcacacttcgtttctttttgaaattggttacccgggaaatcgaagataattggaagccaaggccaccgttttcgtgtcattctattaacagaaaggcccaaggtggggataaagggttatcacgaacctacttttttggtgcagagccctaatgaaaattatttggattccaagaatccaagggtacagaggattggttaaan

SEQ ID NO: 32845 - protein, 70 aa, Zea mays
  misc_feature: Ceres CLONE 1410262-F
MRGNYLAHTQGKRHQTNLAKRAAREGKDAPAQPQPNKRKLAPRKSVKIGRPGYKVPKQYDPEMEAHFVSF

SEQ ID NO: 32846 - DNA, 907 bp, Zea mays
  misc_feature: Ceres CLONE 1410264-F
  misc_feature: Encodes the peptide sequence at SEQ ID NO. 32847
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (34)..(34): n is a, c, t, g, unknown, or other
  misc_feature (38)..(38): n is a, c, t, g, unknown, or other
ggtaaaacacnnnnnataaacatcctaccttctntctnttcccccccccttcaaagctggagctccccgcggaggcggccgctctagaactattggatcccccgggctgcaggaattcgcacgagaccattacctagaacatcctaatcgaaaaaactactccgtcgctttgtttgcaaagctcctcctcgatccatcgatcactgcaccggccggcggcaccgcgctcgcaggggctagccaacgagacggcagcaatggcggaccgtgaccgcagcggtatctacggcggagcccacgccacctacgggcagcagcagcagcagggaggaggcggtcgcccgaatgggtgagcaggtgaaaggacaatgctccacgacaaggaggccgacggcgaccacaaggtcgcttgaccggtggcgaacgctggttcccgtttgtggaggagattgattgcctgcgtgctttgctccgggacctagtcggtttgaccgggccttcccggcggcgtggagaggcttgttactgttggccccccgcccccggctgtttcccttggaattctttttatttaccgacgggaggcctggagagcgtgcaaacacaaacgaatcggtctctattctccctgaacttacaccgtacacaggggggggttaacacacaccccttccctcgacggcaccagtgacggtatactacataccgctccagtaccccccacccccacagaaagacattaccccaacaaccgagtatatatatataatattcattacgatcggatagccccgcttaccagcacccctcacatcaaaagaaatgtcttcaatctgtaataaatgaatagtgtatggtactcttttgaaaggggaaaaaacccactcatggaggaccgaggagaacc

SEQ ID NO: 32847 - protein, 31 aa, Zea mays
  misc_feature: Ceres CLONE 1410264-F
MADRDRSGIYGGAHATYGQQQQQGGGGRPNG

SEQ ID NO: 32848 - DNA, 676 bp, Zea mays
  misc_feature: Ceres CLONE 1410265-F
  misc_feature: Encodes the peptide sequence at SEQ ID NO. 32849
  misc_feature (360)..(360): n is a, c, t, g, unknown, or other
  misc_feature (361)..(361): n is a, c, t, g, unknown, or other
  misc_feature (387)..(387): n is a, c, t, g, unknown, or other
  misc_feature (429)..(429): n is a, c, t, g, unknown, or other
  misc_feature (431)..(431): n is a, c, t, g, unknown, or other
  misc_feature (432)..(432): n is a, c, t, g, unknown, or other
  misc_feature (658)..(658): n is a, c, t, g, unknown, or other
aaagctggagctcaccgcggtggcggccgctctagaactagtggatcccccgggctgcaggaattcgcacgagaccattacctagaacatcctaatcgaaaaagaccgtgacaagttcatcatccagccccgcttgcgcttgaccccttcaagtccaagcattccattccatccagtaccttccttgtcaccttgaccttccccctcccttcctagtcccctactcgcccagtcacagggacctcgacccgctaagcaagctccaagagcgatcgccgcagaagatcccgcgatgcaggccccgccggcgccctcctccgtcgacctgccgctggcggtggcgccgccgccggtgaaggnngcgaccccgcggcccccgcccccggnctcgctgcagcccgagtccccgggggtcttctttctccgcgncnngcgcgccgggcccctgggaaccgcccaccgccgaatcgccatcgccgtcgacctctccgacgagtccgcctacgccgtgcggtgggccgtccccaactactccgcccggggacgccgtaatcctgctccacgtgcgccccacctccggctctacggggcagactgggggccgtcgacgtctccctccccaacctaggccaccgccgcctccgaggaacggaacggnaatgcaaaaccgcgctgc

SEQ ID NO: 32849 - protein, 111 aa, Zea mays
  misc_feature: Ceres CLONE 1410265-F
  misc_feature (23)..(23): Xaa is any aa, unknown, or other
  misc_feature (32)..(32): Xaa is any aa, unknown, or other
  misc_feature (46)..(46): Xaa is any aa, unknown, or other
  misc_feature (47)..(47): Xaa is any aa, unknown, or other
MQAPPAPSSVDLPLAVAPPPVKXATPRPPPPXSLQPESPGVFFLRXXRAGPLGTAHRRIAIAVDLSDESAYAVRWAVPNYSARGRRNPAPRAPHLRLYGADWGPSTSPSPT

SEQ ID NO: 32850 - DNA, 683 bp, Zea mays
  misc_feature: Ceres CLONE 1410268-F
  misc_feature: Encodes the peptide sequence at SEQ ID NO. 32851
  misc_feature (33)..(33): n is a, c, t, g, unknown, or other
  misc_feature (629)..(629): n is a, c, t, g, unknown, or other
tacccgcggtggggggcgctctagaactagtgnatcccccgggctgcgggaattcgcacgagaccattacctagaacatcctaatcgaaaactttcgtcaactccacttctcttctccgcgtcacctcctcttcgccgccgccgacgcttcaccgggcagccagccatggatgaggagtacgacgtgatcgtactaggcacggggctcaaggagtgcatcctcagcggtctcctctctgtggacggcctcaaggttttgcatatggacagaaatgactactatggaggagattccacctcgctcaaccttaatcagctctggaagaggtttagaggggaagacaagcccccagcacatctaggtgcaagcagagactacaatgtggacatggtgccaaagtttatgatggcaaatgggacattggttcgaaccctcatccacaccgacgtgacaaagtacttgtcattcaaagctgttgatgggagctatgttttcagtaaagggaagatttacaaggtccctgccactgatatggaggctctgaagtcccctttgatgggcctattcgagaagcgcagagcaaggaacttcttcatttatgtcccaagataccatgaagctgatccanggacacatcagggattggaccttactagggtgacaactagagaacttatagcaa

SEQ ID NO: 32851 - protein, 172 aa, Zea mays
  misc_feature: Ceres CLONE 1410268-F
  misc_feature (1)..(172): Pfam Name: GDI Pfam Description: GDP dissociation inhibitor
  misc_feature (155)..(155): Xaa is any aa, unknown, or other
MDEEYDVIVLGTGLKECILSGLLSVDGLKVLHMDRNDYYGGDSTSLNLNQLWKRFRGEDKPPAHLGASRDYNVDMVPKFMMANGTLVRTLIHTDVTKYLSFKAVDGSYVFSKGKIYKVPATDMEALKSPLMGLFEKRRARNFFIYVPRYHEADPXTHQGLDLTRVTTRELIA

SEQ ID NO: 32852 - DNA, 674 bp, Zea mays
  misc_feature: Ceres CLONE 1410271-F
  misc_feature: Encodes the peptide sequence at SEQ ID NO. 32853
ggagctccccgcggtggcggccgctctagaatagtggatcccccgggctgcaggaattcgcacgagaccattacctagaacatcctaatcgaaaacacttcccgtgtttctaactccggtggctccaccaccagcaacccgtgcagcgagcccaccccgaccactgccatgtctaggcgcggcgactgtgtctacgagaacaacggcgggacctgcgtgtgcatcgccggcgtcgattactgtgtcgtcgcggcggacacccgtctctctgtcggatcagcatcctcacgcgcgacactctaagatctgcgacctgactgacaaattgtactaacatctcctgctttcaggtgataataaggtctgcacaagaactaggtgccaaagaatgctataccaacccctcataaaaaaggttgggtggcctgcatggcaaaattctttccaaataccggtacaaaagggttcctccccaataacccctcaatgggcccggggggtttaaaagaaggaaaagggggtgttttcccctttgggggggaaggtccccacaaaaaaattgttataggggccgggaaatgggcccttttgttttgcgcggccgggaaaaaaaaaaaaaaaccaaaccccttttccccccgggggggggttttccccccattgggggggaaaaa

SEQ ID NO: 32853 - protein, 44 aa, Zea mays
  misc_feature: Ceres CLONE 1410271-F
  misc_feature: SWISSPROT Homolog: EC 3.4.25.1 Proteasome endopeptidase complex
MSRRGDCVYENNGGTCVCIAGVDYCVVAADTRLSVGSASSRATL

SEQ ID NO: 32854 - DNA, 676 bp, Zea mays
  misc_feature: Ceres CLONE 1410273-F
  misc_feature (307)..(307): n is a, c, t, g, unknown, or other
  misc_feature (312)..(312): n is a, c, t, g, unknown, or other
  misc_feature (485)..(485): n is a, c, t, g, unknown, or other
  misc_feature (490)..(490): n is a, c, t, g, unknown, or other
  misc_feature (600)..(600): n is a, c, t, g, unknown, or other
  misc_feature (656)..(656): n is a, c, t, g, unknown, or other
aaagctggagctccccgcggtggcggccgctctagaactagtggatcccccgggctgcaggaattcgcacgagaccattacctagaacatcctaatcgaaaaatcttctctttctccgtcccctcccaacacgcgttccccaaattctcccaccctactagaaatccccatatccgcggcggcgccgtccatcggattcgatcctcctagcgagtcgactccatctgatcggcggagccggggcaccagccaccatgtgggcggcatcgtgcctggcgtcgtggtgcgcggcgtgcgcgtgcgaggngtggncggacggcggtcggcagcatcggccgccgctccgcccgcatcgcctactgcggcctcttcgcgctctccctcttcgcatcctgggcgcctccgcgaggtcgccgcgcccctcctccagtcgatcccatggattaaccacttccacaagaccccccgaccgcgagtggttcagnaccgnacgcggtgctcagggtcagcctcggcaacttcctcttcttcaccatcctcgccgtcatcatgggccgggataaaggaccagaaggacccccgtgacaagaccaccacggncggatggatggccaagatcttctgctgggtcatcatcgtcttcctcatgttctcgnggcccaacggggtcgtcagc

SEQ ID NO: 32855 - DNA, 677 bp, Zea mays
  misc_feature: Ceres CLONE 1410274-F
  misc_feature: Encodes the peptide sequence at SEQ ID NO. 32856
  misc_feature (172)..(172): n is a, c, t, g, unknown, or other
  misc_feature (264)..(264): n is a, c, t, g, unknown, or other
  misc_feature (369)..(369): n is a, c, t, g, unknown, or other
  misc_feature (372)..(372): n is a, c, t, g, unknown, or other
  misc_feature (444)..(444): n is a, c, t, g, unknown, or other
  misc_feature (445)..(445): n is a, c, t, g, unknown, or other
  misc_feature (534)..(534): n is a, c, t, g, unknown, or other
tccccgcggtggcggccgctctagaactagtggatcccccgggctgcaggaattcgcacgagaccattacctagaacatcctaatcgaaaaagtcctgtcaacagcgtgctcgagattataagcacaaggaatacaaggaaataagagtacagagatgccaactggtaggcntgagcgcacatcacccaggactgggagccggtggttctgcgccgtacgaagccgaaagcgcggacctcaagtcgtcgaagggcgtgaaacangcgctgcggtcgggcgcggccgtggagacggtgcgcaagtcagcagcgggcatgaacaagcactccgctgcggtggcgcccgcgcgtaagctggacgagacgacngancccgcttgcgtggagcgggtggcttgtggaggtgccccgcgccattcagaaagcgcgcgtggccaagggatnngagcagggcggagctggcaaagcgcatcaacgagcgcgcgcagggtggtgcaagagtacaaaagcgggaaaggcggcgccggccccagnccgtgcttgccaagatgaaccgccgcctcgaagtccagcctcgtggaaaaggcgttcgcgccgccactggcggcccggcggaaagtgatcctaatattctgatgggatggacttgtgcgaaatggcaacgttaatactttaac

SEQ ID NO: 32856 - protein, 78 aa, Zea mays
  misc_feature: Ceres CLONE 1410274-F
  misc_feature (19)..(19): Xaa is any aa, unknown, or other
  misc_feature (43)..(43): Xaa is any aa, unknown, or other
  misc_feature (44)..(44): Xaa is any aa, unknown, or other
  misc_feature (73)..(73): Xaa is any aa, unknown, or other
MNKHSAAVAPARKLDETTXPACVERVACGGAPRHSESARGQGXXAGRSWQSASTSARRVVQEYKSGKGGAGPXPCLPR

SEQ ID NO: 32857 - DNA, 682 bp, Zea mays
  misc_feature: Ceres CLONE 1410276-F
  misc_feature: Translation starting site: 228
  misc_feature: SWISSPROT Homolog: EC 2.6.1.1 Aspartate transaminase
  misc_feature (469)..(469): n is a, c, t, g, unknown, or other
  misc_feature (475)..(475): n is a, c, t, g, unknown, or other
  misc_feature (487)..(487): n is a, c, t, g, unknown, or other
aaagctggagctccccgcggtggcggccgctctagaactagtggatcccccgggctggaggaattcgcacgagaccattacctagaacatcctaatcgaaaaagcaaaactagcggcgcagtgacaaaagcccacagcttcttccccctcctccttctccgtcatccgtttcgctctctgccgccgccaccgcacaagaagctagctcctgcctgtaccaccccggcatggcgatgctatcccgcgcagcctcctccgcggcccggcgcccgctgctgccgccgcctaggcttctggcggtgagggcgatggcgtcgtcgctcttcggcacgtcgagcaggcgcccaagggaccccatcctcgcgtcaccgaggctttcctcgccgacccctcgtccgacaaagtgaacgtcggcgtcggcgcctaccgggacgacacgggccagccgtcgtggtcagctgcgtggcgngaggcnagcgccggatcngcggcaactccacatggagtaccttccggatgggagggagcatcaagatgattggagagtcactggaagctggcggaccggagaaaattctgacttcatcaaagataagaggataggaaggggggcaggcggtttcagggactgggggcctgccgggtcttttgtgatttccaaaaaggggttttttggcgggat

SEQ ID NO: 32858 - DNA, 688 bp, Zea mays
  misc_feature: Ceres CLONE 1410277-F
  misc_feature: Translation starting site: 258
  misc_feature (410)..(410): n is a, c, t, g, unknown, or other
  misc_feature (679)..(679): n is a, c, t, g, unknown, or other
aagctggagctccccgcggtggcggccgctctagaatagtggatcccccgggctgcaggaattcgcacgagaccattacctagaacatcctaatcgaaaaatcgcttcagctcggcgtcttcacaaacgccggcgcaaactctcgcccgagcccgacagatcttcaaattcccattccgcccaccgatcgaccttcacgccagtctcggtctcttccgaaggcgtcgcgcgcggttgtttgagaggagaggaggaaaatgagggagtgcatctccgtccacatcgggcagggcggcatccaagtcggcaacgcgtgctgggaaacttactggctcgagcacggcatccagcctgatgggcagtgcctggagataagaccgcggacatcacgatgatgccttcagcacttncttcagccagactgggtggtgggaagcacgttccccgtggcatctttcgtgatctaaaacccactgtgatcgatgaggggcgcactgggacgtaccgccagctcttccaccctgagcagctcatcagtgggaaggaggatgccgctaacaatttcgcccgtggccactacacaatggcaaggaagattggtgatctgggcttggaccgatccgcaaggttggtgacaatggcacggcctccaggggttcctggtctccaaggcgttggnggtgacact

SEQ ID NO: 32859 - DNA, 654 bp, Zea mays
  misc_feature: Ceres CLONE 1410280-F
  misc_feature: Encodes the peptide sequence at SEQ ID NO. 32860
aaagctggagctccccgcggtggcggccgctctagaactagtggatcccccgggctgcaggaattcgcacgagaccattacctagaacatcctaatcgaaaaactctgatgttgttgcttcgtataacctggtctccgaaatccgaataccccgtagcagctgcggttggatctcagatcggtgctgcggtccctcttttaatttgtttcccctccgcttccgttagcgccgactgatcgtcgagtcagatcttacaccctatatatagtctcatctagccgtcactagtgagactcgatttgattcgttccactggattaagcgctttgagcgcgctagatacgtgtcatatcacataaacaatggtgaaggctgttgctgtgcttggtagcagcgatggtgtcaagggcaccatctttttcacccaagagggagatggccctaccgctgtcaccggaagtgtctctggcctcaagcctggcctccatgggttccatgtacatgcacttggtgacaccaccaatggatgcatgtcaactggaccacactacaatcctgcgagcaaggagcatggggcaccagaagatgagaaccgccatgctggtgatcttggaaacgtgacagctggagcagatggtgttgctaatatcaat

SEQ ID NO: 32860 - protein, 97 aa, Zea mays
  misc_feature: Ceres CLONE 1410280-F
  misc_feature (1)..(97): Pfam Name: Sod_Cu Pfam Description: Copper/zinc superoxide dismutase (SODC)
  misc_feature: SWISSPROT Homolog: EC 1.15.1.1 Superoxide dismutase
MVKAVAVLGSSDGVKGTIFFTQEGDGPTAVTGSVSGLKPGLHGFHVHALGDTTNGCMSTGPHYNPASKEHGAPEDENRHAGDLGNVTAGADGVANIN

SEQ ID NO: 32861 - DNA, 747 bp, Zea mays
  misc_feature: Ceres CLONE 1410281-F
  misc_feature: Encodes the peptide sequence at SEQ ID NO. 32862
  misc_feature (298)..(298): n is a, c, t, g, unknown, or other
  misc_feature (333)..(333): n is a, c, t, g, unknown, or other
  misc_feature (339)..(339): n is a, c, t, g, unknown, or other
  misc_feature (340)..(340): n is a, c, t, g, unknown, or other
  misc_feature (343)..(343): n is a, c, t, g, unknown, or other
  misc_feature (390)..(390): n is a, c, t, g, unknown, or other
  misc_feature (400)..(400): n is a, c, t, g, unknown, or other
  misc_feature (401)..(401): n is a, c, t, g, unknown, or other
  misc_feature (419)..(419): n is a, c, t, g, unknown, or other
  misc_feature (548)..(548): n is a, c, t, g, unknown, or other
  misc_feature (574)..(574): n is a, c, t, g, unknown, or other
aagctggagctccccgcggtggcggccgctctagaactagtgggatcccccgggctgcaggaattcgcacgagaccattacctagaacatcctaatcgaaaaacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtgtgaccccccggagcaggggncgcctcgcggaggggggcccggcgcgtgcgccgtnatggcnnctnggagcggggtccccgccgacatccgcgcggcagggcgggcgtgggcncgcattgtcnngacccggggcctcatccngcgacatcaaggcgcgccggtcacccatcccgggtcatgggccaagggccccgcatcgggggcacgtttcggtggagggcccagaatccctgggaggggccggggggccgtccaacctacggtggaccnaagaggcgagggtggttgaccccccngccgacggacgcggcacccacattcaacaaggcacaaactttccggggtcccccttccgtctggcggctggccgcggacctcggcgagggcgcttccgcaggggtggcgcgagggccccccccatgatcggcacccagggggggagggccgcacccggaaacggttcgcaagg

SEQ ID NO: 32862 - protein, 49 aa, Zea mays
  misc_feature: Ceres CLONE 1410281-F
MASDGSGVVTVYGSNGAELLEPSKQPKSATFSVKVGLAQMLRGGVIMDV

SEQ ID NO: 32863 - DNA, 1846 bp, Zea mays
  misc_feature: Ceres CLONE 1410283
  misc_feature: Encodes the peptide sequence at SEQ ID NO. 32864
acggattaaactcgcacctgccctcctcgtccttgacacactgaacgagtgcccgcctgcccggagcagaaccattctcgccctctccctctggcctctgcctccgcctccgcggacgaaaccgccggctgggtccaagtttagcgcgtcggaccctcgctccccaatctcagagcaatggaggtggaggcggcggggccggataagctggcgcctccctcgccggtggagggccccggcgaaaatggcgcggccaccaaggtgcagaaggtgtaccgcagctaccggacccgccggaagctcgccgactccgccgtcgtcgtcgaggagctctggtggcaggcgctggactacgcgcgcctggagcacagcaccgtctccttcttcgacgagcccaaaccggagaccgccgcctcgcgctggaaccgcgtcagcctcaacgcatccaaggtgggccagggtttatccagagacggcaaggccctcaagctggctttccagcactggatcgaagcgatcgacccgcggcataggtatgggcacaacctgcacttctactacgatgaatggtgcaaaagccaagcaggccagccattcttctactggcttgatatcggcgagggaaaggatctggaccttcctgaatgtccaagagctttgctgaagcagcaatgcattaggtatcttggtccgcaagagcgtgagcactacgaatacatcattagcgagggaaaggttatccacaaacagtctggggaaccacttgatacaaggcgtcctaaggggactaaatggatatttgttatgagtacagcaaaaaagctttatgctggcaagaaacagagaggcgtgttccagcactccagctttctggcaggaggtgcaactatagctgctgggagattcactgcagaaagtggagtgatcaagtccatctgggcgtacagcggccactacaaacctagcgcagagaacctccacaacttcatgaacttcctcgaagagaacggagtggacctcaaagaagtcgaggtacgctcatctaccaaagaagactacaacgaggacccagtgccagtgccggtacttaacgacacacggagttccacttcagctaccatggaagaggcagaccttccacaggcggcggttcccgtccccgctctaaacagcacagagggcgacgaaggagacagccctccggaagacgaaggacgaggcagggcgaggtaccagaggaccttgtcaggcgggctgcagagccccagagccacccaagtgccccagagggcgatcctcgagaggatgaagtccaagggcgagttgtccaagtcgtaccagctcgggcacaggctgtccctcaaatggagcaccggggctggcccgaggatcgggtgcgtcaaggactacccgatggagctccggatgcaggcgctggagatggtggacctttcgcccagagggttgtcgtcgactccgtcgccgtcgaggagactgcctcctccgtgcttttcccccactaaagtcgcctcgccgacgtctccgctcgcgccagttcaggcgtccctgccgcagccaagctaggagctcgagagtagcagcattatgcatggccacgcgcaaatagcacaagaccggttccattcgagagtagcagcacaactcaatgttgtccaagtgaaacagggtgtgggcagaatctgtcacgtttcagacaccggtagctttgaagcagatatgtgctagtgtagtgtttttttttactaccatggttgaggaacctgctttgtactgtatcatctgcaaacggaataatgggcaaagcattacaaaaaaaaaaaaaaaa

SEQ ID NO: 32864 - protein, 468 aa, Zea mays
  misc_feature: Ceres CLONE 1410283
MEVEAAGPDKLAPPSPVEGPGENGAATKVQKVYRSYRTRRKLADSAVVVEELWWQALDYARLEHSTVSFFDEPKPETAASRWNRVSLNASKVGQGLSRDGKALKLAFQHWIEAIDPRHRYGHNLHFYYDEWCKSQAGQPFFYWLDIGEGKDLDLPECPRALLKQQCIRYLGPQEREHYEYIISEGKVIHKQSGEPLDTRRPKGTKWIFVMSTAKKLYAGKKQRGVFQHSSFLAGGATIAAGRFTAESGVIKSIWAYSGHYKPSAENLHNFMNFLEENGVDLKEVEVRSSTKEDYNEDPVPVPVLNDTRSSTSATMEEADLPQAAVPVPALNSTEGDEGDSPPEDEGRGRARYQRTLSGGLQSPRATQVPQRAILERMKSKGELSKSYQLGHRLSLKWSTGAGPRIGCVKDYPMELRMQALEMVDLSPRGLSSTPSPSRRLPPPCFSPTKVASPTSPLAPVQASLPQPS

SEQ ID NO: 32865 - DNA, 688 bp, Zea mays
  misc_feature: Ceres CLONE 1410284-F
  misc_feature: Encodes the peptide sequence at SEQ ID NO. 32866
  misc_feature (312)..(312): n is a, c, t, g, unknown, or other
  misc_feature (326)..(326): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
aagctggagctccccgcggtggcggccgctctagaactagtggatcccccgggctgcaggaattcgcacgagaccattacctagaacatcctaatcaaaactccctcctcttgtctattcttcttctccagtgcaaaccggcgcttctcgcgccgtccttccccttctccttgcgcaggttcaggcctgaccgcctgagaaactggaaggtggcggcgacctcgggggttgatcggcgacttgggtcggattagtttccggaagagcactggaggagaaggcctgtttggagcaaatttcgatggcaaccgncgagaccgccgtgnatcgtcgcaaggaccctctcggcccccgcgacatggatttgtcaggggaggagcacgtccccaaggcgcggaagccgtacacgatcacgaagcagcgggagaagtggacggaggacgagcaccggcggttcctggaggccctgcagctgcacggtcgcgcctgggcgcacatacaagagcacatcggcaccaagactgccgtgcaaatccggagcaccgcgcagaagtcttccaccaggtttgtcgagagtcttcgtcaggatgtaccgcctctggcggcgccgcgccggcgatccagtccccgcgcgcgccccaagaaggaggcgcgacctaccgcnnnaaaaggggggggcggggcggcc

SEQ ID NO: 32866 - protein, 129 aa, Zea mays
  misc_feature: Ceres CLONE 1410284-F
  misc_feature (41)..(86): Pfam Name: Myb_DNA-binding Pfam Description: Myb-like DNA-binding domain
  misc_feature (4)..(4): Xaa is any aa, unknown, or other
  misc_feature (9)..(9): Xaa is any aa, unknown, or other
  misc_feature (122)..(122): Xaa is any aa, unknown, or other
MATXETAVXRRKDPLGPRDMDLSGEEHVPKARKPYTITKQREKWTEDEHRRFLEALQLHGRAWAHIQEHIGTKTAVQIRSTAQKSSTRFVESLRQDVPPLAAPRRRSSPRARPKKEARPTAXKGGGGAA

SEQ ID NO: 32867 - DNA, 674 bp, Zea mays
  misc_feature: Ceres CLONE 1410301-F
  misc_feature: Translation starting site: 515
  misc_feature (253)..(253): n is a, c, t, g, unknown, or other
  misc_feature (327)..(327): n is a, c, t, g, unknown, or other
  misc_feature (423)..(423): n is a, c, t, g, unknown, or other
  misc_feature (604)..(604): n is a, c, t, g, unknown, or other
tccccgcggtggcggccgctctagaactagtggatcccccgggctgcaggaattcgcacgagaccattacctagaacatcctaatcgaaaaaaaaccccagcgcacgaactccaaaatagcgagccgaagggggccacgagtcctccacctccctctccgccgcgtcgctcgcgcttgacgcgcgccgagagccgaatcggagccacgaggcagccgccccgggcggatcgatcctagggccagggcatgggncggaggggacgccgacgccggcggcgagcccgcggacgcgcaggccacgctccacatccggtgcaccaacgccntccaagttcaccgtgcgggccgacctgggcgcccaccggtcggggcgtgtttaagggcgatcgtcgccgacaggctggcgacgtgccggcgccgcnagcagcggtggatctaccaaggcgcggaaatcttgaaggacgagcaaaccctagccaggctacggtggtggagacagaccatacaatccacatgggtaccgtggtgctgtgccatcaccaacatctactgcacctgcagccaaccaagaacctaccactgctggctcctgccagttcccgncaacgggattggggtggtttgttgcaaagtctgggtactacaggcgctgctgtaacagtgagggggtggg

SEQ ID NO: 32868 - DNA, 652 bp, Zea mays
  misc_feature: Ceres CLONE 1410303-F
  misc_feature: Encodes the peptide sequence at SEQ ID NO. 32869
  misc_feature (652)..(652): n is a, c, t, g, unknown, or other
ctagaactagtggatcccccgggctgcaggaattcgcacgagaccattacctagaacatcctaatcgaaaaaactgccagacccaagccaacaagcaagaccgcttctgcttgtgatccgaaacctttcttcgaacaaaaagaaccccacccgacgtaccgcgagccggcgatggcgacggtggcgatggacatctcgaagcccacgccggcagcgtccggtgacgaggcagcagcgggcggcgaaggggaggagcggcggcgggggcgaggggctgcggcagtactacctgcagcacatccatgacctgcagctccagatccggcagaagacccataacctcaaccgcctcgaggcccagcgcaacgacctcaactcccgagttagaatgctcagggaaagagttgcagttgcttcaagagcctggctcatatggtgggtgagggtgggtgaaggccatgggaaaaacgaaaggttctggtggaaggtacctccccgaaggcaaacaatgggggccggggatcacagttagagggtgtgcgattggccgaagaattagcggctgtcaaccgcggggtgggctcctccggaaaggcacggctcgcagggcttcccatgctggagcccgggcgaagggcacgggggcgggtcn

SEQ ID NO: 32869 - protein, 44 aa, Zea mays
  misc_feature: Ceres CLONE 1410303-F
MATVAMDISKPTPAASGDEAAAGGEGEERRRGRGAAAVLPAAHP

SEQ ID NO: 32870 - DNA, 942 bp, Zea mays
  misc_feature: Ceres CLONE 1410310-R
  misc_feature (528)..(528): n is a, c, t, g, unknown, or other
  misc_feature (942)..(942): n is a, c, t, g, unknown, or other
caccaccaagggggtgcggggccccccctcgaggtcgacggtatcgataagcttttttttttttttttttaggagaagatgttggtagttctttccttcctttgcctttacagtgtacaatagtttattcaacttacaatgctacaccaaacctgctgctcacaccgcaaaaaaagagtcatctatccctacctcaagaaactagttcatgtaggcaacaggggttgcctctcatcagttccaatcctatggctcgcatcaacagcagcaccagcagtcatatttacaaaagaagattcggatgaccggtgattttgtgtgtcttccaactctatataagtcaggctggttttgtcatcctttgaacttttagcaaagtggagaaaaaaaaaaaaaaaaaaaatagtgcggggccccctgtgtagaaaaaaaaaaaaaaagaccccctcgcccgtactgtatggagcccccccctcggccgcggggagaaaaaaagaagaagagttgcgtgggtggggggggggcggngcgcgtagggggggggggtttgacccccccccctacagcacagaaaaagagaggggagtggcggaggtgaagagaaaataatgagcgtgaacagacgcggagggtgaggcgggggaaggaagagccggtggggcgggagcgtctctcctataacggcaagcagtcagggaccaggactacgcgggcgccagactgtatgactggggatagccagcgtagaggatcgttagtatagatgagtttctatctaccaacgagtgacaatcggtacagaagaactaacctggtgagtttacaacggcgcgatgtgcctccttccaggggaaaagcggctgatcttttccaaataggacgtagaaggcacggagtggtttgatccgtcaatctaggcagattgggttatataaagaagtn

SEQ ID NO: 32871 - DNA, 728 bp, Zea mays
  misc_feature: Ceres CLONE 1410311-F
  misc_feature: Encodes the peptide sequence at SEQ ID NO. 32872
  misc_feature (408)..(408): n is a, c, t, g, unknown, or other
  misc_feature (423)..(423): n is a, c, t, g, unknown, or other
  misc_feature (477)..(477): n is a, c, t, g, unknown, or other
  misc_feature (669)..(669): n is a, c, t, g, unknown, or other
aaagctggagctccccgcggtggcggccgctctagaactagtggatcccccgggctgcaggaattcgcacgagaccattacctagaacatcctaatcgaaaaatcttcctgctcaacatcagtagcagctttagctgtagcagcgccaccggccaccgccacgccatggccaccacgttgcacaagccccttggggcgatcaccgttgacgacctcgccgcggcggcgcctgggtcggacgccaccgcgctccacgcagcgctccggcgcgcgctcgactcgcacggacccaccgaagtgtggggcgagctctgccggtccgtgctcctgtccgtctgtccccttcgccgtccaccggatgctctactacggttgctttcgccggggttcccgtcccccacgccgccnggcctggacgcccgnaccccaaggagtctgtcttgaccaatggtcggccgtgtcctccgaggcgcgtgntaggaacttgatcggcgacgcgtacaaggatcccatcaccagcttcccagacctccacaagttctccaacgagaacccagaggcgtactggaagatggtatttgaaggatatgggtatccaattcagggtagaaccttcctgcatctggagagaaacactgcatatcctgggtggggaggggctaccaggcncgagctccacgctgcctgttaatgcttgactgcaaaacccggaggaactccgacggccc

SEQ ID NO: 32872 - protein, 110 aa, Zea mays
  misc_feature: Ceres CLONE 1410311-F
  misc_feature (17)..(17): Xaa is any aa, unknown, or other
  misc_feature (22)..(22): Xaa is any aa, unknown, or other
  misc_feature (40)..(40): Xaa is any aa, unknown, or other
  misc_feature (104)..(104): Xaa is any aa, unknown, or other
MLYYGCFRRGSRPPRRXAWTPXPQGVCLDQWSAVSSEARXRNLIGDAYKDPITSFPDLHKFSNENPEAYWKMVFEGYGYPIQGRTFLHLERNTAYPGWGGATRXELHAAC

SEQ ID NO: 32873 - DNA, 663 bp, Zea mays
  misc_feature: Ceres CLONE 1410312-F
  misc_feature: Encodes the peptide sequence at SEQ ID NO. 32874
  misc_feature (314)..(314): n is a, c, t, g, unknown, or other
  misc_feature (469)..(469): n is a, c, t, g, unknown, or other
  misc_feature (491)..(491): n is a, c, t, g, unknown, or other
  misc_feature (492)..(492): n is a, c, t, g, unknown, or other
  misc_feature (506)..(506): n is a, c, t, g, unknown, or other
  misc_feature (568)..(568): n is a, c, t, g, unknown, or other
  misc_feature (618)..(618): n is a, c, t, g, unknown, or other
tacccgcggtggcggccgctctagaactagtggatcccccgggctgcaggaattcgcacgagaccattacctagaacatcctaatcgaaaaagtaatacggcacgccgttcaatctaccgggacggcgagacggagaatagaagacgtcagcactcagcagttcagcactgacccgtcggccgtcgccctcccggctcgcaaccgcatctctctcggcttctggcctcttcctagttcctaactaccaccgccacctctaccactggcctcaatctgcaaaccctagccctcgtcgccggcggccatggccganaccgtcgacgacaaggtcagctactttcaggccgtcaccggcatctccaacacggactcctggcacggagatcctcgccgcgcacaactgggacggcaggcttcgcggtgtccaccatcaccgccaaccccttctcgccctccgcttcggcctcnccctcctcgcgtgaccggcctnntccgctccggtggnggaaaaaaggggggagtacgtcgcgcccccgcccccgctgccgctgccgctgccgccagaanaaaaccgggggatccgggtggaagctggtgacgctccccttccgtggggnctcggggggggggggccggcctcgtcgcccggaacgttccggctg

SEQ ID NO: 32874 - protein, 97 aa, Zea mays
  misc_feature: Ceres CLONE 1410312-F
  misc_feature (3)..(3): Xaa is any aa, unknown, or other
  misc_feature (55)..(55): Xaa is any aa, unknown, or other
  misc_feature (63)..(63): Xaa is any aa, unknown, or other
  misc_feature (88)..(88): Xaa is any aa, unknown, or other
MAXTVDDKVSYFQAVTGISNTDSWHGDPRRAQLGRQASRCPPSPPTPSRPPLRPXPPRVTGLXRSGGGKKGGVRRAPAPAAAAAAARXKPGDPGGSW

SEQ ID NO: 32875 - DNA, 737 bp, Zea mays
  misc_feature: Ceres CLONE 1410313-F
  misc_feature: Encodes the peptide sequence at SEQ ID NO. 32876
  misc_feature (55)..(55): n is a, c, t, g, unknown, or other
  misc_feature (56)..(56): n is a, c, t, g, unknown, or other
  misc_feature (314)..(314): n is a, c, t, g, unknown, or other
  misc_feature (331)..(331): n is a, c, t, g, unknown, or other
  misc_feature (352)..(352): n is a, c, t, g, unknown, or other
  misc_feature (694)..(694): n is a, c, t, g, unknown, or other
aaaagctggagctccccgcggtggcggccggctctagaactagtgggatcccccnngggctgcaggaattcgcacgagaccattacctagaacatcctaatcgaaaaaccgttctcttctccctaatcctggtaatcagtagtagccactagcgctgctgccgttctcttcccctacccgacacaagctccaccacctctatctaccacacgccaccactgtaggagctcctccacgatcatcccgccctagagccataataattcgttgaagaggagggggttcttagaaccagagggcggctacctgtgaanggataccgtgctgctgnctgctgctgtcctcgagctanagccgtgtggtggctgtgcaaattgagagcgcagcttccaggctcagattggcttccatggggaggactcctgctgttacagcaaaacctgaggaaagggtctcggtccccgggggaaaggaaaacttttggccccaaaaccaaccccggtttgggttgtgggaaattgcccccatttggggggttttaaagagggggaaaaactccccgcttgggggaaaaattccccggcgcgccctaaaaaggggttttccggggggagagaaaaacccccgaaaattttggggtgggggaaaaaaggggtctcaaataataaaaaggggggggggagaattccccccnaaaaaaaaatctcggccccccgccacaaaaaaaaaccccccga

SEQ ID NO: 32876 - protein, 49 aa, Zea mays
  misc_feature: Ceres CLONE 1410313-F
  misc_feature (18)..(18): Xaa is any aa, unknown, or other
KLELPAVAAGSRTSGIPXGLQEFARDHYLEHPNRKTVLFSLILVISSSH

SEQ ID NO: 32877 - DNA, 723 bp, Zea mays
  misc_feature: Ceres CLONE 1410314-F
  misc_feature: Encodes the peptide sequence at SEQ ID NO. 32878
  misc_feature (339)..(339): n is a, c, t, g, unknown, or other
  misc_feature (436)..(436): n is a, c, t, g, unknown, or other
  misc_feature (600)..(600): n is a, c, t, g, unknown, or other
  misc_feature (660)..(660): n is a, c, t, g, unknown, or other
  misc_feature (707)..(707): n is a, c, t, g, unknown, or other
caaagctggagctccccgcggtggcggccgctctagaactagtggatcccccgggctgcaggaattcgcacgagaccattacctagaacatcctaatcgaaaaaaacccgaaacccactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggcaacagccgngccccgccgccgcaggcgctccgctctacctctccctctccgcccggtggccgcgcactctgctcggattgctggtgagatgcccaaagcctttgtngatcttagatgatgttgtgcaacacaccctgactaatttgcacagtattcacaaaagcttaactattttggcaggccaaggctgagggaacaaattctcagaaagtgtactttatgaatttttgagaggagtccaaggggccttttgttgatgcaacatatcanacactcactaagactcggagcaatggacgcctgtccaatacattttgcatctgcacctcngatatggtgtcacaaaactcgctgccctgacagatgcaaactgctgncgcttttttttgggag

SEQ ID NO: 32878 - protein, 89 aa, Zea mays
  misc_feature: Ceres CLONE 1410314-F
MATSPPQNPSSGEPSDASSLAAAALEAPVRVWRSLVARFPPLPDSSSFLAGVSDLQLRYFGNSRAPPPQALRSTSPSPPGGRALCSDCW

SEQ ID NO: 32879 - DNA, 685 bp, Zea mays
  misc_feature: Ceres CLONE 1410316-F
  misc_feature (365)..(365): n is a, c, t, g, unknown, or other
  misc_feature (462)..(462): n is a, c, t, g, unknown, or other
  misc_feature (548)..(548): n is a, c, t, g, unknown, or other
aaagctggagctccccgcggtggcggccgctctagaactagtggatcccccgggctgcaggaattcgcacgagaccattacctagaacatcctaatcgaaaaatacaacggtgtcagcggcctccctacgccaccgtcctcatccgccgccgtcgtccactacaccgccacggtcgtcctcggtcgcgaccgcgcccttcgttctcatccagcgccacggtctagggtttgagcactcctccatcgtctccttgcctcttctccatcatctccttgcctcttctctcctctgtgttctccctctggtcacggtcttgtttgctcttttgtttttcattcaaatcgtcgtgcatccagatctggcngtctatttttgggccaaatgcttatttcttgcagaaaccaggcatccagaattctagcgtgttctgagcacaaaagttgtacaggcatgacctatgnatcaaggaaagttgtagcagaacacgttcgtcgtcgcgaacattcgtcgagccgtgtggctactggcgctggccggtgagcaccgntcaagtccggtgtggctgctgcccctgaccagcacgaatgcgtctctggtctcccatgaaatgattagatgggcacctggatcaccgcgtctctgaaacacatgatcaccgggagcttttcaataatttaagaagga

SEQ ID NO: 32880 - DNA, 673 bp, Zea mays
  misc_feature: Ceres CLONE 1410317-F
  misc_feature: Encodes the peptide sequence at SEQ ID NO. 32881
  misc_feature (187)..(187): n is a, c, t, g, unknown, or other
  misc_feature (199)..(199): n is a, c, t, g, unknown, or other
  misc_feature (240)..(240): n is a, c, t, g, unknown, or other
  misc_feature (261)..(261): n is a, c, t, g, unknown, or other
  misc_feature (263)..(263): n is a, c, t, g, unknown, or other
aaagctggagctccccgcggtggcggccgctctagaactagtggatcccccgggctgcaggaattcgcacgagaccattacctagaacatcctaatcgaaaaaagtcatagggacattgcattggggaactacagaaaagggtccgaatcgaatccgtggtgcactgccccttccctccccacaagncgccgccggcgncgtgaggactccggcgaatggctgtccgcgtcgactcgggncttcttcggcggcgggtcggngncatactaaggctcctaaagaggtatggacaatggcaaaagctacaacagccactttcagctttgggtttctgcgacatctgggaggtcaaatctggcgcgaaaatgggaataacttaactaaagcctctcactacgagggtggaaggaaggccattttgcttctgacaacgagaccagggtgtaggggggtgtggccctcctgggggggggaatgggaactgggggaaatcttggtgaaatcctttagaaaaactgtggaaaaaaaccaggggtgggtggaaccctttcgcccattggaaacgggttaagcccccatttaaaggtgccccgcccccggggggggggggtggtttttaaaaaaaccttttcttttgggaaggggggggaaaattttttccccccggtaaag

SEQ ID NO: 32881 - protein, 54 aa, Zea mays
  misc_feature: Ceres CLONE 1410317-F
  misc_feature (16)..(16): Xaa is any aa, unknown, or other
MAVRVDSGLLRRRVGXILRLLKRYGQWQKLQQPLSALGFCDIWEVKSGAKMGIT

SEQ ID NO: 32882 - DNA, 777 bp, Zea mays
  misc_feature: Ceres CLONE 1410318-F
  misc_feature: Translation starting site: 235
  misc_feature: SWISSPROT Homolog: EC 2.3.1.41 Beta-ketoacyl-acyl-carrier-protein synthase I
  misc_feature (394)..(394): n is a, c, t, g, unknown, or other
  misc_feature (454)..(454): n is a, c, t, g, unknown, or other
  misc_feature (549)..(549): n is a, c, t, g, unknown, or other
  misc_feature (573)..(573): n is a, c, t, g, unknown, or other
  misc_feature (576)..(576): n is a, c, t, g, unknown, or other
  misc_feature (577)..(577): n is a, c, t, g, unknown, or other
  misc_feature (611)..(611): n is a, c, t, g, unknown, or other
  misc_feature (612)..(612): n is a, c, t, g, unknown, or other
caaagctggagctccccgcggtggcggccgctctagaactagtggatcccccgggctgcaggaattcgcacgagaccattacctagaacatcctaatcgaaaatcgcagccagcaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggcggaatctcccgggacgcctctccgtccgcgcctccgcgacggtggtagcggcaccgcggcgggagacggatcccaagaagcgggtggtgatcacggggnatggggctggtctccgttttcgggaacgatgtagacgcttactacgaccgcctgctagtncggggagagcggcatcgggcccatcgaccgcttcgacgcttctaagtccccacccgctttggcggtccagaatcccgggctttctcctccgaggnattacatcgacggaaagacgacgncgnncccttgatgattgcctccgatactgcatcgtcgnntggcagaagggctctcggaggcctccggtatcgccacggctcaagcccatttggaaaagatgacagaccccccgcgccgggggtggcttgggccacctttgtatatgtgggccccccccggggtgttttttcgagaggggggccccaaaatcctttttggaaaat

SEQ ID NO: 32883 - DNA, 699 bp, Zea mays
  misc_feature: Ceres CLONE 1410319-F
  misc_feature: Translation starting site: 350
  misc_feature (384)..(384): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (531)..(531): n is a, c, t, g, unknown, or other
  misc_feature (532)..(532): n is a, c, t, g, unknown, or other
  misc_feature (590)..(590): n is a, c, t, g, unknown, or other
  misc_feature (602)..(602): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (625)..(625): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (660)..(660): n is a, c, t, g, unknown, or other
  misc_feature (663)..(663): n is a, c, t, g, unknown, or other
  misc_feature (669)..(669): n is a, c, t, g, unknown, or other
  misc_feature (672)..(672): n is a, c, t, g, unknown, or other
  misc_feature (673)..(673): n is a, c, t, g, unknown, or other
  misc_feature (675)..(675): n is a, c, t, g, unknown, or other
  misc_feature (676)..(676): n is a, c, t, g, unknown, or other
  misc_feature (678)..(678): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
aaagctggagctccccgcggtggcggccgctctagaactagtggatcccccgggctgcaggaattcgcacgagaccattacctagaacatcctaatcgaaaaattttgccaatgcgacggtgaaatcccgcacctacctccttcctctctcaccgaggaccctcgcaccaagaactgagcggtaagagaggtagagaggcaagcgcacgagagtttctgctcctagtctcgtctcgccccgcctccgtctcctttccctctctggttctctctctgcgattctcgtcgcattggttccggtccctcacgaaaggcggtagctctctgtcgtccctgatctatctagataatggggatcacgacgtcagcgaccatcgcccgagnagcagccgcaccacgcaaaaccccggggggccgctctcggcctttgccaggaggggggcccgtgnnntcccacttcttccccccgggggggggaaaagggacccacttttggggaggggccaattttgcggggggaggaggggaacnntttggccccctatattttgagaaaaaaaccggggggggatctcccgcttataaaaacnttgtgggggganannnncnnnncccacaaaaaaanaannnnttttttcccccacctcctcgggggnnnancgntctccnccnngnntntnnnnnnnntcnnnnnnnnng

SEQ ID NO: 32884 - DNA, 749 bp, Zea mays
  misc_feature: Ceres CLONE 1410320-F
  misc_feature: Encodes the peptide sequence at SEQ ID NO. 32885
  misc_feature (443)..(443): n is a, c, t, g, unknown, or other
  misc_feature (485)..(485): n is a, c, t, g, unknown, or other
  misc_feature (545)..(545): n is a, c, t, g, unknown, or other
  misc_feature (611)..(611): n is a, c, t, g, unknown, or other
  misc_feature (612)..(612): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (733)..(733): n is a, c, t, g, unknown, or other
  misc_feature (749)..(749): n is a, c, t, g, unknown, or other
tccccgcggtggcggccgctctagaactagtggatcccccgggctgcaggaattcgcacgagaccattacctacaacatcctaatcgaaaaatcgaacccccgccaccaccagtgcagtagcaccattcttgacaggcacacctcgaagaacaagagctggtcctcctgccaatatgcgacagagagagagaggccaatggaagccatgtggtgggtcgtctcctccctgctgctctgcctcgccgtctcatctgcggcgggtagagcaacgccccgcgactgcgacactactgccgcctttgcgcccagcgattctcgtgccgatgccgtgaacgaggacgtcgattgatacaaaaccgtcgtagtgtttccacgccgaacccctggcttggtggatctatgtggctccttcactccacccctaggccagacccagctacgnggttcacttgtttggtcagcagcaccacctcacgcccccccncctcagtacttccccaacccgcaaccccaccatgtcagtttacggtccaggtccctcgantccacccaacccccctcactcccttcaaaacgacttaatccagatctctgcccgcctttgtatagnncccccgctcctacatcccagatcccttttggcccctcacctgttcgtgtgcnnnncatatcccctaacatgtcccccaagtccctcgcggggcacccgtttctgtttttgtgggaacattnggcgcccctactttgn

SEQ ID NO: 32885 - protein, 50 aa, Zea mays
  misc_feature: Ceres CLONE 1410320-F
MEAMWWVVSSLLLCLAVSSAAGRATPRDCDTTAAFAPSDSRADAVNEDVD

SEQ ID NO: 32886 - DNA, 729 bp, Zea mays
  misc_feature: Ceres CLONE 1410321-F
  misc_feature: Encodes the peptide sequence at SEQ ID NO. 32887
  misc_feature (422)..(422): n is a, c, t, g, unknown, or other
  misc_feature (431)..(431): n is a, c, t, g, unknown, or other
  misc_feature (598)..(598): n is a, c, t, g, unknown, or other
aaaagctggagctccccgcggtggcggccgctctagaactagtggatcccccgggctgcaggaattcgcacgagaccattacctagaacatcttaatcgaaaaaagaattcgcacgcacagagcacttttgctaaatcgctagttcgtttcctaaaccctagcaaagtaggaatggcgtcggcgagcatgctcgcgcgctcccttctccgcaccccagaccctacccaaacgagccacccgaaccgccggagcgccgctgtcgtctccttcccccgccgccaccgccgcctgtccgtgcgcgcctccgtctccacggcctccccttccccaccgccacagcccgcggcggcggctgccggcgtgccgaagcactgcttccggcgcggggccgatggctacctgtactgcgagggagtgcggntggaggacncgatgacggctgctgagcgcagccccttctacctctacagcaagccacagatcctccgcaacctcgccgcttaccgcgatgctctccaggggctccgctccatcatcgggtatggcgtgaaggggccacacaaccctcccgtgctacgcgtcctgcgtgagcttggntgcggcggcgttctcgtcagcgggaacgagctccgactcgccctccaggggggattcgaccccgccgggtgaatatttaacgggaaatggaaaaaccctcgaagatcttaaattagctgctgaaagggggt

SEQ ID NO: 32887 - protein, 165 aa, Zea mays
  misc_feature: Ceres CLONE 1410321-F
  misc_feature: SWISSPROT Homolog: EC 4.1.1.20 Diaminopimelate decarboxylase
  misc_feature (84)..(84): Xaa is any aa, unknown, or other
  misc_feature (87)..(87): Xaa is any aa, unknown, or other
MASASMLARSLLRTPDPTQTSHPNRRSAAVVSFPRRHRRLSVRASVSTASPSPPPQPAAAAAGVPKHCFRRGADGYLYCEGVRXEDXMTAAERSPFYLYSKPQILRNLAAYRDALQGLRSIIGYGVKGPHNPPVLRVLRELGCGGVLVSGNELRLALQGGFDPAG

SEQ ID NO: 32888 - DNA, 781 bp, Zea mays
  misc_feature: Ceres CLONE 1410324-F
  misc_feature (14)..(14): n is a, c, t, g, unknown, or other
  misc_feature (15)..(15): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (28)..(28): n is a, c, t, g, unknown, or other
  misc_feature (32)..(32): n is a, c, t, g, unknown, or other
  misc_feature (34)..(34): n is a, c, t, g, unknown, or other
  misc_feature (38)..(38): n is a, c, t, g, unknown, or other
gttggccccccccnncccccnnntctanattntngaanatgatattaccctgtgccttccccgggctccccgcgggggcggccgctctagaactagtggatcccccgggctgcaggaattcgcacgagaccattacctagaacatcctaatcgaaaagacgcccatgaggggcctgatctaatgtagcgttaggagaaagcctactgttccatctctttcttggagtacgagggcacgaaggcctaaccccctcgcccccaccagattcggggaattcgcgcctcatccgatcgtcaccggccgccgaagcgcaagaaacagcggcacgggttaggactctggaggatacggcggctcggcggattcaggaagtgaggatattttcttggatttctgttcttgattgaggagaggatctcgcattagctactgcgttattcactggatgttgcccatggggtaagaagaccggcagctctatccttcttccgacataggttcgcaggtcatacaatacagacctgtgtctgaagatagcgatgaccatcctaatgctgatgcgaccaggccccttcaatgctgcccccccctgatgatctcccaggacaaagcgccttttaccccctagactggccggagagcgatccatatgaatatgtgcgcctattctgtcaaaaagggtgggcgtggttgaattgagcttgtggcacattcatctcaggtcccttccccctctctcttccaagtgggcgttttcacactacccgccggtcaggcccc

SEQ ID NO: 32889 - DNA, 660 bp, Zea mays
  misc_feature: Ceres CLONE 1410327-F
  misc_feature (276)..(276): n is a, c, t, g, unknown, or other
  misc_feature (319)..(319): n is a, c, t, g, unknown, or other
  misc_feature (403)..(403): n is a, c, t, g, unknown, or other
  misc_feature (445)..(445): n is a, c, t, g, unknown, or other
  misc_feature (640)..(640): n is a, c, t, g, unknown, or other
tggagctccccgcggtggcggccgctctagaactagtggatcccccgggctgcaggaattcgcacgagaccattacctagaacatcctaatcgaaaaacccctgttcctctgcgatttgggctcgtcctgtgtccttcctgttgctcagaagctcgctcattcgatgtccctgtctgacaggcgacaaatcccactggaattccgagcacagagctttgactccaggggccaaaactttcttgctcatctcccttgcggaagagcgcctcctctgncgtctgaaagtcaggatcgtttttcacagattccatttgcagntaccgagcagtccgggacccgcgtgggctgcaagattggtttttgaaaaatctgatcacaccagagatttgctttaaattacgnccactggaacttttcccctggaaatgtcccttccaacataanccccggtgggtaaggaaaaccttttgaaacttatcaaacgcaggcctgagggcagggattttttgggttttccccggggcggccaaaaacgggtgggaactccgggagaaccctcgcccgcccaaccttgtataattttgttcaaacaagcgggggggggggccctcctccccccgaatggccccccaaaagagnaaaagaacaactctttgaaa

SEQ ID NO: 32890 - DNA, 803 bp, Zea mays
  misc_feature: Ceres CLONE 1410332-F
  misc_feature: Encodes the peptide sequence at SEQ ID NO. 32891
  misc_feature (285)..(285): n is a, c, t, g, unknown, or other
  misc_feature (336)..(336): n is a, c, t, g, unknown, or other
  misc_feature (346)..(346): n is a, c, t, g, unknown, or other
  misc_feature (690)..(690): n is a, c, t, g, unknown, or other
  misc_feature (691)..(691): n is a, c, t, g, unknown, or other
  misc_feature (718)..(718): n is a, c, t, g, unknown, or other
  misc_feature (725)..(725): n is a, c, t, g, unknown, or other
  misc_feature (743)..(743): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
catagctggagctccccgcggtggcggccgctctagaactagtggatcccccgggctgcaggaattcgcacgagaccattacctagaacatcctaatcgaaaaatcacacactaatcaacaagcaggaccagctagctagctcctcccactgctatcacccgggccccggccagccatctcgctgaaagagaaaagcgcagccctgaagactactagctcgggcattgcagtcgtcctcctggtggcgatgctggcagtccagtccgcggtggccgacatctcgntgctccgacgtgctcaacgacctgtcgccgtgcctgcccttcctgcagggncaggcagccnaacccagcgagagcaacaaacagtggctgcgacggcgtgaggaccctgtacgcgggcggcggacacaggccccgaagggcagcccacgtggccggtgcctccagggcgccctacgttcaggtccaccgctgggttcctccccgggcaaagaaattgccccgggaacggggggccctttggttggccaaaaaaaatcaccccccaaattaagggggaaaaagaacaaaagagaggggaatggggtcccttaccaaaaaccaagagacgggggggggggaggttcccggggcccgtgttaaaaaaggggggccccgccgcgaggaggaaaaaaaaaaagaattttnngaaattttggtataggggttcccaaanggggggntttttttcatgccgcagncgctcgnnnnnnnnnnnnnnnnnnnnnnnnnnnnnnnnnnnnnnnnnnnnnnnnnnnnnt

SEQ ID NO: 32891 - protein, 45 aa, Zea mays
  misc_feature: Ceres CLONE 1410332-F
  misc_feature (13)..(13): Xaa is any aa, unknown, or other
  misc_feature (30)..(30): Xaa is any aa, unknown, or other
  misc_feature (33)..(33): Xaa is any aa, unknown, or other
MLAVQSAVADISXLRRAQRPVAVPALPAGXGSXTQREQQTVAATA

SEQ ID NO: 32892 - DNA, 789 bp, Zea mays
  misc_feature: Ceres CLONE 1410335-F
  misc_feature: Encodes the peptide sequence at SEQ ID NO. 32893
  misc_feature (234)..(234): n is a, c, t, g, unknown, or other
  misc_feature (300)..(300): n is a, c, t, g, unknown, or other
  misc_feature (303)..(303): n is a, c, t, g, unknown, or other
  misc_feature (314)..(314): n is a, c, t, g, unknown, or other
  misc_feature (339)..(339): n is a, c, t, g, unknown, or other
  misc_feature (340)..(340): n is a, c, t, g, unknown, or other
  misc_feature (353)..(353): n is a, c, t, g, unknown, or other
  misc_feature (379)..(379): n is a, c, t, g, unknown, or other
  misc_feature (407)..(407): n is a, c, t, g, unknown, or other
  misc_feature (409)..(409): n is a, c, t, g, unknown, or other
  misc_feature (557)..(557): n is a, c, t, g, unknown, or other
  misc_feature (565)..(565): n is a, c, t, g, unknown, or other
  misc_feature (566)..(566): n is a, c, t, g, unknown, or other
caaagctggagctccccgcggtggcggccgctctagaactagtggatcccccgggctgcaggaattcgcacgagaccattacctagaacatcctaatcgaaaaaagaggaaagccaggcacgccgctcacccaccgcgccaccaaccgcagatcctaaatccgatctctctctctctctctctctctctctctctctctccctccctctcgaggttttcggtttcgatccggcnagcgggcgagatcttcatggcgacgtcgttcgaccgctgggagaaggacccctttctccctcgcgncgnagagggtcagnaatcccgcgatcggatggaaatcgnnttatcggtatggntgcaagaaaagagcgggggcaatccngaggcggcagcgtcactggaggcctacngntgcgcagcttccccgggagctggaaacggggctggcacccgccaggggaacttggatgaattggggggggcatcaaaaccaaacgtttggtttttggcccgagaaaaaaacccaaagctggggggtggtattttggccacccaaaccncccggcgnnttttttcccaatatataggggggggaaaacttttgtgaaaaccccccttttggcgcggggggggggccccagagggggggcccccttgggaggaggaggaaaaaaggaacaccttgttttttttcttattgcggccccttttataaaaaagaaaaaagggggcgcaccctcccttccccgggggtttatttggggggggcccacaaacaacacagaaaaaaaa

SEQ ID NO: 32893 - protein, 117 aa, Zea mays
  misc_feature: Ceres CLONE 1410335-F
  misc_feature (17)..(17): Xaa is any aa, unknown, or other
  misc_feature (18)..(18): Xaa is any aa, unknown, or other
  misc_feature (22)..(22): Xaa is any aa, unknown, or other
  misc_feature (30)..(30): Xaa is any aa, unknown, or other
  misc_feature (35)..(35): Xaa is any aa, unknown, or other
  misc_feature (53)..(53): Xaa is any aa, unknown, or other
  misc_feature (103)..(103): Xaa is any aa, unknown, or other
  misc_feature (106)..(106): Xaa is any aa, unknown, or other
MATSFDRWEKDPFLPRXXEGQXSRDRMEIXLSVWXQEKSGGNPEAAASLEAYXCAASPGAGNGAGTRQGNLDELGGASKPNVWFLAREKNPKLGGGILATQTXRRXFSQYIGGGKLL

SEQ ID NO: 32894 - DNA, 684 bp, Zea mays
  misc_feature: Ceres CLONE 1410337-F
  misc_feature: Encodes the peptide sequence at SEQ ID NO. 32895
  misc_feature (286)..(286): n is a, c, t, g, unknown, or other
  misc_feature (318)..(318): n is a, c, t, g, unknown, or other
  misc_feature (426)..(426): n is a, c, t, g, unknown, or other
  misc_feature (492)..(492): n is a, c, t, g, unknown, or other
  misc_feature (513)..(513): n is a, c, t, g, unknown, or other
tccccgcggtggcggccgctctagaactagtggatcccccgggctgcaggaattcgcacgagaccattacctagaacatcctaatcgaaaaagtttaggaacagttggaaaagagggagaaatggagaacggcggcggcaaaggcgacgttcccaacgatgcgaacgaacattgccctggaacgcagtcggaggaggcggggaaggcggatgcctgcgctgggtgccccaaccagcagatttgcgccaccgcccccaagggcccccgatcccgatgtggttgctantggttgagaggttggctactgtgaaaccaaanttattagttttgtctggaaaaggggaggtgttaggaaagagcacattctcagcccaactctcctttgccttagctgaatggacccatgcagttggccttcttgaatanaatatatgtgggccctagcatcccaaaaatgtaggggcctcgagggaaagatattcatcaagcaancccttggtggtcaccctgggnatggcgagccaacttgggcggggatgggccaatgggtttcatgctggctaaccaagaggacgggggccctagggagggtcccccgaagagggactggagcaagggtctttaaaggagggggacgggggggaaaattgaattctttggaggggggccccctcccgaacacct

SEQ ID NO: 32895 - protein, 62 aa, Zea mays
  misc_feature: Ceres CLONE 1410337-F
  misc_feature (55)..(55): Xaa is any aa, unknown, or other
MENGGGKGDVPNDANEHCPGTQSEEAGKADACAGCPNQQICATAPKGPRSRCGCXWLRGWLL

SEQ ID NO: 32896 - DNA, 764 bp, Zea mays
  misc_feature: Ceres CLONE 1410340-F
  misc_feature: Encodes the peptide sequence at SEQ ID NO. 32897
  misc_feature (378)..(378): n is a, c, t, g, unknown, or other
  misc_feature (401)..(401): n is a, c, t, g, unknown, or other
  misc_feature (412)..(412): n is a, c, t, g, unknown, or other
  misc_feature (436)..(436): n is a, c, t, g, unknown, or other
aaagctggagctccccgcggtggcggccgctctagaactagtggatcccccgggctgcaggaattcgcacgagaccattacctagaacatcctaatcgaaaacctccccatcgcgtctgtccgctacccctccccgaccagatcgctacgagacgccgcgcgatccgacccaggccgacgccgacgacccctctcgccgccggcggccatggcgtacggcgaccgcgtcaccaccttcgaggactccgagaatgagagcgagtacggctatgtccgcaaggtctctggacctgtggttgtggctgatggaatgggtggtgctgccatgtatgaacttggtcgtgtcggacatgataacctcattggggaaaatatccngtctggagggcgattcagctacnatccaaggttnatgaggaacagctggactgatggntaatggaccctgaattgaaaacagaaagccctctttcagttgaattgggaacttggattccttggaaacatttttggagggatccaagggacctctaaaacattcgtttttaggcccgggaatgggattttcccccggggggggttcacgtccctgcctggaaaaaaagggtttgggggaaatttcgccaaaaaaattggggggggggagagcccccccggggggggattctaacccccctgtggtttggaaacccttgggggggccccgttggtgctttccccgggggttttgggggaaaaaaaatttttctggcccccggggcccc

SEQ ID NO: 32897 - protein, 76 aa, Zea mays
  misc_feature: Ceres CLONE 1410340-F
  misc_feature: SWISSPROT Homolog: EC 3.6.3.14 H(+)-transporting two-sector ATPase
  misc_feature (57)..(57): Xaa is any aa, unknown, or other
  misc_feature (65)..(65): Xaa is any aa, unknown, or other
  misc_feature (68)..(68): Xaa is any aa, unknown, or other
MAYGDRVTTFEDSENESEYGYVRKVSGPVVVADGMGGAAMYELGRVGHDNLIGENIXSGGRFSYXPRXMRNSWTDG

SEQ ID NO: 32898 - DNA, 655 bp, Zea mays
  misc_feature: Ceres CLONE 1410343-F
  misc_feature: Encodes the peptide sequence at SEQ ID NO. 32899
  misc_feature (323)..(323): n is a, c, t, g, unknown, or other
  misc_feature (403)..(403): n is a, c, t, g, unknown, or other
  misc_feature (472)..(472): n is a, c, t, g, unknown, or other
  misc_feature (587)..(587): n is a, c, t, g, unknown, or other
tccccgcggtggcggccgctctagaactagtggatcccccgggctgcaggaattcgcacgagaccattacctagaacatcctaatcgaaaaagatttggatgtggactagatgcttaaggtgtgaacgtgaaagtggggtccccagatcatcacgaagggtgataatgtcagctgaagcacactacctttcatttgggaagttccttgaacttagtttttcaagccactcaaccgctagaaggctgccaatatgcgggcattcactcaatacggattgtctgcgcttttttttgggttgggctccaaagttgcaatgttccantattcctcagtcgaaatttacaatgcctgcaaaccacagcctaactcttgagattcacaaccccgatatgcacaaagatngccccaaggttgctggcctcggtgtttcgtgctctggattgttgagtcttcaatgagagctgattccgntaatatagaggtgaacaagcttttgattatttcttttggttaatttggtgaacccatatagaggtgaacaagcttatttaaaggaagatccttgtaacaatcaagagttcatacnatagatgaaacgatattgtgattctctcaatggtggcttcatgagcaagcaatcattcaccttggtca

SEQ ID NO: 32899 - protein, 119 aa, Zea mays
  misc_feature: Ceres CLONE 1410343-F
  misc_feature (75)..(75): Xaa is any aa, unknown, or other
  misc_feature (102)..(102): Xaa is any aa, unknown, or other
MWTRCLRCERESGVPRSSRRVIMSAEAHYLSFGKFLELSFSSHSTARRLPICGHSLNTDCLRFFLGWAPKLQCSXIPQSKFTMPANHSLTLEIHNPDMHKDXPKVAGLGVSCSGLLSLQ

SEQ ID NO: 32900 - DNA, 710 bp, Zea mays
  misc_feature: Ceres CLONE 1410344-F
  misc_feature: Encodes the peptide sequence at SEQ ID NO. 32901
  misc_feature (296)..(296): n is a, c, t, g, unknown, or other
  misc_feature (306)..(306): n is a, c, t, g, unknown, or other
  misc_feature (347)..(347): n is a, c, t, g, unknown, or other
  misc_feature (367)..(367): n is a, c, t, g, unknown, or other
  misc_feature (370)..(370): n is a, c, t, g, unknown, or other
  misc_feature (684)..(684): n is a, c, t, g, unknown, or other
  misc_feature (699)..(699): n is a, c, t, g, unknown, or other
  misc_feature (710)..(710): n is a, c, t, g, unknown, or other
aagctggagctccccgcggtggcggccgctctagaactagtggatcccccgggctgcaggaattcgcacgagaccattacctagaacatcctaatcgaaaaacgacgcaattcccgtcttcccacgccgtatcgccgttgctatgggcaagaagcggaagctcgagcccaaatcggcggcagggttcacgccggttaaggcctccccgaccaccaggtctgccaccgctaaggccgctggtcctatccgaggtcctcgcccccgtcgaggctacgatggagaagctgccgccaggnggcaggcggncgagggatgtagaggaaaccgagggggaaggtgggaggccnaggaggaaaagggaaagtgnaanaaggaaaaaaaaaaggggagagcggaacaggctttcgatccagggggctgctgggattccgttcccccaagggacagcttcggccaagctgtgtaaccgaagctttccatcgcttcacgggggaaggtgcttaaccaccattcccgcgcgtgggggcgacgccccaacccgggttcagggggaagaatttttcctacacgggcctccggttggggaaccccacaaaccgaaacccttcaccggagggctttcgggcccatacgggggagatagagggatctccaagggggcgtcccccgaaccgaaacacgggnaaagtggaagggggnaccgggttccn

SEQ ID NO: 32901 - protein, 107 aa, Zea mays
  misc_feature: Ceres CLONE 1410344-F
  misc_feature (52)..(52): Xaa is any aa, unknown, or other
  misc_feature (55)..(55): Xaa is any aa, unknown, or other
  misc_feature (69)..(69): Xaa is any aa, unknown, or other
  misc_feature (75)..(75): Xaa is any aa, unknown, or other
  misc_feature (76)..(76): Xaa is any aa, unknown, or other
MGKKRKLEPKSAAGFTPVKASPTTRSATAKAAGPIRGPRPRRGYDGEAAARXQAXEGCRGNRGGRWEAXEEKGKXXKEKKKGRAEQAFDPGGCWDSVPPRDSFGQAV

SEQ ID NO: 32902 - DNA, 735 bp, Zea mays
  misc_feature: Ceres CLONE 1410345-F
  misc_feature: Encodes the peptide sequence at SEQ ID NO. 32903
  misc_feature (341)..(341): n is a, c, t, g, unknown, or other
  misc_feature (366)..(366): n is a, c, t, g, unknown, or other
  misc_feature (382)..(382): n is a, c, t, g, unknown, or other
  misc_feature (413)..(413): n is a, c, t, g, unknown, or other
  misc_feature (419)..(419): n is a, c, t, g, unknown, or other
  misc_feature (422)..(422): n is a, c, t, g, unknown, or other
  misc_feature (438)..(438): n is a, c, t, g, unknown, or other
  misc_feature (452)..(452): n is a, c, t, g, unknown, or other
  misc_feature (563)..(563): n is a, c, t, g, unknown, or other
  misc_feature (604)..(604): n is a, c, t, g, unknown, or other
caaagctggagctccccgcggtggcggccgctctagaacaagtggatcccccgggcttgcaggaattcgcacgagaccattacctagaacatcctaatcaaaaaaaaaaaagttggtccgctccccacccctccgtccgaccgtcctcgacctcccgtcccgccgcctcccacagtcgcaaccctagtcccacccgccgtcctcccgccctcccgcttcccatttttcagtcgccgagccgcgtacagcgcacgcactgcacgcgcatcggcacttccagcgacgcgtcgtgagctcctccccttcgacccttcctgtggcgcgtcgtaagctctgtgcangcgacggcggcgcgctaccagtgancgggggatacggcggnatcgtctcccctcgcccctcctccatcccgntgcggncgncgccagcctacagggncaggagtaccaccnagcgagcgcgatggtgagctccgccttggagcgctgtctcccctgccatgcctctctctgtcatgccttccctccccatccgctgctggccgctgccgggttcttccgcgntcattccgggcccgggggaatggtgagactatgacgattcnaaaaaaaaggtttgtttggggggcaagacacagacaaggatcactctacgagagctccgataagctgaaaacactggtagagatcaatgctctccgggggggggggggggttttgagggggcttaggaaaa

SEQ ID NO: 32903 - protein, 44 aa, Zea mays
  misc_feature: Ceres CLONE 1410345-F
  misc_feature (34)..(34): Xaa is any aa, unknown, or other
MVSSALERCLPCHASLCHAFPPHPLLAAAGFFRXHSGPGGMVRL

SEQ ID NO: 32904 - DNA, 757 bp, Zea mays
  misc_feature: Ceres CLONE 1410349-F
  misc_feature (655)..(655): n is a, c, t, g, unknown, or other
  misc_feature (656)..(656): n is a, c, t, g, unknown, or other
  misc_feature (663)..(663): n is a, c, t, g, unknown, or other
  misc_feature (665)..(665): n is a, c, t, g, unknown, or other
aaaagctgggagctcccaccgcggtggcggccgctctagaactagtggatcccccgggctgcaggaattcgcacgagaccattacctagaacatcctaatcgaaaactagtttcatttcctcctgttccagccgctcacccaagaaccggtcgtcaggagcttgggccgaccgagctattctattctccttgttccttttggccgttcgcccctttactccttctttgtttctttgtttctttttttttcctttcttgcatctggccgctagttactctttctctctttctgtttttttttgttctagcagctggccgctagtttctcttggctgacctctcttttctctctttttttttcgaaatctgttccggtttctgttcgtgtgcttagggttcacagaaccctaaactgttcttagttttcttatacctgatctgatcggttgtagtgatttctgccgagctctcagggataaaatccctttcattattttactgtttttttttaaaaaaatgaactcggttcatcagggtttctggaactcgattcgagttgggggattctgtactaactcgtactccgagatcctctttctgtttgggactacaggagaaaacgacccccttcctccaatcgtatagagggtctgannatattantnataatttttttatttataccaccgcacagatcgacccatcggatttgttgacccgagctcttattatttttctgtgaatgaaatttctgtac

SEQ ID NO: 32905 - DNA, 696 bp, Zea mays
  misc_feature: Ceres CLONE 1410354-F
acccgcggtggcggccgctctagaactagtggatcccccgggctgcaggaattcgcacgagaccattacctagaacatcctaatcgaaaaacatccagatccgtccagatccagattcacccgtctggcacttcacttggcatcacccccgccgtcgcgccgcggccggccgggcctgcaccaaggggtccaggtgaataggtgatgcggccgactcacccgcggcgcggcgcggccctcgtgagaactgcaaaaccaccggccgtatacagtaggcctgcctgcctgcctgccagcaaaccctcccgatcggccgcactgaaatgatcagagtgagtcccctcctcctcgtccgcccgctcgcgtggtcattgccccactccctcacgcctctcgcgcccgccgctccaccacccccatccacgctcaggggaaaggggggtctgggttgcatacaggtgaaaggcacggcgccgccgctgccgcgcgagcctctccgtccccatcgggcgcggaaatgggatccagtcgtccgagccccttgtatgcgtcaggtgaagtccgtatagagttggggcttccctaagtggaatacagaagttcacatgaaaccagataaagatgagtgcggataaatcgcatctaccacatgtagggagtgtgacgtaacatgggtatttagcacgaataacgggg

SEQ ID NO: 32906 - DNA, 665 bp, Zea mays
  misc_feature: Ceres CLONE 1410355-F
  misc_feature (158)..(158): n is a, c, t, g, unknown, or other
  misc_feature (194)..(194): n is a, c, t, g, unknown, or other
  misc_feature (234)..(234): n is a, c, t, g, unknown, or other
cgcggtggcggccgctctagaactagtggatcccccgggctgcaggaattcgcacgagaccattacctagaacatcctaatcgaaaaaacggtgtcctgcacttgcacccctatgccgtcgccgcggcggcagcggcattgatctcggcgtacatggntgtggttctgggcgctgacgcgacggctgtccgggnccgcgaatgtggccccctcgtcgcagctggccagcgtcgntctgaatccgggcgcgggtcacggactgaatcgtcgaacacctgcgctccagggggaaagcggtcacgaaacagaaggggatctggcggtttgcgttctttggggcgggcccgggggttgtggaaccttccggggaaaccccggaaacctgaaaaaaatcctggggggggggttttaaaaataaacccaaggggccccaggggggaaggggggtttcccaaaattccccggggccaaggaacttttcactcccagggggggagaagggggtgttccccagaaaaaaaggggggtctcatattacccacaaaagacctttcgcccaagaaaatggggccttttgccccaccctcctaaaaaaacccggcggggggggtattcctctcaaacacggtgggggggcgcggggggaggggtctctccccccattg

SEQ ID NO: 32907 - DNA, 666 bp, Zea mays
  misc_feature: Ceres CLONE 1410357-F
  misc_feature: Encodes the peptide sequence at SEQ ID NO. 32908
  misc_feature (432)..(432): n is a, c, t, g, unknown, or other
  misc_feature (494)..(494): n is a, c, t, g, unknown, or other
  misc_feature (497)..(497): n is a, c, t, g, unknown, or other
  misc_feature (503)..(503): n is a, c, t, g, unknown, or other
  misc_feature (506)..(506): n is a, c, t, g, unknown, or other
  misc_feature (509)..(509): n is a, c, t, g, unknown, or other
  misc_feature (515)..(515): n is a, c, t, g, unknown, or other
  misc_feature (568)..(568): n is a, c, t, g, unknown, or other
aaagctggagctccccgcggtggcggccgctctagaactagtggatcccccgggctgcaggaattcgcacgagaccattacctagaacatcctaatcgaaaaacacaatacgcacacttcgcaaagcgtcttcctccgaccccatcgcctctgtggcttcctggctgtctgactgcgtctgcctggtcgtacgcgagcgcgtgcgtcccttcaccgtcacgagcggcgcacaccgtcaccgccacgctccgtcgccttccagaaaatctaaaccccagcggagccggccacggccagtcagccctcacacggactccgacgcgctgcccgctcgcctgccaaacccccaccccctcgccggcgatgctgccgcgtcgctttagcaaccacccgggctcctcctcacccctcccgttcctcgtcgtctgcggnctgctcctcgctgcgggcgtagcattttccccggccgctgccgccgaggccgctggccgcgncgnctgcgncgncgncgctgntcacgaggctcgcgcgaccaagccgaggtcgaggcgtatagcgagcgcccggnaaatgggtgccctggccaaggccaccgccaaggtgatgctccaggcaatgcccagggagcgacggggggcacctccgcgaaatgatcaagcgggcgtc

SEQ ID NO: 32908 - protein, 101 aa, Zea mays
  misc_feature: Ceres CLONE 1410357-F
  misc_feature (44)..(44): Xaa is any aa, unknown, or other
  misc_feature (45)..(45): Xaa is any aa, unknown, or other
  misc_feature (47)..(47): Xaa is any aa, unknown, or other
  misc_feature (48)..(48): Xaa is any aa, unknown, or other
  misc_feature (49)..(49): Xaa is any aa, unknown, or other
  misc_feature (51)..(51): Xaa is any aa, unknown, or other
  misc_feature (69)..(69): Xaa is any aa, unknown, or other
MLPRRFSNHPGSSSPLPFLVVCGLLLAAGVAFSPAAAAEAAGRXXCXXXAXHEARATKPRSRRIASARXMGALAKATAKVMLQAMPRERRGAPPRNDQAGV

SEQ ID NO: 32909 - DNA, 663 bp, Zea mays
  misc_feature: Ceres CLONE 1410358-F
  misc_feature: Encodes the peptide sequence at SEQ ID NO. 32910
  misc_feature (663)..(663): n is a, c, t, g, unknown, or other
gctctagaactagtggatcccccgggctgcaggaattcgcacgagaccattacctagacatcctaatcgaaaaattccactattgtctctctcgaaatcggccgtctctctcccgtccggcacttcctccgatcgactagcctgcggcggcgccggcgccggcgaccagcggccatgcgggtggcacccagggtgctcttcctcgtccgcgacgccgcgggctacggcgctgccctcgccgacgcgctccgcccgccgcccgggctaacgagggagtcctcgcccttcgagctcccccttggaaagtacggcctcgacggagagaaggcgtgcgccgagctcctgagcttttccgattccagtggctctccacaggtgaccatttttgttctgccagactataagccacctcttgcagcgtgtgttgtaaatgaggtcttggaactgatttcttctgaagctacctccactgagcgaactctaactgccccatacatcacaagatcgtcgagctatcatcatggaacggaacatgcaacaaaggcatcgacctggtactcccctgggggcggatatagggggccacgggtgagtatactccccctgttggggagggtgggagcccctaagacctccctaagtccttgtatattacgtgggggn

SEQ ID NO: 32910 - protein, 163 aa, Zea mays
  misc_feature: Ceres CLONE 1410358-F
MRVAPRVLFLVRDAAGYGAALADALRPPPGLTRESSPFELPLGKYGLDGEKACAELLSFSDSSGSPQVTIFVLPDYKPPLAACVVNEVLELISSEATSTERTLTAPYITRSSSYHHGTEHATKASTWYSPGGGYRGPRVSILPLLGRVGAPKTSLSPCILRGG

SEQ ID NO: 32911 - DNA, 717 bp, Zea mays
  misc_feature: Ceres CLONE 1410359-F
  misc_feature: Encodes the peptide sequence at SEQ ID NO. 32912
  misc_feature (331)..(331): n is a, c, t, g, unknown, or other
  misc_feature (404)..(404): n is a, c, t, g, unknown, or other
  misc_feature (450)..(450): n is a, c, t, g, unknown, or other
  misc_feature (493)..(493): n is a, c, t, g, unknown, or other
atagctggagctccccgcggtggcggccgctctagaactagtggatcccccgggctgcaggaattcgcacgagaccattacctagaacatcctaaaaaaaaaggaattctgccttcttctctcatcttcctgctcaacatcagtagcagctttagctgtagcagcgccaccggccaccgccacgctatggccaccacgttgcacaagcccctgggggcgatcaccgttgacgacctcgccgcggcggcgcctgggtcggacgccaccgcgctccacgcagcgctccggcgcgcgctcgactcgcacggacccaccgaagtgtggggcgagnctctgccggtccgtggctctgtccgtctgtccccttcgccgtccaccggatgctctactacggttgctttcgnccgggttcccgtctcccacgccggccgcctggacgcccgacccccnagggaggctgtcttggacaatggtcggccgtgtccctcgaggncgcggggtagggacttcatcggcgacgcgtacaaggatcccatcaccagctcccagaacctccacagttctccacgagaacccagagcggtactggaagaggtatttggaggaatgggtaacaattcagggaaaagcatcctgaattgggaaaaaaaccgcaaattccggggggagaggggtacaaggcccgggtcaacgggggggcaatggttgcggtaaacc

SEQ ID NO: 32912 - protein, 175 aa, Zea mays
  misc_feature: Ceres CLONE 1410359-F
  misc_feature (49)..(49): Xaa is any aa, unknown, or other
  misc_feature (73)..(73): Xaa is any aa, unknown, or other
  misc_feature (103)..(103): Xaa is any aa, unknown, or other
MATTLHKPLGAITVDDLAAAAPGSDATALHAALRRALDSHGPTEVWGEXLPVRGSVRLSPSPSTGCSTTVAFXRVPVSHAGRLDARPPREAVLDNGRPCPSRXRGRDFIGDAYKDPITSSQNLHSSPREPRAVLEEVFGGMGNNSGKSILNWEKNRKFRGERGTRPGSTGGQWLR

SEQ ID NO: 32913 - DNA, 691 bp, Zea mays
  misc_feature: Ceres CLONE 1410361-F
  misc_feature: Encodes the peptide sequence at SEQ ID NO. 32914
gctctagaactagtggatcccccgggctgcaggaattcgcacgagaccattacctagaacatcctaatagaaaaactgccaactcgcacgcagcagtacgacgtctctcctctgggtctggggccgagacaccgagcacgtactaccagcaagatggtggcgtctcccagattcaagcccatcgaggagtgctgctcggaggggcggccggagcagacggtggccgccgacctggacggtacgctgctcatctcgcagagcgggttcccctactacctcctcgtggctctcgaggtcggcagcgtcctccgcgccgcgctgctgctcctgtccgtgccgttcgtctacgtcacctacaccttcttctccgaggcgctggccatcagctacgttggagtacatgtccgcggccgcttggcacggtgttcagcatcgaagttggtgcccgtgctccgggatcctcagcttactacgcggggcaagctacaccccggagggctggaccggcgcgcgactggttttcggtgaggcggtttcccccaccccggccccacccccgttttgcgaggtattagagcccgcggccgcgtgctggcggcgcgtggggggtgggtggggtgcatgcccgccccccgggcggttctcgcaagataacagcaaggtagatgacgccgcccggtgggtgatacac

SEQ ID NO: 32914 - protein, 124 aa, Zea mays
  misc_feature: Ceres CLONE 1410361-F
  misc_feature: SWISSPROT Homolog: EC 2.3.1.15 Glycerol-3-phosphate O-acyltransferase
MVASPRFKPIEECCSEGRPEQTVAADLDGTLLISQSGFPYYLLVALEVGSVLRAALLLLSVPFVYVTYTFFSEALAISYVGVHVRGRLARCSASKLVPVLRDPQLTTRGKLHPGGLDRRATGFR

SEQ ID NO: 32915 - DNA, 850 bp, Zea mays
  misc_feature: Ceres CLONE 1410364-R
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
aaaaaaaaataatttttcacccctctccaaacccccccccccccaccnnnccccacagaatggcaccggcaccctcctcgaggtcgacggcatcgataagcttttttttttttttttttatggaagaaacggaaaatggagcatacagaaataggaccaaaaaataacatgaaggtacataacattgactagttttacttgaaagcaacagaatgccacagcatcgacgtggaacactccggccgccatatatgatcagtaccataaacttgaacagtaacacaaacagactagtagccaatcaaatattgcacaaaaacaacagtctgacacaatactgactaagaaacagatagctaagtgataggtgcttcgccaattctgaactccaggtatggatgaggcgaagtggcatcggacaagcaaaccatattcagggttgaacattcccaggtctctgatacccccccccccttaatgagaatacatggaggagaatagaaaccctggggatggctccaagaatcctgaggcgtcaacaccataaggaaaacgaagggggaaaacccccccctaaaaggcaatttttttagaaaagaaatggtttccaaaacccgaattggaaagggccccctgcaaagggaaccggggggggacccaaagaaaagccccatgcccaaaagcagggaaccaaaatgggagggaaacaaagaaacgggggacacccggaatttcctaaacacaaccccccctccgaaaaatcttctatttcctccaaaaaaaccaaaaatccccccgagagggaagaattctttgtggggccctttgtgtcaaaacacagggggggatg

SEQ ID NO: 32916 - DNA, 650 bp, Zea mays
  misc_feature: Ceres CLONE 1410364-F
  misc_feature: Encodes the peptide sequence at SEQ ID NO. 32917
  misc_feature (1)..(1): n is a, c, t, g, unknown, or other
  misc_feature (166)..(166): n is a, c, t, g, unknown, or other
  misc_feature (231)..(231): n is a, c, t, g, unknown, or other
  misc_feature (232)..(232): n is a, c, t, g, unknown, or other
  misc_feature (288)..(288): n is a, c, t, g, unknown, or other
nagagctggagctccaccgcggtggcggccgctctagaactagtggatcccccgggctgcaggaattcgcacgagaccattacctagaacatcctaatcgaaaaacatctcacacacttgggttggtgactagctagcttgctcttatccgcctgcagtccatggncaccgtcagtctcgcgctctcgctgcgattcgcgccgtcgtcgcgaccgctgagtctccacgcanngagcccgagccgtgacctggcgcgcgacaacaccacgtccaccggtcgacgccgtntgaaaaaggaaagcttaatttcgagggcccgggggaggttgtaaatggggccaaaccaaaaaaattttcctgaaattttaatccgggggtcggaacgtgtcaaaaaaaaaaagaggggggggccaattttttgttaaacccaaaaaaggtccaagaaaaaaatggggagttttctttccccccccccccttttgggggtttgtggaaaataaaaaaccccgtgggccccctttttttacagggggggaatatgttgcccctcccctaaataccccccccccttggggggggcccccccccacaaaaaggcccccccccatgtttttggggggggggttttttttcttccaaaaaaagagggt

SEQ ID NO: 32917 - protein, 56 aa, Zea mays
  misc_feature: Ceres CLONE 1410364-F
  misc_feature (2)..(2): Xaa is any aa, unknown, or other
  misc_feature (24)..(24): Xaa is any aa, unknown, or other
  misc_feature (43)..(43): Xaa is any aa, unknown, or other
MXTVSLALSLRFAPSSRPLSLHAXSPSRDLARDNTTSTGRRRXKKESLISRARGRL

SEQ ID NO: 32918 - DNA, 728 bp, Zea mays
  misc_feature: Ceres CLONE 1410368-F
  misc_feature: Encodes the peptide sequence at SEQ ID NO. 32919
caaagctggagctccccgcggtggcggccgctctagaactagtggatcccccgggctgcaggaattcgcacgagaccattacctagaacatcctaatcgaaaaaatgtcaaatctctcgcgagcgaggcagacccacgggccgcggccatctcacggtggaagcagccaagcagccggcctggcgcccctccccttccgtcccgccgctgctgccgtgcctcgtgcctgccagcggcggatgccgccccgccccgctgctgaccaccgccgctgctgagcatggccgccgctcccgcgggcgctcagaaccgctgcgtcttcgttggcaacataccatatgatgcgacggaggagcagctcgtgcagatttgcgaagaagtcggcccagtcgtatccttcagattggtgattgacaaagagaccggcaagccaaaaggttatggcttttgcgagtacaaggatgaggaaactgctttaagtgcacgccggaaccttcaggggtacgagattaatggtcggcaggtacggtggtgattttgctgaaagggggagggacactgatagaataaagaaaagggtcgtggaggaaccaggatggcatctaatgttgtaagccaaacggttagcggggacttctgttggtggggaaacaaattttcatcagcggttgggctccaccggaaaaaaggctggatctgggagggtgggggccttgggggagtcaaaa

SEQ ID NO: 32919 - protein, 84 aa, Zea mays
  misc_feature: Ceres CLONE 1410368-F
  misc_feature (13)..(84): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAAPAGAQNRCVFVGNIPYDATEEQLVQICEEVGPVVSFRLVIDKETGKPKGYGFCEYKDEETALSARRNLQGYEINGRQVRW

SEQ ID NO: 32920 - DNA, 676 bp, Zea mays
  misc_feature: Ceres CLONE 1410369-F
  misc_feature: Encodes the peptide sequence at SEQ ID NO. 32921
  misc_feature (338)..(338): n is a, c, t, g, unknown, or other
  misc_feature (386)..(386): n is a, c, t, g, unknown, or other
  misc_feature (416)..(416): n is a, c, t, g, unknown, or other
  misc_feature (493)..(493): n is a, c, t, g, unknown, or other
  misc_feature (572)..(572): n is a, c, t, g, unknown, or other
  misc_feature (609)..(609): n is a, c, t, g, unknown, or other
tccccgcggtggcggccgctctagaactagtggatcccccgggctgcaggaattcgcacgagaccattacctagaacatcctaatcgaaaaagaccaaccaaacacacacaactgtagccgtcgtcgtcgttggcgtgcgtgttgctctgctttcggagcccgtgcgcgagcggaaccaaagtaccagaccatggagggcctgctgccgttcctgtaccgggccatcctccacctcgccagcggcgggcagtcgcccatcggcaaccccttcttccgcgacgatcggccgccggagtcgccgctggcggggcactactacgtccgcctcgccgcgggncgcccgacgtgccggccttcctctcctccgcggcgcgcggctatacgnaaccgcgggtgagagcccggccggaccagnaacgacgctggggcctgggcgtgcgagcaggaagaatcctcgtgtgctccttcagttgcgtgttcagaagtgctggntctcctcccctcttcttgtggcttcttggagattctcctccccctccccctcctttgctccttggaataaaggcatggnatggatgaggtccagccatccaggggggccgcgtcgnttttcttccattggatataggccatatatgacgtgaccaaaaaaaaaaaaaaaaaagcttatcgata

SEQ ID NO: 32921 - protein, 68 aa, Zea mays
  misc_feature: Ceres CLONE 1410369-F
MEGLLPFLYRAILHLASGGQSPIGNPFFRDDRPPESPLAGHYYVRLAAGRPTCRPSSPPRRAAIRNRG

SEQ ID NO: 32922 - DNA, 725 bp, Zea mays
  misc_feature: Ceres CLONE 1410371-F
  misc_feature (558)..(558): n is a, c, t, g, unknown, or other
  misc_feature (573)..(573): n is a, c, t, g, unknown, or other
aaagctggagctccccgcggtggcggccgctctagaactagtggatcccccgggctgcaggaattcgcacgagaccattacctagaacatcctaatccaaaaagaggctggcgcacctgcgtcactcgctccgcgctgccgcgatctcctctgacgtcgaagtcgcccgggggatgacacagggggaaggggtggtgtgggaggtgtgaacaggagctcggtgacttttgtgaggagcgcctgatggaggagcgccgactcgacacgccggcgatgaggagaatcagcgagtggtatatacgttccgagcttctcctaccttccctcctgcggctccttgctctacttttcattaattggcatgtcagctgctggtgtttcgcatttgattcgacgagttcgtgtcagtaaccggcgccgctgataggttgttcggtctgattttgaactgagaacagacagatatcgtcattaaggtatgaacacgtgtgctgtgattacatatcttcacgcatttacccgctgaagcgttgctctagacaaccctgaaaatgaagntttggggagcttgangcgggctctgttgctcgctgatagctgctggatcttttccatagagttgcaagtgagtcaacatcgggtttgggatagttactataagttgtgcaagctccggtggaagctagcgatctaggtccgtggatccaacgggtataatggctcat

SEQ ID NO: 32923 - DNA, 687 bp, Zea mays
  misc_feature: Ceres CLONE 1410372-F
  misc_feature: Encodes the peptide sequence at SEQ ID NO. 32924
  misc_feature (341)..(341): n is a, c, t, g, unknown, or other
  misc_feature (548)..(548): n is a, c, t, g, unknown, or other
  misc_feature (549)..(549): n is a, c, t, g, unknown, or other
tccccgcggtggcggccgctctagaactagtggatcccccgggctgcaggaattcgcacgagaccattacctagaacatcctaatcgaaaaaaatcgaatcctcatcgctccgtctatggcgactctaaccatgcagccgatcggtcccacccctgctccggctgcgcagcaagacccaagcaagggagagaatcctcctaccgtggatggtaccgatctgggtgacatcgacttgggctgggttatcctcaagaactcggatgtcgtttccgcggatttggcagccgccgccgatctgtggcggtcagcgtctaggctcttctacgattcctagctgggncacggtgggttctcaggagggtgtggtttaacacgctcgtgccgttctacaacagagttaggcatctcgaaacgagaaccgctgggattcgtggaattgcgtttggggaaagtttggggacccatttaagctgaagtaacagaggaactaagctggcgaatgtggctaagcaacttccctgtgaagatgggtctcggcagaaagcannggggaaagaggttgaacaaattggctgagggtagtgggaggatgattgcggaaaaagggttgaagcagtcactgaaaagaacgaacagggtccagggaaggagattggatgctgcctgggggaggcgggtcattcgcg

SEQ ID NO: 32924 - protein, 72 aa, Zea mays
  misc_feature: Ceres CLONE 1410372-F
MATLTMQPIGPTPAPAAQQDPSKGENPPTVDGTDLGDIDLGWVILKNSDVVSADLAAAADLWRSASRLFYDS

SEQ ID NO: 32925 - DNA, 746 bp, Zea mays
  misc_feature: Ceres CLONE 1410374-F
  misc_feature: Encodes the peptide sequence at SEQ ID NO. 32926
  misc_feature (257)..(257): n is a, c, t, g, unknown, or other
  misc_feature (258)..(258): n is a, c, t, g, unknown, or other
  misc_feature (504)..(504): n is a, c, t, g, unknown, or other
  misc_feature (611)..(611): n is a, c, t, g, unknown, or other
aaagctggagctccccgcggtggcggccgctctaaaactagtggatcccccgggctgcaggatttcgcacgagaccatttacctaaaacatcctaatcgaaaagcgggtgctgcgcgtgctcgtgggcgggcggaattcggggttcttgcgcggtcccggtcccctcggcgattgcggacgctctctgcagatcttcgcgtaactccgggagcgcgccggagatgaactgcgggccgcccgacagcttgccgccggnngtcggcgccgtcgtgcttcctcaacctgaactgggaccagtctatggccgccgaccagctcgacccggcgctcagctcgatggtctcctccccggcgtccaactcgacgggccgccgccgcggttactgacggccgcgctctccacgggatctctccgcagcagcagtacgggaggactccgctcagctcccccccaggtcaacctgttccaccaaactcgcccccagttccacacttcccggcgncggaaggtcggcggcctgccaatcctggagacctggatggcgatggggcatttaaaccagttcctcgccgacccaggttcccccaaggggggggggcggttttcccntttcaaggccgcccccgggggaaagggtttttgggggggcgtcccttcccccggaaatgttggttcccccggaaccccgccccttggggatttagaagaaggtggagcttcggaaacccgggaggaaaattcctt

SEQ ID NO: 32926 - protein, 68 aa, Zea mays
  misc_feature: Ceres CLONE 1410374-F
  misc_feature (24)..(24): Xaa is any aa, unknown, or other
MAMGHLNQFLADPGSPKGGGRFSXFKAAPGGKGFWGGVPSPGNVGSPGTPPLGDLEEGGASETREENS

SEQ ID NO: 32927 - DNA, 712 bp, Zea mays
  misc_feature: Ceres CLONE 1410375-F
  misc_feature: Encodes the peptide sequence at SEQ ID NO. 32928
  misc_feature (429)..(429): n is a, c, t, g, unknown, or other
  misc_feature (512)..(512): n is a, c, t, g, unknown, or other
  misc_feature (656)..(656): n is a, c, t, g, unknown, or other
cgcggtggcggccgctctagaactagtggatcccccgggctgcaggaattcgcacgagaccattacctagaacatcctaaaaaaaaaaacctagctagatttagaggaaaaaaaaaactgtccccaaccgtgagatggctgagtacggcgagcgctaccagggcaacggcgacccggccacgcccgagggtggctacgcgcagaccgagtacgccgccgccggtggctcgccgcccgccgaccgcaagccctccgtgttctccgaccacgctgacggtcgctcctcccagccccagcatgagactcatcaccatgggcagtgggttcctccaaatctcgagaaagggaccgagaacgtgataaagggaaaggacagggagcgaggcaaaagaccgtgtccgcgaaaaaaggagagggaccgagcagggnaacaagggatcgtggaaagagggacagagaacaaggggtatcggtgatcgccacccacaatgaatcggtcgcgagcgcagcgnagataaggaacaccccgtggatccggtttggagggaatcgtgaccgtcaccgccgatggaatcgggaccccgtccccagggagtcctggattctggaaaggaggagaaagaaatcgggggaacagaaatggccccatcgtaggntattcgctcccgttccccttttctaagaggtcccgggcccgtggaccgccaaaatt

SEQ ID NO: 32928 - protein, 113 aa, Zea mays
  misc_feature: Ceres CLONE 1410375-F
  misc_feature (99)..(99): Xaa is any aa, unknown, or other
MAEYGERYQGNGDPATPEGGYAQTEYAAAGGSPPADRKPSVFSDHADGRSSQPQHETHHHGQWVPPNLEKGTENVIKGKDRERGKRPCPRKKERDRAGXQGIVERGTENKGYR

SEQ ID NO: 32929 - DNA, 763 bp, Zea mays
  misc_feature: Ceres CLONE 1410376-F
  misc_feature: Encodes the peptide sequence at SEQ ID NO. 32930
  misc_feature (493)..(493): n is a, c, t, g, unknown, or other
  misc_feature (568)..(568): n is a, c, t, g, unknown, or other
  misc_feature (711)..(711): n is a, c, t, g, unknown, or other
  misc_feature (713)..(713): n is a, c, t, g, unknown, or other
  misc_feature (727)..(727): n is a, c, t, g, unknown, or other
  misc_feature (744)..(744): n is a, c, t, g, unknown, or other
aaagctggagctccccgcggtggcggccgctctagaactagtggatcccccgggctgcaggaattcgcacgagaccattacctagaacatcctaatcgaaaaaaatcccgctgcttccgccaccggctaccctcgcggcctcgcccgtggccacctcctttcctctttccatttccgttcctccgctcccgatccctaaaccctacctaccccaaacccgcggcggcggcggcgcgactgttgggtttccttggtcatgggctgcttcctctcctgcttccggggcggctccaacccgtcgggcgatctccgcgacccgctcgtgagggagagccgcatcggggacgcctttgtcaacgacgagaagaagcttgatgaagcgactggaaagctggatgtcgaggcggctactgaccacggagtcgacgacgagcttcggagagaggcaaattatctcagatcatgtggcacaatatcacagaccccaccgganattctagattcaatcccaatcaactcagaagatgctaacgagtgcggcgatacaccgaccaacgtgcagcagagnaaacatggtagggggtagtttgaagagaactcatctgaactgctcaactccgattgatcacgatgtactacataagcaggccactgaatgaagggaggactcttcaggacgggatcagagactcaccatcccttagaaagagntnagccttcgggccancagaaacgtggtgagangacaaagcaccgactccgg

SEQ ID NO: 32930 - protein, 109 aa, Zea mays
  misc_feature: Ceres CLONE 1410376-F
  misc_feature (79)..(79): Xaa is any aa, unknown, or other
  misc_feature (104)..(104): Xaa is any aa, unknown, or other
MGCFLSCFRGGSNPSGDLRDPLVRESRIGDAFVNDEKKLDEATGKLDVEAATDHGVDDELRREANYLRSCGTISQTPPXILDSIPINSEDANECGDTPTNVQQXKHGRG

SEQ ID NO: 32931 - DNA, 730 bp, Zea mays
  misc_feature: Ceres CLONE 1410378-F
  misc_feature: Translation starting site: 282
  misc_feature (641)..(641): n is a, c, t, g, unknown, or other
  misc_feature (651)..(651): n is a, c, t, g, unknown, or other
  misc_feature (654)..(654): n is a, c, t, g, unknown, or other
  misc_feature (679)..(679): n is a, c, t, g, unknown, or other
  misc_feature (685)..(685): n is a, c, t, g, unknown, or other
  misc_feature (686)..(686): n is a, c, t, g, unknown, or other
  misc_feature (697)..(697): n is a, c, t, g, unknown, or other
caaagctggagctccccgcggtggcggccgctctagaactagtggatcccccgggctgcaggaattcgcacgagaccattacctagaacatcctaatcgaaaaaattcgaagccttcccggttaccccttcggcctccacctatcaccacccgggacgtcttccatggcctcctcgtagtagaatagctctatctcaccgcaacaactcctcattacatcctttatgagaggctgatcgattggtagatacgtactcgggtggagcagaacaacgagagacatggcgacgacgacgcgtgttgccgccaccgccgccggcgtgctgctggtcctgtcggcgttggcgaccctggcgcgggccgaggacccgtacctgttcttcgagtggaaggtgacgtacgggaccaagtccctgctgggcgtgccccagaaggtcatcctcatcaacggcgagttccccggccccaggatcaactgctccctccacacaacatcgtcgtcaatgtcttcaccagctcgaccatccgctccttttcacctggaacgggatgcagcacaggaagaactcgtggatgggacggatgcccagcacgcagtgtccgatcctggctaaacacactccacgtacaagtgcagcccnaggacagatncgnagctcttctacttcccgtcatcggnatgaannggggcgcgggncgctacggggccattcaggggtcagccgctccc

SEQ ID NO: 32932 - DNA, 678 bp, Zea mays
  misc_feature: Ceres CLONE 1410380-F
  misc_feature: Encodes the peptide sequence at SEQ ID NO. 32933
ggagctccccgcggtggcgagcgctctagaactagtggatcccccgggctgcaggaattcgcacgagaccattacctagaacatcctaatcgaaaaaacacaacaatctctctcccctcactccctctctgcagcgcgcagctttcaaagcgttgggagagatggcagaggagacgcaaccagaggccgcagccgccgccgcgcccgccgcggccgaggtagtcgtgaccgaagctgcgccggcggaggcggaggtgcctgcggcggcggaagctgaagccgaggccaaggatgagaagaaaggtgacgaggcggagctcaccgccgatgacgcgggggtggggaccggctcgttcaaggaggaaagcaacctggtggaagacctgcccgacccggagaagaaggcgctcgacgagttcaagcagctgatcgctgctgccctcgccgccggtgagttcaatctgcctcccccgccgccgccgccgaaggccaaggaaacaaaggtggaggaagccaaggcccaggtggctgcggatgccccggttgaggaggtcaagacggaggtgccgccggccgaggaggccaaggctgagacactggctgaggaagccaagccttccgagcccgagccgcaggagaagaccgtcgtggtcactgaggaggagactgccaccaaga

SEQ ID NO: 32933 - protein, 172 aa, Zea mays
  misc_feature: Ceres CLONE 1410380-F
MAEETQPEAAAAAAPAAAEVVVTEAAPAEAEVPAAAEAEAEAKDEKKGDEAELTADDAGVGTGSFKEESNLVEDLPDPEKKALDEFKQLIAAALAAGEFNLPPPPPPPKAKETKVEEAKAQVAADAPVEEVKTEVPPAEEAKAETLAEEAKPSEPEPQEKTVVVTEEETATK

SEQ ID NO: 32934 - DNA, 692 bp, Zea mays
  misc_feature: Ceres CLONE 1410382-F
  misc_feature: Encodes the peptide sequence at SEQ ID NO. 32935
  misc_feature (405)..(405): n is a, c, t, g, unknown, or other
  misc_feature (441)..(441): n is a, c, t, g, unknown, or other
  misc_feature (513)..(513): n is a, c, t, g, unknown, or other
cgcggtggcggccgctctagaactagtggatcccccgggctgcaggaattcgcacgagaccattacctagaacatcctaatcgaaaagtgtatcgcggaattttttgggttctcgggctccgccgcgatcccatccccatccccgccttgccgttgccgttgccggcccccccggttctcccggagctttctttctggccggcgcagtagagaagcaagacagaattgcggcggcgcctgcccgcgcaaaggaaataatcagcactgtttgccaaaggcagctcctgacgcatggctagtacttaaggatactttatgtgcagaccatgaagatagatgacgaaaggccttaccaaactcatatttttcatgatcttgcatctaacggcagtcctaaattagacntgtgaggctgaaagacaaagtaatcacaaggttganggcagataaaatggttgagcaaaccaatcaatctgaagttagcttttgtgaaggctgagcatcctgaatggnaggtaaaattcggaagacacgcattgaggattactccatggaccaggaggggtttgtagagatcaaactgccagacacagatcttcttcgggggatacgggggccatttgggcccaaggatgctgcattttattaaaagggaattctttccaaatcaaaagatttcttcagaaaagcag

SEQ ID NO: 32935 - protein, 46 aa, Zea mays
  misc_feature: Ceres CLONE 1410382-F
  misc_feature (2)..(2): Xaa is any aa, unknown, or other
MXGKIRKTRIEDYSMDQEGFVEIKLPDTDLLRGIRGPFGPKDAAFY

SEQ ID NO: 32936 - DNA, 642 bp, Zea mays
  misc_feature: Ceres CLONE 1410384-F
  misc_feature: Encodes the peptide sequence at SEQ ID NO. 32937
acccgcggtggcggccgctctagaactagtggatcccccgggctgcaggaattcgcacgagaccattacctagaacatcctaatcgaaaaattcctcctgccccatctcctcccgatccatccgagcccaaaccctagtccagccagatctccgccgtcgccggcgagagcacggtatcagatccgccgcgatggcgttccgccgcatcttatccacagcggtgcgccgccgctcggccatcgccgcgccagcggccggtaacgcgcgcgaggcctccacgggcgtcgccgcggcgcccggcgtggtagcccccgatgcgaccccggtgcgtgctcccgtgatgccgtacgatcgcatcgacgaagccgttaacgccaggctccggcggcttgagcacccagacccgcgcttcctccgctatgcaagccccgtgccgtcccacgccgaccacacggccatccttgcggcgccggagacccggctcaccacgctgcccaacggcctgcgcgtggccacggaatcgtccctcgccgcgcgcacggctactttgggtgtgcggatcgatgcccgccgcaagttcccaaacgagcaggcggcccgtcgtcccccaatcttgtcaagcaacttgctgccccaggcta

SEQ ID NO: 32937 - protein, 150 aa, Zea mays
  misc_feature: Ceres CLONE 1410384-F
  misc_feature: SWISSPROT Homolog: EC 3.4.24.64 Mitochondrial processing peptidase
MAFRRILSTAVRRRSAIAAPAAGNAREASTGVAAAPGVVAPDATPVRAPVMPYDRIDEAVNARLRRLEHPDPRFLRYASPVPSHADHTAILAAPETRLTTLPNGLRVATESSLAARTATLGVRIDARRKFPNEQAARRPPILSSNLLPQA

SEQ ID NO: 32938 - DNA, 627 bp, Zea mays
  misc_feature: Ceres CLONE 1410394-F
ccccgcggtggcggccgctctagaactagtggatcccccgggctgcaggaattcgcacgagacctttacctagaacatcctaatcaaaaagacgtccacagtgcgccgtgttctgccgcgcctgcgttcccaccgcgtgtccgcaactctgccccacctcacatccgcgtccgcaatccgcgcctccgccgccgcagcccttcctccgcgcagcgtccgtccatccatggctctccctacacgcagtgtcgtgccgctttccgcaatccgtgcctcaatccccttccttcgcgcagtgcccttccatccatggctcgcttccagaaatcccctacctacggcgcagcgtcgcagtcaggaatccgcccccaaaatcactacccgctctgcggcgatggaagggaatcaatccgtcaatggaaggaacacgtgcttcccccttccatcctcggcgctgcgcggattgcggattgcatggccatcgtttcgcgccccaatccgtcgatgcaaggaacgcgtgcttcccccttccatcctcggcgctgcgcgaattgcagattgcatggtcatcgtttcgccccagttcattgcccgcatcagatggaagggtgccccgatccgcctcac

SEQ ID NO: 32939 - DNA, 634 bp, Zea mays
  misc_feature: Ceres CLONE 1410395-F
  misc_feature: Encodes the peptide sequence at SEQ ID NO. 32940
  misc_feature (181)..(181): n is a, c, t, g, unknown, or other
  misc_feature (225)..(225): n is a, c, t, g, unknown, or other
  misc_feature (258)..(258): n is a, c, t, g, unknown, or other
  misc_feature (602)..(602): n is a, c, t, g, unknown, or other
  misc_feature (610)..(610): n is a, c, t, g, unknown, or other
tggagctccccgcggtggcggccgctctagaactagtggatcccccgggctgcaggaattcgcacgagaccattacctagaacatcctaatcgaaaaactgcagtctccagagtctagagacctccaccgtccactccaaagacgagcagcgggcaaacccaagcacccgcccaatccggntcgccttgcttctcaccccgcccggactctgctgagagactggncagcgtggctatgccattgggcgacgacgcggnggcggacttcgcgctgacggacgagctccttggcggggctgcccgggaaccccctacaaaaactggaattgggggcgccccacacacgcctttggggtgggcgggccccgtgtccccccttgaaacggaaaagggggcccccccgccccggaaggccccgggaaaaaaacccccaaaaaggcccacattccccgggaggggggggggggtgttttcccaaaccccccccctttcctgaaaaaaaacaacccgcgcggggttcccccgcgccccgcgccgaaggggaaaaaatatttaatcccccccccaaaggggggggggggggtctctctttggtggggggnaaaaaaanccccaaaaaaaaaaaggggggggg

SEQ ID NO: 32940 - protein, 86 aa, Zea mays
  misc_feature: Ceres CLONE 1410395-F
  misc_feature (8)..(8): Xaa is any aa, unknown, or other
MPLGDDAXADFALTDELLGGAAREPPTKTGIGGAPHTPLGWAGPVSPLETEKGAPPPRKAPGKKPPKRPTFPGRGGGVFSQTPPLS

SEQ ID NO: 32941 - DNA, 708 bp, Zea mays
  misc_feature: Ceres CLONE 1410400-F
  misc_feature (284)..(284): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (421)..(421): n is a, c, t, g, unknown, or other
  misc_feature (422)..(422): n is a, c, t, g, unknown, or other
  misc_feature (457)..(457): n is a, c, t, g, unknown, or other
  misc_feature (468)..(468): n is a, c, t, g, unknown, or other
  misc_feature (497)..(497): n is a, c, t, g, unknown, or other
  misc_feature (513)..(513): n is a, c, t, g, unknown, or other
  misc_feature (561)..(561): n is a, c, t, g, unknown, or other
  misc_feature (582)..(582): n is a, c, t, g, unknown, or other
  misc_feature (675)..(675): n is a, c, t, g, unknown, or other
tggcggccgctctagaactagtggatcccccgggctgcaggaattcgcacgagaccattacctagaacatcctaatcgaaaacgtatatgaatcttctcagacagaattccagggaggggatgttcagaaggtgcttatttcgttgttgaaaatattgtgccaacactatggaaagcttcgttcatcctttgggtctgacccgtcacaagagggtatagatggcccagagatggcagtgacgaaacttttctcatcttgtaagagcagtgctaatatgaaaggntatgggagctgttgtccattgcatgagaaatcttccctcagaaagccagattcagactactggcccaggaggttcannnagtctcttgggtttctgggtagaaaggaaagaggcccttcacagggcacaagaaggtnncacctttggggccctggcactggatccttgctttnacacttttggntggattaagttttaatggcggatactggnggaagaaaatggccancctgccatttttttgtttctggattccaccccttggaggacactgtgncttttcttaatgctggaaaancttgaaaaaatggttttttcagttttgaggaatcttggttaaacccgagtgggtttggtcttcttccccaacaagccctggaaaaggtggggnccaaaaagggaatggcttgaatgactgggcaaa

SEQ ID NO: 32942 - DNA, 629 bp, Zea mays
  misc_feature: Ceres CLONE 1410408-F
  misc_feature (419)..(419): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (545)..(545): n is a, c, t, g, unknown, or other
  misc_feature (600)..(600): n is a, c, t, g, unknown, or other
  misc_feature (601)..(601): n is a, c, t, g, unknown, or other
  misc_feature (629)..(629): n is a, c, t, g, unknown, or other
cgctcataactagtggatcccccgggctgcaggaattcgcacgagaccattacctagaacatcctaatcgaaaaaggccgcagctactccacggtgacggccgccatgagagccctcctctccctctcccgtctcgcccgacggcttccagcttctctcagccctgtaagggcgccgacaacattactcctccggcacatccatgcggatgcccctccgccgccgccatctcatgactcgacgcccttcgtctcccgcatcctcgaatcggagccgtgcctgaccccgaacgacgagtcggagccggcatccgatccgaccctcgacgagttcctcgcgcgcttcgtggctgccttccgcccgcgactggcggctgccttcccaaccatgaccgtgacgtgctcgacgagatgctccgnctcgtcgcggacgccgtgctgtgccgcctcacgggacgggacccggggggggcgatgctattgagctcatgacacctctggcggcccnnnaagggaaggtcagcgcctccgtgcggagctatgcgnccggggatcaggcccgcgccgaccttcgccatacttccttgcgaagaggggaggnnaaaggaccgggttccctttgccatgtcn

SEQ ID NO: 32943 - DNA, 662 bp, Zea mays
  misc_feature: Ceres CLONE 1410411-F
  misc_feature: Translation starting site: 172
  misc_feature (519)..(519): n is a, c, t, g, unknown, or other
  misc_feature (662)..(662): n is a, c, t, g, unknown, or other
cgcggtggcggccgctctagaactagtggatcccccgggctgcaggaattcgcacgagaccattacctagaacatcctaatcgaaaactcgccgtcgtcgccaccgccactttgccccgcctcgtcgcctcctccgacgaccaccgtccaccggcgacaaggacagcgacgatgcagtcggcggcgtggaggcgtcacctcctcgaccaccacctctccccttccacctcggctgccatcgccgccttcagatccgcctcccagcccgggctcgctccccaagggttgtttggagcggatggcgcaagatgcatgtctgcgagggcgccggcggtcaaggggtccgggcatctcgtccgcaagggcaccggagggaggtcttctgtgagtggaattgtagccacggtgtttggagctactgggtttcttgggcgctatcttgtgcaacaacttgccaagatggggtctcaagtgcttgcccattcagagggttgtgaggattctcctcgtcactgaagnatatggggtgacttggggtcagattgtgcccatgaagtacattccgagagatggtgattccattaaggctgttatggccaagtcaaatgtggttattaacctcataggacgagagtatgaaaacaggactacagccttcgaan

SEQ ID NO: 32944 - DNA, 645 bp, Zea mays
  misc_feature: Ceres CLONE 1410414-F
  misc_feature: Encodes the peptide sequence at SEQ ID NO. 32945
  misc_feature (501)..(501): n is a, c, t, g, unknown, or other
cgctctagaactagtggatcccccgggctgcaggaattcgcacgagaccattacctagaacatcctaatcgaaaagcaaaaccctagagacagaagacgcgaggggagagagagaggcgcccggcatggcgagcgcgacgtccccagcgatggccgcgaatctggcgggcaagtcgggcgtgcgggtcgtcgtgatcggcgaccccggcaccggcaagtccagcctcatcgtcgccctcgccaccgagcagtttcccgagaacgtgcctcgcgtcatgccccccacccgcctccccgccgattatttccccgaccgcgtccccatcaccatcatcgacacgtcgtccagcccggagcagaagccgaagttgatcgccgagtgtcaggccgccgatgcggtcgtgctcacctacgcctgcgaccggcccgccacgctggagcggatcagttcgttctggcttcccgagctccggcgactccagctgaaggctcagattatcngtgtcgtggtgcaagctggacctgagggacgaacaacaagttagccgttgagcaggttatggcgcccatcatgcagtccttctgcgagattgagacctgcattgagtgctccgctcttcgccagatacagggggcctgaggctt

SEQ ID NO: 32945 - protein, 131 aa, Zea mays
  misc_feature: Ceres CLONE 1410414-F
  misc_feature (12)..(124): Pfam Name: Miro Pfam Description: Miro-like protein
  misc_feature (118)..(118): Xaa is any aa, unknown, or other
MAANLAGKSGVRVVVIGDPGTGKSSLIVALATEQFPENVPRVMPPTRLPADYFPDRVPITIIDTSSSPEQKPKLIAECQAADAVVLTYACDRPATLERISSFWLPELRRLQLKAQIIXVVVQAGPEGRTTS

SEQ ID NO: 32946 - DNA, 677 bp, Zea mays
  misc_feature: Ceres CLONE 1410416-F
  misc_feature: Encodes the peptide sequence at SEQ ID NO. 32947
  misc_feature (567)..(567): n is a, c, t, g, unknown, or other
  misc_feature (576)..(576): n is a, c, t, g, unknown, or other
  misc_feature (666)..(666): n is a, c, t, g, unknown, or other
tccccgcggtggcggccgctctagaactagtggatcccccgggctgcaggaattcgcacgagaccattacctagaacaatctaatcgaaaatttcttctctcgttcacctcgcgtgcgcgaaccagctagggcgaccgctgccgccctacggcctacgcccagctgctcaggtcttattcgggcctttggcggcgagaaccgaccgcgccaggataatggctcaccgtggacacctagatggactgactgcccaagctccagcactgatgcgccatggttccttcgctgcaggcagcctttctagccactcacctttggagtcttcatctacactggagatgctggagaacaagcttgccatgcaaactgcagaagtggaaaagcttatcatggagaatcagcggttagcatcaagccatgtggtcttgaggcatgacattgttgatacagagaaagagatgcaaataatccgcactcacctaggtgaagttcagacagagactgatttgcatattagagatttattgcagagaattagattaatgcacgcagacatacatagtggntgatgcggntgaagaagagcttcatcaggtgcatatgggaggcaagagactttattactggaaggcagatgctgacccttgagacagaggatgtgactnaagatttacag

SEQ ID NO: 32947 - protein, 117 aa, Zea mays
  misc_feature: Ceres CLONE 1410416-F
MAHRGHLDGLTAQAPALMRHGSFAAGSLSSHSPLESSSTLEMLENKLAMQTAEVEKLIMENQRLASSHVVLRHDIVDTEKEMQIIRTHLGEVQTETDLHIRDLLQRIRLMHADIHSG

SEQ ID NO: 32948 - DNA, 641 bp, Zea mays
  misc_feature: Ceres CLONE 1410419-F
  misc_feature: Translation starting site: 457
  misc_feature: SWISSPROT Homolog: EC 3.5.2.3 Dihydroorotase
tcataactagtggatcccccgggctgcaggaattcgcacgagaccattacctagaacatcctaatcaaaacttaatgtttccaaggttctgtggcagtgcgaggcattttgggaggtggtgagcgcctcgcttggcaccttcattttcgtgatgatgctgtccttcaggctgcagtgccacacaagttcgtttggtgtaggtgctgcttgatttttggcggtgcatgccgggtgttcgacaatgtttctgaggttttgtggcagtgcgaggcattttgggagggacatcatcatgcccaacttgaagtcgtccgtgaccacaacagcgagcgcggtggagtacatggatgaagtattgaaggcgttgtcgccagccgccgccgccgacgacggaggagcagcacctctcgtctgtccaccgctgaccgctcgtttgtcagcctagcaccggtgtgcatgaacgcccagtatatgctacagcaccgccgcccctggccctgccgcctgcgcccggtcgttgccctgtgcactccgcgggcctcgggaatgcccaaccagacttttatcgggttggcccccctctcctctcttctcttctctcccggccgctccccctctctcccttctctcggggttccgaa

SEQ ID NO: 32949 - DNA, 666 bp, Zea mays
  misc_feature: Ceres CLONE 1410421-F
  misc_feature (438)..(438): n is a, c, t, g, unknown, or other
  misc_feature (508)..(508): n is a, c, t, g, unknown, or other
  misc_feature (514)..(514): n is a, c, t, g, unknown, or other
ccccgcggtggcggccgctctataactagtggatcccccgggctgcaggaattcgcacgagaccattacctagaacatcctaatcgaaaaaaaaataaaatccaattttctcagtctcgagcgcccgcgtccctcgccccgtcgcgactcgcgacttcgcgagtcgccccgtcccagcctcccagccgtcccggctccccgcgaccccgccctccggcagtccggcgcgggggctcctctccgatccggtgagccgaacgaggatcccaactccccgaagaaagcggccacagccagagccagggtggctcggctctcctctcacagactgcgccgcagcgcctagcgctcggctggcagccgctccggccggtcggccccgcgcccccgcccctgctgcctacatccgcctgcagccagaagatctgcctccagcgnaccgcctgcctggccctttgtggctctgtggttctgcacaccagcacacgcacttgtcccaaacaacggnggcggncgatgagtatctcagaagagcttcccggcgaaggatctgacggtggaggaaggagtcctcttcaacggggaggacttcctccccgagaataccctcggacgaaaaaattctcccgaacgggacaaaaaaaattggccacgtcgtcaacgggg

SEQ ID NO: 32950 - DNA, 631 bp, Zea mays
  misc_feature: Ceres CLONE 1410425-F
  misc_feature: Encodes the peptide sequence at SEQ ID NO. 32951
  misc_feature (336)..(336): n is a, c, t, g, unknown, or other
  misc_feature (363)..(363): n is a, c, t, g, unknown, or other
tggagctccccgcggtggcggccgctctagaactagtggatcccccgggctgcaggaattcgcacgagaccattacctagaacatcctaatcgaaaaacttcagtaatcagtgctcgctagcccaccacgccgccctgaacctagcccggacacccgccaggacaggccagcccaacgcgatgcgaccgccgcctcaggtccgcgcaccaccatgtccatgagctccccggtgcagctcaggcggctgaagcctctgtaccagctggtggtgaacaacatcctggcatcgtggcgtgccgtcgccgccgcggtctgctcaggcgtcgtcgctcggncccgagagatcctgccgctcaggccgngcacatggtcctggccgcgttcctgctgccgcggcacggtgctatacctgatgctccggcgcgcgctgtgtacctggtggactacgcgtgtttccgaccagccccaactccgcgtcccggtcgggaggttcctgagcactcccggggtgtggcggggtttcacgagcgcaaggtccggtttatgaagcgcctggtgaaagggtccgtttctcggagaagaaacccgcctggccaaccccaaaaataaattccgcggggggggggactt

SEQ ID NO: 32951 - protein, 80 aa, Zea mays
  misc_feature: Ceres CLONE 1410425-F
MVLAAFLLPRHGAIPDAPARAVYLVDYACFRPAPTPRPGREVPEHSRGVAGFHERKVRFMKRLVKGSVSRRRNPPGQPQK

SEQ ID NO: 32952 - DNA, 662 bp, Zea mays
  misc_feature: Ceres CLONE 1410426-F
  misc_feature: Encodes the peptide sequence at SEQ ID NO. 32953
gctctagaactagtggatcccccgggctgcaggaattcgcacgagaccattacctagaacatcctaatcaaaaaacgacgtcactagtagagccgtagagggcaagaggcgacggaatgacggagcggcaggtggcggagctgggtcccgggacggcgtgctgcggctggaaccactgtggccgccgcctcgccgctggcgccgtcgatggctccgtctccgtctatgactcccagccgccaccctcgttcaagtggcaggcccatgagcaagccattgtgaatgtcgtctggcttcctccagagtatggggatgctatagccttgtgttttgtgctgatgggacactgtcttgggggggaaggagggttgctgctgaatgatccacttcccaccctggaagaaatggaaaaatccttcgaggagggcaactcctctaataccaaaatggacatttttggataccttcggggaattcctgaaaaaggggtacgggataatccaaaagggcccagggcaagggctaacgagctcctgggaattcattgggaaataaaaccaggggggcgagtttccgggggaaggtctccaaaaaatattaggtgggtccaactcctcttaaaattttgggaaaaaacctcggggtaggggccttttcgggcg

SEQ ID NO: 32953 - protein, 176 aa, Zea mays
  misc_feature: Ceres CLONE 1410426-F
MTERQVAELGPGTACCGWNHCGRRLAAGAVDGSVSVYDSQPPPSFKWQAHEQAIVNVVWLPPEYGDAIALCFVLMGHCLGGEGGLLLNDPLPTLEEMEKSFEEGNSSNTKMDIFGYLRGIPEKGVRDNPKGPRARANELLGIHWEIKPGGRVSGGRSPKNIRWVQLLLKFWEKTSG

SEQ ID NO: 32954 - DNA, 666 bp, Zea mays
  misc_feature: Ceres CLONE 1410429-F
  misc_feature: Encodes the peptide sequence at SEQ ID NO. 32955
  misc_feature (441)..(441): n is a, c, t, g, unknown, or other
ggcggccgctctatactagtggatcccccgggctgcaggaattcgcacgagaccattacctagaacatcctaatcgaaaaagttccatcccaatcgccgagaaggggaagccaaatcgatggcggcggcggcggccggcggcgagaacagcggcgcgggcgcgggcgcgggcgagggcgagttctacctgcggtactacgcacaccggccggtgaccctgcgtgcgtgcctctctctctctctctctctctcccctcccgcatccggtggatcgtcaacgccgcccggcccgggcggcagcgccgcgcgccacctgagggcagcgggagccagcagccgctgcttcaccaaggcggtcgcgccgcttttggagcgcttatgcccccggtccgctgagcgcttagtgcagttttttggaacatgagacctcctagcagtggncaaaagactgaggtctcccataacgtggagaaattgggggggttctgatcaagcttgcctggcaaaggccaaaggtgtggcatcgagcaaaacctttttggggctggagtgaacgaagtcccctttgttgccggcagtcccactgggggggaggccctcaaaaaaattgggggggacggcagtttaaaaaaggtcgggggggaggccaaaaaaaaagggcagggt

SEQ ID NO: 32955 - protein, 101 aa, Zea mays; identical to SEQ ID NO: 11239
  misc_feature: Ceres CLONE 1410429-F

SEQ ID NO: 32956 - DNA, 633 bp, Zea mays
  misc_feature: Ceres CLONE 1410430-F
  misc_feature: Encodes the peptide sequence at SEQ ID NO. 32957
  misc_feature (227)..(227): n is a, c, t, g, unknown, or other
  misc_feature (299)..(299): n is a, c, t, g, unknown, or other
gctctagaactagtggatcccccgggctgcaggaattcgcacgagaccattacctagaacatcctaatcgaaaaactttctcttgctagggtttcagctctccgccaccgtcatgagtgcctccgggccggatcaccgtcgccgccacccgccgttcctgcgggacctctcgtccccgatctcctcgtcgtttcgcctcccaccggcctcgatgcggcgagaggagnaggcctccaccccgccgccgcctccgccgctgctctccctcgacgacctctcccacctctccccctccaggnagccggccacgcctccgcaggcgacgacgacaccctcgcctcagccaccggcgtggagtcgatctcttctcgacgctgcgggccacgggctcgccgggcccctcggcatggtggaccccctcgaggggagagaatccagggtaggatcaccgatggatgccgtcgggcataccagtagcagtcccgacgacgccgtcgggtcagagtcacaggaaaagagggaggggtgatcacgttgcccccccccaggaggtggggggggccggaaaagcccaaagtatttggtcccggtggttgaacgggtcaaaaaggggggagggttccaccgttttgg

SEQ ID NO: 32957 - protein, 40 aa, Zea mays
  misc_feature: Ceres CLONE 1410430-F
MVDPLEGRESRVGSPMDAVGHTSSSPDDAVGSESQEKREG

SEQ ID NO: 32958 - DNA, 633 bp, Zea mays
  misc_feature: Ceres CLONE 1410437-F
  misc_feature: Encodes the peptide sequence at SEQ ID NO. 32959
  misc_feature (383)..(383): n is a, c, t, g, unknown, or other
  misc_feature (528)..(528): n is a, c, t, g, unknown, or other
  misc_feature (595)..(595): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (633)..(633): n is a, c, t, g, unknown, or other
gctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacgggcttcgtgtggctccggcagcgccgcaaggtggaccactacttcgccaaggccggccgccacgtgtcctacggncgcccgaggtggtcggcggtggccgaacaagggccggctcaagaagaatcacgggcgtcaaggccaaggagatgccttgctgtgggtcaccctccacgagatcctgcgtcgacgacccgcccactggtaagctccactgcaaggncatcggcggcctgtccgcagcttcccccgtcgaggcctccgaggccgaggagccggcgcgcggaaanccgggcgtgtctcccagggacgcgaggggnnnnnnngn

SEQ ID NO: 32959 - protein, 159 aa, Zea mays
  misc_feature: Ceres CLONE 1410437-F
  misc_feature (2)..(117): Pfam Name: DUF538 Pfam Description: Protein of unknown function, DUF538
  misc_feature (128)..(128): Xaa is any aa, unknown, or other
  misc_feature (150)..(150): Xaa is any aa, unknown, or other
MTLTIPDEVRAKAEVYVGDAAGQEKTRLLLQETGLPSGLLPLRDIIECGYVEETGFVWLRQRRKVDHYFAKAGRHVSYGRPRWSAVAEQGPAQEESRASRPRRCLAVGHPPRDPASTTRPLVSSTARXSAACPQLPPSRPPRPRSRRAEXRACLPGTRG

SEQ ID NO: 32960 - DNA, 672 bp, Zea mays
  misc_feature: Ceres CLONE 1410439-F
  misc_feature: Encodes the peptide sequence at SEQ ID NO. 32961
ggagctccccgcggtggcggccgctctagaactagtggatcccccgggctgcaggaattcgcacgagaccattacctagaacatcctaatcgaaaaagcaaatcactacacacaccttgtctctaatcagatatcaaagaagtagccattaagttaacgatggcttccgccgacctcgcagaggccatcgagcccagcaggaagaagaagagcaacgtcaagtatgcctccatctgcgccatcctcgcctccatggcctccgtcatccttggctacgatattggggtgatgagcggagcggccatgtacatcaagaaggacctgaagatcacggacgtgcagctggagatcctgatagggatcctcagcctctactcgctcatcgggtccttcgcgggcgcgcggacgtccgacaggatcggccgccgcctgactgtcgtcttcgccgccgtcatcttcttcgcgggcgcgctgctcatgggtttcgccgtcaactactccatgctcatggtgggccgcttcgtggccggagttggcgtgggctacgggggcatgatcgcgcccgtgtacacggccgagatctcgccggcggcgtcccgcggcttcctcacgtccttccccggaagtgttcatcaacgtcggcatcctgctcggctacctgtcgaactttgc

SEQ ID NO: 32961 - protein, 171 aa, Zea mays
  misc_feature: Ceres CLONE 1410439-F
MASADLAEAIEPSRKKKSNVKYASICAILASMASVILGYDIGVMSGAAMYIKKDLKITDVQLEILIGILSLYSLIGSFAGARTSDRIGRRLTVVFAAVIFFAGALLMGFAVNYSMLMVGRFVAGVGVGYGGMIAPVYTAEISPAASRGFLTSFPGSVHQRRHPARLPVELC

SEQ ID NO: 32962 - DNA, 669 bp, Zea mays
  misc_feature: Ceres CLONE 1410443-F
  misc_feature (434)..(434): n is a, c, t, g, unknown, or other
  misc_feature (437)..(437): n is a, c, t, g, unknown, or other
cgctcttaactagtggatcccccgggctgcaggaattcgcacgagaccattacctagaacatcctaatcgaaaaaaacaacgccgcgacgagaagagagaagagggcgggcatcggccagtgggggctcggaggccgagggaggcgaggaaagcggcgggtgccgggccgcccgcgccggtgccgaggccctcaccagtcaccaccccctcccctcttccgtctgtcccccgcttgccgccaccgccgctgcctgctcgcgacccttcccccttttaacgctcccgcggccccgcgtcgtgctcccttttgtcgccgctgccttcgtgcccgtactcgcgggttctcctcgctcctcaatctccgcgcctggggcgcggcgttcgccgccggatctgggcgcgggacggtgccccgaacggtcgatggcgcgantgnctctccggttgcgcgcccgcgcgctcgcgattctcgtgctcgtgacagtggctctgcttccacttgtcagttccgacgatggacaccaacactggcgagggtgttgtccgtgggtgggacgcattcctccccgcgtaggcgtgaacgacgggggaccaaattgggcgttgggggattgcctcttcttccctccaatttccaaggatggaaggtcccgccctacttttttttg

SEQ ID NO: 32963 - DNA, 747 bp, Zea mays
  misc_feature: Ceres CLONE 1410444-F
  misc_feature: Encodes the peptide sequence at SEQ ID NO. 32964
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (17)..(17): n is a, c, t, g, unknown, or other
ntattccccccnnggcnctttcccctccccccatcttacgggggaggatggccaaactgagactcaccgcggtggcggccgctctagaactagtggatcccccgggctgcaggaattcgcacgagaccattacctagaacatcctaatcgaaaaacacaacccaaagcagccacagcagcctccttcctcctctcactctcgctcgcgctgcgctcgctacctcgcttcgcattccattcgaaaagaggggaggaaaggcaagatgttcatcgagagcttccgcgtcgagagcccccacgtgcggtacggcccgatggagatcgagtcggagtaccggtacgacacgacggagctggtacacgagggcaaggacggcgcctcacgctgggtcgtccgccccaagtccgtcaagtacaacttccggaccagaaccgccgtccccaagctcggggtgatgcttgtgggggtggggaggcaacaacgggtccacgctggacggctggggtcattgccaacaggggaggggatctcatgcgcgaccaaggacaaggtgcagcaagccaactactacggcttccctcaccaaggcctccaccatcagaggcggcagttacaagggggggaggagaccctatggcgccggttcaagaagcctccttcccataggggacccagaacgcacagtggggggtcggcagggggggggcaattaaacaaaatgggacccggggccgaattcccaggag

SEQ ID NO: 32964 - protein, 161 aa, Zea mays
  misc_feature: Ceres CLONE 1410444-F
  misc_feature: SWISSPROT Homolog: EC 5.5.1.4 Inositol-3-phosphate synthase
MFIESFRVESPHVRYGPMEIESEYRYDTTELVHEGKDGASRWVVRPKSVKYNFRTRTAVPKLGVMLVGVGRQQRVHAGRLGSLPTGEGISCATKDKVQQANYYGFPHQGLHHQRRQLQGGEETLWRRFKKPPSHRGPRTHSGGSAGGGQLNKMGPGAEFPG

SEQ ID NO: 32965 - DNA, 654 bp, Zea mays
  misc_feature: Ceres CLONE 1410445-F
  misc_feature: Encodes the peptide sequence at SEQ ID NO. 32966
tccccgcggtggcggccgctctagaactagtggatcccccgggctgcaggaattcgcacgagaccattacctagaacattctaatcgaaaaagtagaaggtagaacaccttcttgacccgaattcaatccgtgcgcacgcaccctccgccggcgacggctcacgcatcgctcggcgcccgccccgcgtccccgagacgacgaccggcagagcgcgccctcgcggcgctacccgacacctgcgacgaaacgccccgagtccactagtcgaggagtgcgtcgacgcaggggctcgggaacgcggtgtcgccatcgcggagccctagcgagatcgtcgggaaggtccgaaggcgagcacgtgtttgtgtaacctttctccccttcttccctttgccggccggcccttcagcggcgacaagtgcccaccaggcggtggtttacgttgagctgaggagtgaggaagatgtctggaaatccagtcggcgtcgacaacacttctaggaggaaatttgacaaggaagagtacttggagagagctcgacagagggagcagagggagaaggatgaagctcggaaaggcaaggaaaggggtcctcctgtgcaaagacagcctttgaaacacagggactatgaagttgatcttgattctcgtcttg

SEQ ID NO: 32966 - protein, 64 aa, Zea mays
  misc_feature: Ceres CLONE 1410445-F
MSGNPVGVDNTSRRKFDKEEYLERARQREQREKDEARKGKERGPPVQRQPLKHRDYEVDLDSRL

SEQ ID NO: 32967 - DNA, 679 bp, Zea mays
  misc_feature: Ceres CLONE 1410449-F
  misc_feature: Encodes the peptide sequence at SEQ ID NO. 32968
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
gctctagaactagtggatcccccgggctgcaggaattcgcacgagaccattacctagaacatcctaatcgaaaagggaaacaaagcgaagttggggcggcgagacgcgagacgcgagacgcgagaaatggcggagccgcctttggccgccggctgcacgacaaactggaggagggaggcggatgagcggctgcggcgcctccactccctcctcttcggcgccgacgccgcactcgagcacggggacgccacggtggcgcaggcgctcgcgctccgcctcctcggcttcctcgactctcaggggctagcccgcaggcgcgnnnncccgaggaccgccgcctgcccgccggccattcgggaggcgggcttccgctcggcttagccggcgcctcacgcgtcccgcacctccccctccggacccaggacgccaccgactctcccccaacgcccccgagccggtgaatctccaacttccggacgacaataagtgttctcttccttccgagcgtatggcggtatttccgctctcccccccgcacgtcggctgccccccagctacgcatcgtgtccacctccgttgccaccgagctcccccgtgcgcgcccccctcacccctctattatacccgaccgcacgaggtccttgcgacaccccctatatcacaaccctaccacaccacg

SEQ ID NO: 32968 - protein, 84 aa, Zea mays
  misc_feature: Ceres CLONE 1410449-F
  misc_feature (65)..(65): Xaa is any aa, unknown, or other
  misc_feature (66)..(66): Xaa is any aa, unknown, or other
MAEPPLAAGCTTNWRREADERLRRLHSLLFGADAALEHGDATVAQALALRLLGFLDSQGLARRRXXPRTAACPPAIREAGFRSA

SEQ ID NO: 32969 - DNA, 699 bp, Zea mays
  misc_feature: Ceres CLONE 1410451-F
  misc_feature (473)..(473): n is a, c, t, g, unknown, or other
ggagctccccgcggtggcggccgctctagaactagtggatcccccgggctgcaggaattcgcacgagaccattacctagaacatcctaatcgaaaaaagtcccaatccaccgacgaattccaaaccctgcctaggacctcggcgccactcgccgcacgtcgtccacgtccgcctccaccccaatccgatggggtatgaagagagcaaaaacatctcctcagtctcagctaccctgagctgccatgtttgtgcaaaaggtattacctttcctgcttagaagaccccactctcagttagcaaggtcgcctccgctcgccttcttgaaggatcttcctcttctgggtctccctcccgtgccattagcccatatttgaagaaggttccccttgtgatcttggttacaacaaaaagagggccataccattgggcggggatgagtggggaaaccccttgttgcgtggggaaaaaatccnaaaagggggatccgcaccccctgtttgagtaaacatcttttaaaaggggattttgcaccttgggaccaaagattaacccccccgttttctatttaacccttgtgaagaaccccaaaattctagggccctctcctcctttctgtgacctggaagaccgggtctacaaaatttaacgggccccaaaaagggcacgggggagaatttggcaacctaataaccacaaaat

SEQ ID NO: 32970 - DNA, 663 bp, Zea mays
  misc_feature: Ceres CLONE 1410452-F
  misc_feature: Encodes the peptide sequence at SEQ ID NO. 32971
  misc_feature (188)..(188): n is a, c, t, g, unknown, or other
  misc_feature (201)..(201): n is a, c, t, g, unknown, or other
  misc_feature (202)..(202): n is a, c, t, g, unknown, or other
ggagctccccgcggtggcggccgctctagaactagtggatcccccgggctgcaggaattcgcacgagaccattacctagaacatcctaatcgaaaagctgaagccactagccggctgcctgctctacttcctccgaaccgaacgaggtgcatcgtgaggaagcagcagcagggggggcagtggccggnccgggatgacggnnagggaggccgtggcggcggcggaggcggagctggatcaggactcggcggcggcggcggcgcccgtgctgctgagcccgctcagcgagacgctgtggcgcgacagggcggcggcggcggcgggcggagtcctcgtcggggacgtgtcggcgcgcctggcgtggcgcgacctcaccgtgaccgtcgcgctcggctccggcgacacgcaggccgtgctgcagggcctcacggggcacgccgagcccggcaccatcaccgcgctcatgggcccgtccggctccggcaagtccacgctgctcgacgcgctcgccggccgcctcgccgacaacgccttcctctccgggaccgtcctcgtcaacgggcgtcagggcaacctctccttcggcgccgcggcctacgtgacgcaagacgacaacctgatcggcacgctgaccggggagggaaaacatcttcgtactcggcg

SEQ ID NO: 32971 - protein, 156 aa, Zea mays
  misc_feature: Ceres CLONE 1410452-F
  misc_feature: SWISSPROT Homolog: EC 3.6.3.28 Phosphonate-transporting ATPase
  misc_feature (3)..(3): Xaa is any aa, unknown, or other
MTXREAVAAAEAELDQDSAAAAAPVLLSPLSETLWRDRAAAAAGGVLVGDVSARLAWRDLTVTVALGSGDTQAVLQGLTGHAEPGTITALMGPSGSGKSTLLDALAGRLADNAFLSGTVLVNGRQGNLSFGAAAYVTQDDNLIGTLTGEGKHLRTR

SEQ ID NO: 32972 - DNA, 646 bp, Zea mays
  misc_feature: Ceres CLONE 1410454-F
  misc_feature: Encodes the peptide sequence at SEQ ID NO. 32973
  misc_feature (405)..(405): n is a, c, t, g, unknown, or other
  misc_feature (411)..(411): n is a, c, t, g, unknown, or other
ggagctccccgcggtggcggccgctctagaactagtggatcccccgggctgcaggaattcgcacgagaccattacctagaacatcctaatcgaaaaaaaaaaacgcacggggagcttggagacttcacgacaaatcgacgatcgccgcttctcttggccattgtagagggagagagagagcgcgagcgacctaggtcagtcggtttcggttttgggcgtcagcttcagctatccgcgaccgcgacgatgggtctgcgcgtggccgccaccgcgccagctccggacggcgtgcgcgtgctcggcaggggcgccgcgcgcgtgacgccgcgaccgtgggcggctgtcggcggcaggagacgctctcccgtggcggatgtccgtcgcgaccacccgaggcacacaacnattcgncagtgagcgccatcggaggaccaggggctggaggctaggaactccaggagggggtcggcgaccatccccggaggtgggaggccgtaccacgttcttccgggtaacagaagcgggaccaatccgatgcggcaatgggcggccggcaggcctaacggacggggggtgggcataggaaagaacgggggttcccgaggggcacccccacccgggggtcacctctgaagggcaaattccc

SEQ ID NO: 32973 - protein, 56 aa, Zea mays
  misc_feature: Ceres CLONE 1410454-F
MGLRVAATAPAPDGVRVLGRGAARVTPRPWAAVGGRRRSPVADVRRDHPRHTTIRQ

SEQ ID NO: 32974 - DNA, 815 bp, Zea mays
  misc_feature: Ceres CLONE 1410459-F
  misc_feature: Encodes the peptide sequence at SEQ ID NO. 32975
tattatttctcttattttttcacccacctcaccaccccatataaaacccaaaccggagatccaagaggtggggggcgttctacaatagtggatcccccgggctgcaggaattcgcacgagaccattacctagaacatcctaatcgaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggagtccacggaagaggcaggcgccccgccgcgaagaatgcaaggggttccctgtgcctgcaaggaagcggacggtcagcgcggtgctacctacgtgggtgacacggtgggcccgccgccgaaagcggtatcatatcagtgaccagtggacccttctcccttttgtgcaaaccccccgtatatgtgaaagtagaacagaaacaaaacccacccccaccaccacgccggccgcagtgcccttttactgcgtcttcaaatcacgagacggcacggagccccgccaccgagcccctcccccccacccaccgtccgccccccccctaaaacaaaagaaatcactaacatatcagattggcacgagcgtagggggaagatcaacatacctcc

SEQ ID NO: 32975 - protein, 88 aa, Zea mays
  misc_feature: Ceres CLONE 1410459-F
MAPAVGLKRSATQTITLPPPDTRLAVRDVMRSTIPSQPAVAPESTEEAGAPPRRMQGVPCACKEADGQRGATYVGDTVGPPPKAVSYQ

SEQ ID NO: 32976 - DNA, 862 bp, Zea mays
  misc_feature: Ceres CLONE 1410462-F
  misc_feature: Encodes the peptide sequence at SEQ ID NO. 32977
  misc_feature (15)..(15): n is a, c, t, g, unknown, or other
  misc_feature (31)..(31): n is a, c, t, g, unknown, or other
  misc_feature (36)..(36): n is a, c, t, g, unknown, or other
tcccccccccccccngcccccctcctctatnataanttgctcttcctccaacctggggctccccgcggtggcgggcgctcttcaatagtggatcccccgggctgcaggaattcgcacgagaccattacctagaacatcctaatcgaaaaaacaatctctgcggagtaggtcgcctgacgaactaccgagacgtgcgtctcgcttctcccttcctcagctgctggcccgctgcctgcagccattgcccgctcctcgaggtcaaatggcccctgcccccgctctcaccgccacatccgtcctgaagcgttcccacctacccggcgtccacctcgttggcctgtcgccggcagccgggggcggaccgcgatctcggtgctttctccagcgatcccgccgccccgtgtttcatggcagcaaggaatcctgggagcgggttgctaagagggctccctccttggactgaagtgcccagctgcttccccttcggagaaaggaacaacctttctggcgaagcgacggcgggcggtttcgcctttttccaaaaaagggggggcgggaggaacccaaagggacacatctacttgtggaaaaaacttttgaaaacaacgcggccacacttcccacgtgatttcccccaataaaaggtcgggccgggcgcaataaaaaaactcccccccgacccttgtggcgcaaaaatcgcccatgccgcggttaacgtgcgctcccccccactcccccacctttatgcgcccgtcaccatatactgggacttactacgcaccgcgtctcctctggacggcaacacatagcagtaacactccccgagacattgtttaatatcaatattatataaacactcccg

SEQ ID NO: 32977 - protein, 77 aa, Zea mays
  misc_feature: Ceres CLONE 1410462-F
MAARNPGSGLLRGLPPWTEVPSCFPFGERNNLSGEATAGGFAFFQKRGGGRNPKGHIYLWKKLLKTTRPHFPRDFPQ

SEQ ID NO: 32978 - DNA, 653 bp, Zea mays
  misc_feature: Ceres CLONE 1410463-F
  misc_feature: Encodes the peptide sequence at SEQ ID NO. 32979
  misc_feature (286)..(286): n is a, c, t, g, unknown, or other
  misc_feature (423)..(423): n is a, c, t, g, unknown, or other
tccccgcggtggcggccgctctagaactagtggatcccccgggctgcaggaattcgcacgagaccattacctagaacatcctaatcaaaaaacagattagcttaaacacgcgctcgcgtacagcgaagaaatggcgatggcgatgcagccatcttagtcccctaccctgatcccctctccctctccgtctccatggccgcccctcctctggtgtttgtcgccgctgccatagccgcgctcgccatcctcgtcctcgtcctcgttgtcttcgccttccggcgatggnggtgggtggtggcggcagcgccgcccgctccaggccgcggcggaggcctcgaccccggtcgctgtccaggaggaggatatatataggcctcttctttccggaaatcgggacgatcactctagacaaagtaattattnttcttggaagttctgtaggagaaccttcaaagattcaaacaaataggagtaacacttcgcctagaagtcatgcaattgctgatacagggaggactatccagatgaatgttgtgctacacaaggagaaactcatgtaatcaatattgaaaatgatacttctgaagagtttcgattaggaagcactttaagacggaatcaccagcaaaattgcaaccccggtcaaaagcaca

SEQ ID NO: 32979 - protein, 92 aa, Zea mays
  misc_feature: Ceres CLONE 1410463-F
  misc_feature (2)..(2): Xaa is any aa, unknown, or other
  misc_feature (48)..(48): Xaa is any aa, unknown, or other
MXVGGGGSAARSRPRRRPRPRSLSRRRIYIGLFFPEIGTITLDKVIIXLGSSVGEPSKIQTNRSNTSPRSHAIADTGRTIQMNVVLHKEKLM

SEQ ID NO: 32980 - DNA, 651 bp, Zea mays
  misc_feature: Ceres CLONE 1410465-F
  misc_feature: Encodes the peptide sequence at SEQ ID NO. 32981
  misc_feature (510)..(510): n is a, c, t, g, unknown, or other
  misc_feature (532)..(532): n is a, c, t, g, unknown, or other
  misc_feature (591)..(591): n is a, c, t, g, unknown, or other
  misc_feature (592)..(592): n is a, c, t, g, unknown, or other
  misc_feature (651)..(651): n is a, c, t, g, unknown, or other
aaagctggagctccccgcggtggcggccgctctagaactagtggatcccccgggctgcaggaattcgcacgagaccattacctagaacatcctaatcgaaaaacttactggtcctcactcccacaccaaccaaccaacctcctctgcctgccgcttctcctgctgcgggcggtcacggctgcaagtactagaggaggacatccgcttccattactgcgcctgcgaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgctgcgcaggacagtgcctgcagatgggatgcacaggctgttgccaggtgtccttcagaggttcagcactgcagcagcagtagaggagcccatcacgccgtcagtccatgtgaactacacaaagctcctcattaatggcnaactttgtttgatccgcatccnggaagaacttccccactctggacctcgtacagggggagtgattgctcatgtggctgagnngtgacgcaaaggacattaaacgtgcaatagctgcggctcgcagggcttttgatgaaggn

SEQ ID NO: 32981 - protein, 102 aa, Zea mays
  misc_feature: Ceres CLONE 1410465-F
  misc_feature: SWISSPROT Homolog: EC 1.2.1.3 Aldehyde dehydrogenase (NAD(+))
  misc_feature (76)..(76): Xaa is any aa, unknown, or other
  misc_feature (83)..(83): Xaa is any aa, unknown, or other
MARRAASSLVSRCLLARAPAGAPPAAPSALRRTVPADGMHRLLPGVLQRFSTAAAVEEPITPSVHVNYTKLLINGXLCLIRIXEELPHSGPRTGGVIAHVAE

SEQ ID NO: 32982 - DNA, 863 bp, Zea mays
  misc_feature: Ceres CLONE 1410466-F
  misc_feature (12)..(12): n is a, c, t, g, unknown, or other
  misc_feature (13)..(13): n is a, c, t, g, unknown, or other
  misc_feature (19)..(19): n is a, c, t, g, unknown, or other
ttaaaaaaaaannaataantcttttttttcctcctcccctctctccactctgatagctcaccgtggtggcggccgctttagactagtggatcccccgggctgcaggaattcgcacgagaccattacctagaacatcctaatcgaaaacagtcccagtcccagtcccagtcccaggacagtcccgtcagcagccacttccccggcccctcccgctcctgctcgccggaggccgggccggcggcgatgtaacaataattattgatggtgcagtaatgagggagtgacgagaattctaggatgaagtgtgttccgcctctgtgccttgtcgttgttgccggtttctccctccgccccgtgttggttgttccacccccactacccctcgacccacccctaccacccggcccactactcctaccgaccttcgctagtttccgcgccctcccccttccaacacttcgtcggctacttcgcccggccccctccacccgagaaaacatcctctcccccctcctccctatcgcacatttctgtgtgttcctactctctttcatcctactccttttcttaatttttcgttcgttcatcccttttcttttctgttctttgcttgtgggtgtgacgtggtggctgggcctttcgattctctgaaatatctactaattactgtttggttgctaatctataatttgaaaagttttcctagtcctgtaccccccctaacgagtcgaacccacaagcgctaaaacacatgacactatcaatctaggaatattgttgccctatcgtccatattcatctccatatatcatcacagcccccccaccccatcgctcactcgcccaactttcaacccacgaccc

SEQ ID NO: 32983 - DNA, 671 bp, Zea mays
  misc_feature: Ceres CLONE 1410468-F
cgcggtggcggccgctctatacatagtggatcccccgggctgcaggaattcgcacgagaccattacctagaacatcctaatcaaaacatccagagagagacacggaggacctgggtttggttgcgctgcttgactcgctccgtgttccaagcgccttttgagcattcaggcagatataaaattcctctttttacactacaatccccgctgaatcagcagcagcaactctctccctctccgttcttggtggtccgagacccttggccgtacgctctgcctcactcctccgtctcttgcttcccttgccgccggcggcgcgcggcgccggtcgcggatcggcggcgggtgcatggtggagccctgtctctctccacacacagcgacaccttccaagacgctcctcagcctcccccgcgccacgctgtcctccttcgccgaccccgacggcgacggcggctccagcgcgaaagccagcgacggcggcgccaaggccgtcgccggagaaggaggagcaggtcggggaatgccagatgccgcacatgcccaaggtcgttccacatccccccatgggcggactacactaatccccgctgacgattgggattcgccacccccaccgtggccgcctggctatccccctgtcctgctccaccaccactactctctagata

SEQ ID NO: 32984 - DNA, 686 bp, Zea mays
  misc_feature: Ceres CLONE 1410469-F
  misc_feature: Encodes the peptide sequence at SEQ ID NO. 32985
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (484)..(484): n is a, c, t, g, unknown, or other
  misc_feature (528)..(528): n is a, c, t, g, unknown, or other
  misc_feature (531)..(531): n is a, c, t, g, unknown, or other
nnnnnnnnnnnnnnnnnnnnnnnnnnnnnnnnnnnnnnnnnnnnnnnnnnnnnnnnnnnnnnnnnnnnccccccccccnnnnnnnnnnnnnncnnnnnnnnnnnnnnnnnnnnnnnnnnnnnnnnnnnnnnnnnnnnnnnnnnnnnnnnnnnnnnnnnnaaaaagctggagctccccgcggtggcggccgctctataactagtggatcccccgggctgcaggaattcgcacgagaccattacctagaacatcctaatcgaaaagttcccctttccctcctgcgcacccgtcttctcctccccgcgtcaaaccccagcacaaaaagcaaccgcccgccgcctcctcgctcctctcccgaatcagccgtcgcggtgcctaatccggccgatcccccctccgatccgcgggtgcccgccgcagaggcggcgcctccgggcctcccccgatgtatagcaacttcaaggagcaggcgatcgagtacgtncagcaggcggtccaggagggacatgggcgcaactacgtcaaggncgntccctctctacatgaacgcggctcgagtacctcaaaacccacctcaggtacgagaaggacccccaagatcaagggaggccattccccgcccaggttcccggagaacctccgccggggccaagggaaaatcgggggggtccccccaaggggggggg

SEQ ID NO: 32985 - protein, 80 aa, Zea mays
  misc_feature: Ceres CLONE 1410469-F
  misc_feature (28)..(28): Xaa is any aa, unknown, or other
  misc_feature (29)..(29): Xaa is any aa, unknown, or other
MYSNFKEQAIEYVQQAVQEGHGRNYVKXXPSLHERGSSTSKPTSGTRRTPKIKGGHSPPRFPENLRRGQGKIGGVPPRGG

SEQ ID NO: 32986 - DNA, 660 bp, Zea mays
  misc_feature: Ceres CLONE 1410470-F
  misc_feature (572)..(572): n is a, c, t, g, unknown, or other
  misc_feature (660)..(660): n is a, c, t, g, unknown, or other
tccccgcggtggcggccgctctagaactagtggatcccccgggctgcaggaattcgcacgagaccattacctagaacatcctaatcgaaaaatctccctcgggcaccggcacaacacgggaggcgtcgaagaagcaactccaaattctcttgctagagtatcagttttcggacaacgcagtgataggcttccggagggataaacgcccacggtaccgtgggcgccagctggatctcccagcgcccatctcctcgtccagtcgactccttccggcctggaggggtttacttttgttaattttccttccgctggcgtgccgcgccactacgtaccgaggaagtcctctccgcgctcaccgctcactccacctcgaggctgcagctactactaatacccgggcggtgcgaacctttgcctttagcctttagctagtacaccgaacgcgccaagtcccggaggcggaggcggtgatctttgttcgtttcctcgagtctcctctcctcccctctcctttcattccctgtcgcgtggacggcaatgacggacaccgcgcggcttcttcctgccgcggngagcgcgctgctgctgctgctctgcatcgcgggcgccgcgcgcccggccaacgtgacgtacgaccaccgcgcgctggtcatcgacggn

SEQ ID NO: 32987 - DNA, 636 bp, Zea mays
  misc_feature: Ceres CLONE 1410471-F
  misc_feature: Encodes the peptide sequence at SEQ ID NO. 32988
cacccgcggtggcggccgctctagaactagtggatcccccgggctgcaggaattcgcacgagaccattacctagaacatcctaatcgaaaaagcatttgttctttgcccacttgcctccctccaggctccagtccggccggtcctgatctctgtccagctagctagctagcgcctccagccgtccagccagcggcggcgcgacgattcttccctccccggccggaagcccccgcacgccgccgcccctgcaggcaagctgagttgtctctgccagagatggataggctcggcggctctgcccgcctcctgctcgtctctgatctggaccagacgatgatcgaccatgatgaccggcagaacctgtcgttgctgaggtttgaggcgctgtgggaggaggagctcgcccaggactctctgctgggcttctccacggggaggacgccgtagagctacaaggacttgcggagggacaggactctggtgactccggacgtgaccatcatgtccgcggagaccgtgataacgtacgctgaggagatgccccgtgacgtctgctgatgaggagtgtctgaacagcgactgacacaggagcatcgtcgggcatgacacgaacatgttggcttcggtgtctggca

SEQ ID NO: 32988 - protein, 56 aa, Zea mays
  misc_feature: Ceres CLONE 1410471-F
MDRLGGSARLLLVSDLDQTMIDHDDRQNLSLLRFEALWEEELAQDSLLGFSTGRTP

SEQ ID NO: 32989 - DNA, 747 bp, Zea mays
  misc_feature: Ceres CLONE 1410475-F
  misc_feature: Encodes the peptide sequence at SEQ ID NO. 32990
  misc_feature (582)..(582): n is a, c, t, g, unknown, or other
  misc_feature (583)..(583): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (702)..(702): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
aaagctggagctccccgcggtggcggccgctctagaactagtggatcccccgggctgcaggaattcgcacgagaccattacctagaacatcctaatcgaaaaatatacccccgtcccatcgtatacgaatcacagacaaagcacgagcggtggtagctggccagccaccatggctccaccacctctgttcccgctcccgcctctcctcatcctcctcgtcatcgtgcctctgttccccaccgccgcgccgacggccacgacgctgccgctgtaccgccacctaccgcacgtagccgaggccgtggcatcgcaccaccacccgctgtcccgcctggccgccgcgtcgctggcccgcgcgttgcacctcaagcgccgggaccccaaccaccacagccagaaaggatcaggcggccacccgtcagtaccagccaccgccgcgctgtacccgcactcctacggcggctacgccttcacggcgtcgctcgagacgccgccgcagccgctccccgtgctgctcgacaccggcagccacctcacgtggggtgcatgcacctcgagctacgagtgccgcaactgctcctnncccatcgctcnnngcgtccggtcttccaccccaagactcctcctcctcccgctcgtgggctgccgcaacccctctgccagtgggtccactctggcgcgaacctcgccaacaagtgccgncgcgccccctgctcccccggnnngccgcaatgccccgccgccgca

SEQ ID NO: 32990 - protein, 192 aa, Zea mays
  misc_feature: Ceres CLONE 1410475-F
  misc_feature: SWISSPROT Homolog: EC 3.4.23.12 Nepenthesin
  misc_feature (138)..(138): Xaa is any aa, unknown, or other
  misc_feature (142)..(142): Xaa is any aa, unknown, or other
  misc_feature (143)..(143): Xaa is any aa, unknown, or other
  misc_feature (178)..(178): Xaa is any aa, unknown, or other
  misc_feature (185)..(185): Xaa is any aa, unknown, or other
  misc_feature (186)..(186): Xaa is any aa, unknown, or other
MAPPPLFPLPPLLILLVIVPLFPTAAPTATTLPLYRHLPHVAEAVASHHHPLSRLAAASLARALHLKRRDPNHHSQKGSGGHPSVPATAALYPHSYGGYAFTASLETPPQPLPVLLDTGSHLTWGACTSSYECRNCSXPIAXXVRSSTPRLLLLPLVGCRNPSASGSTLARTSPTSAXAPPAPPXXRNAPPP

SEQ ID NO: 32991 - DNA, 834 bp, Zea mays
  misc_feature: Ceres CLONE 1410476-F
  misc_feature (29)..(29): n is a, c, t, g, unknown, or other
ttatggggggcccccgccccccacccttnagtaattgtaattatagcacaaaacctccataactggaagtcaccgagtgtggcgagccgctctagaactagtggatcccccgggctgcaggaattcgcacgagaccattacctagaacatcctaatcgaaaaacaacatctgtcaccgtgaaatctcggctacctccttctgacttctggtacctcgccgccggggacccaactccgatccccaccccaccataccaaagccaccgcggttgcggctgcggattccgcatcatcaatggtgctgatcactctcgtccgcgactacttcgaccgcatgctccacgacatccctgggaggaagggcctcgtcctcgacccacaaacccgtgggtatggtgaacgtggatgtacaagccagtccggatttgctggagaaatgaaggtccttcctcccccgagaacatgggaacaacgccccccaggttcccaggggagtcccatggccgcaaccttccaagggtccgttctaaacttcccttccggaacccctcccggttaaacaacgggccaaagaaaagcctcccgccaggccaccctccgcccaatggccgccggccttccgccccggaagacccccaccctaattccttcctctcagcttaatcatttggcaaggcgcccccccccaataatatcaaaattaacttttgcctgcgaaccccccaaccgacacaaggggaagggtttacggccaacacacaagttgcccaggaacgcttaccacagtgccgtggatttgtttttggggcgccgcattcggcgcacccataaacc

SEQ ID NO: 32992 - DNA, 761 bp, Zea mays
  misc_feature: Ceres CLONE 1410477-F
  misc_feature (556)..(556): n is a, c, t, g, unknown, or other
  misc_feature (601)..(601): n is a, c, t, g, unknown, or other
  misc_feature (604)..(604): n is a, c, t, g, unknown, or other
  misc_feature (633)..(633): n is a, c, t, g, unknown, or other
  misc_feature (660)..(660): n is a, c, t, g, unknown, or other
aaagctggagctccccgcggtggcggccgctctagaactagtggatcccccgggctgcaggaattcgcacgagaccattacctagaacatcctaatcaaaaatcgagctgagctgagcatcatggggtagtgtgtgtgtgaggcgatagagaagctagtgctcataaccaaccaccactcagtcctcctcctctaccctttcccttccgccgcgttcctacttggtcctagagggagagagatctcgaactccaagggcgcatgctccggttgctagctacgatgccgtgtgcgtagctgcggcagcccttgatcgatcaatcgatcgcttgtgcggaatgagccggatcgagtggagtcagctagctagatactccgtggtcgtcgtcgtcgttggacgtacgccagaagagggagctagagaagaataccgtacagctgcttccaacatggcagctgcctcgtctgcccacctgttcggactcggcgacgggcagatgcagatgcagccgcagcagcagcaggcgccgcctcctcctcttgtgaacaacccggncgcgccgccgcccaaagaagaagcggaaccaacccggtaaccaanccntgacggcggaggtgatcgcgctttccccnaagacgctgatggcgacaaaaccggtncggtgtgcgagtgtgccaacaggggttcccagcgggagcagaacctgcagctggcaccggcgcggcacaaacctggccgtgggaagctgaagcagagaacc

SEQ ID NO: 32993 - DNA, 764 bp, Zea mays
  misc_feature: Ceres CLONE 1410478-F
  misc_feature: Encodes the peptide sequence at SEQ ID NO. 32994
  misc_feature (233)..(233): n is a, c, t, g, unknown, or other
  misc_feature (336)..(336): n is a, c, t, g, unknown, or other
  misc_feature (337)..(337): n is a, c, t, g, unknown, or other
  misc_feature (339)..(339): n is a, c, t, g, unknown, or other
  misc_feature (407)..(407): n is a, c, t, g, unknown, or other
  misc_feature (413)..(413): n is a, c, t, g, unknown, or other
  misc_feature (416)..(416): n is a, c, t, g, unknown, or other
  misc_feature (417)..(417): n is a, c, t, g, unknown, or other
aagctggagctccccgcggtggcggccgctctagaactagtggatcccccgggctgcaggaattcgcacgagaccattacctagaacatcctaatcgaaaagacatcagacatcaccaactcgtcgacggtagagagagcaagctcttcggcgatttgagaagaatcgaggagcgagcgagcgagcgagcgagagaggaggaggaggagctggggcttgagcctgcgcccggnggccccgggtcacggaatcctaccattaccaaccctagccttcgttgatcgccgtctcaggtcatggcagggccggcgccggatcgggccgccctgactgtgnngncgggcatggacatggccatcatgcacgacagcgaccggtacgagctcgtgcgcgatatcggctccggnaacttncgnnggtgcccggctcatgggcgaccggcggaaccagggaatcgtcgccgtaagtacatcgagggcggggagaaaataatgaaaatggccgcggggataatttaccatagatcttggaagcccctaactttttgggttaaagggggtttttaaccccggcccctttggtttttggcggaaataccccccgggggggggttttttagggggttttaaaaaccgcggctccccggagaagggggcccttcttttcccccgcgttttttggggagaactccctctctttaggggaagcccccccggtttttaagagaaacaccccttttgggggggggcccccccctcttaaaa

SEQ ID NO: 32994 - protein, 89 aa, Zea mays
  misc_feature: Ceres CLONE 1410478-F
  misc_feature: SWISSPROT Homolog: EC 2.7.11.1 Non-specific serine/threonine protein kinase
  misc_feature (14)..(14): Xaa is any aa, unknown, or other
  misc_feature (15)..(15): Xaa is any aa, unknown, or other
  misc_feature (39)..(39): Xaa is any aa, unknown, or other
  misc_feature (41)..(41): Xaa is any aa, unknown, or other
MAGPAPDRAALTVXXGMDMAIMHDSDRYELVRDIGSGNXRXCPAHGRPAEPGNRRRKYIEGGEKIMKMAAGIIYHRSWKPLTFWVKGGF

SEQ ID NO: 32995 - DNA, 668 bp, Zea mays
  misc_feature: Ceres CLONE 1410479-F
  misc_feature: Encodes the peptide sequence at SEQ ID NO. 32996
  misc_feature (626)..(626): n is a, c, t, g, unknown, or other
  misc_feature (650)..(650): n is a, c, t, g, unknown, or other
aaagctggagctccccgcggtggcggccgctctagaactagtggatcccccgggctgcaggaattcgcacgagaccattacctagaacatcctaatcgaaaaagcctgtcttgcctccctattccccaattctcccgacgagtccacgaccccagtatagtatccatccctaccctcgaccgcctcaacgaccacctgccacccggccaggcggccaccacgaccacggtcctgcgcccggcggtccttcactccccatgcgttccagcttgcgtacggccagtgcggcggtgccactgccgttccctgcaggtgagcaggtcgtagcccagatctgtgcgatcgtgcaccgccgccggcttcatagttcgcacacaccactagcgatcgactgtcctcgtgcatctccattctccgccagctactcgcgacctctccacgtgaccatgttgagcactacgtcggacattgccagctcgcccagcaggtatacgaaatcttgagtgagctgtacgtccatttggaagtagcaaagaagcaactcctgatgatgcaactgtaaggacaatctttcttatagctctaaggtatgatacaatggcattccatagaaatgttttcccagntcctccatgtcctgagacaaatangaagtttggattgttgct

SEQ ID NO: 32996 - protein, 81 aa, Zea mays
  misc_feature: Ceres CLONE 1410479-F
MRSSLRTASAAVPLPFPAGEQVVAQICAIVHRRRLHSSHTPLAIDCPRASPFSASYSRPLHVTMLSTTSDIASSPSRYTKS

SEQ ID NO: 32997 - DNA, 688 bp, Zea mays
  misc_feature: Ceres CLONE 1410481-F
  misc_feature: Encodes the peptide sequence at SEQ ID NO. 32998
  misc_feature (421)..(421): n is a, c, t, g, unknown, or other
  misc_feature (452)..(452): n is a, c, t, g, unknown, or other
  misc_feature (470)..(470): n is a, c, t, g, unknown, or other
  misc_feature (484)..(484): n is a, c, t, g, unknown, or other
  misc_feature (503)..(503): n is a, c, t, g, unknown, or other
  misc_feature (544)..(544): n is a, c, t, g, unknown, or other
  misc_feature (612)..(612): n is a, c, t, g, unknown, or other
  misc_feature (665)..(665): n is a, c, t, g, unknown, or other
  misc_feature (670)..(670): n is a, c, t, g, unknown, or other
tggagctccccgcggtggcggccgctctagaactagtggatcccccgggctgcaggaattcgcacgagaccattacctagaacatcctaatcaaaaaaaactttagtctactcgtcctcggtcctcctcttctcgcagcagccagcagaccaatcgggacaagcaaactcccccgattagtttaagcagcccgggcccggcgacgaccagctccgttccgcgcggggatttaaacgcgcgaagcgagaaggcacgcagcaggcggcagcggcaagcaacgaacgcgatcgcgcgccgacgacgacgcgcggtgccggcgcctggtggtgccgtgttgcggactccgctgcatcgtctcggtcggtcgtcgtcgttatcatgggtgtccggctgccgggtggcgtggtccgccgtcctcgtncctcctcgtgcgggcggcccgtgggcgcggnaagtacgcggccatcttncaacttcggggacntccctgggtggacgccggncaacctgggtgggtgggacggcatccccggactacctgggncacggcgcgcctgccctacggcatgacccacttcggctaccccaccgggcgctggctcgacggccggncctcgtcgttgacttcatcgccgcagggaacttgggcgttgcgcttgctgccngcgtncaaaggcgaaaaaacgcg

SEQ ID NO: 32998 - protein, 63 aa, Zea mays
  misc_feature: Ceres CLONE 1410481-F
  misc_feature (15)..(15): Xaa is any aa, unknown, or other
  misc_feature (25)..(25): Xaa is any aa, unknown, or other
  misc_feature (31)..(31): Xaa is any aa, unknown, or other
  misc_feature (36)..(36): Xaa is any aa, unknown, or other
  misc_feature (42)..(42): Xaa is any aa, unknown, or other
  misc_feature (56)..(56): Xaa is any aa, unknown, or other
MGVRLPGGVVRRPRXSSCGRPVGAXSTRPSXNFGDXPGWTPXNLGGWDGIPGLPGXRRACPTA

SEQ ID NO: 32999 - DNA, 665 bp, Zea mays
  misc_feature: Ceres CLONE 1410486-F
  misc_feature: Encodes the peptide sequence at SEQ ID NO. 33000
aaagctggagctccccgcggtggcggccgctctagaactagtggatcccccgggctgcaggaattcgcacgagaccattacctagaacatcctaatcgaaaactcttcggcgtcctatcttataatcgcattgcgaaatccccaaatggaggcctcgccactcttccgaatctgaacaatcaccaccgttattaaaaagatgatgcgctgcgctgcaacgggcggagggtgcgctgcttcttgtatcgccgattggatattgccggcgttgaacccctgcagcgtgtggatgctgacgtgcaacgatcgagtggtgcgccggcctgaggccgcgggcggttcatctcgtcggcctcgagatgcccaacctgcgctacggcggagggggcctcttccgaggagagcccgcgctacggtcgcttgcaagccacgacggccgtagacacctgaagatattacattggagcaatgttcacgctatatcctcgcgacatgttctgccatatgatgccgctgcttgctcgatggctactctgcttggataccatcttggcgagatgaatggctgccttgaatatctcgctgaggatcatgggattgctgaacatgctgtcttgcaaggagtgggtggtttagcacatcccttggctgtcgcaacactaatg

SEQ ID NO: 33000 - protein, 102 aa, Zea mays
  misc_feature: Ceres CLONE 1410486-F
MPNLRYGGGGLFRGEPALRSLASHDGRRHLKILHWSNVHAISSRHVLPYDAAACSMATLLGYHLGEMNGCLEYLAEDHGIAEHAVLQGVGGLAHPLAVATLM

SEQ ID NO: 33001 - DNA, 646 bp, Zea mays
  misc_feature: Ceres CLONE 1410487-F
  misc_feature: Encodes the peptide sequence at SEQ ID NO. 33002
aaagctggagctcaccgcggtggcggccgctctagaactagtggatcccccgggctgcaggaattcgcacgagaccattacctagaacatcctaatcgaaaagacgggagcgttatctcgatctgacgctcgcctgggcctgcctctgcctcgacgagctcgccgacgccgacgcgcgccaccacgcgatcctcggcctcccgctcccctgcacctgttgcgcgcccgcacctgacctgcctcctcgaacttcctggtgagctaccctccccgcgccgtcagatcccatcacgacggcctccgcaccagcttccccttcgccggccccaccgacgacgaggcacgcctacacaaaagcatcggagcaagagggccgacgaggagtatcatcggatgtgcggaaggacgaagggaagtttcgtcgccctcgtccacctcgtgcccgagctcgagatgcagctaaaaaaagaccatattcaacttggggtcaatcccccgagggaagccaggcacatgaatcgtgggacggaaaaaacgaaaaaaccgggccctggggaacgccggccccaacaggaaagacccaaattccgggaaacacccaccgggcccttgtatccaaagaggacagccctcaagggaattccag

SEQ ID NO: 33002 - protein, 84 aa, Zea mays
  misc_feature: Ceres CLONE 1410487-F
MCGRTKGSFVALVHLVPELEMQLKKDHIQLGVNPPREARHMNRGTEKTKKPGPGERRPQQERPKFRETPTGPLYPKRTALKGIP

SEQ ID NO: 33003 - DNA, 680 bp, Zea mays
  misc_feature: Ceres CLONE 1410488-F
  misc_feature: Encodes the peptide sequence at SEQ ID NO. 33004
  misc_feature (387)..(387): n is a, c, t, g, unknown, or other
  misc_feature (510)..(510): n is a, c, t, g, unknown, or other
aagctggagctccccgcggtggcggccgctctagaactagtggatcccccgggctgcaggaattcgcacgagaccattacctagaacatcctaatcgaaaaaaacctaaccaagcctctgcggctcttcttcgaatccaactcctccccgatccccaaaatcgaacccaagtcgaaaccctaacctcggccttctcgatgtcggccgccacaaccgccccaacccctgcggtggccaccccgatggcgccgcctccgtcgtacccggcctcctccacgatctccgcctccgtggccgcgtcggtcgaggaagaggacgacctctatggccgcctcaagtcgctccagcgccacatggagttcgtcgagatccaggaggagtacgttnaagacgaacagaagaacctcaagcgcgaactcctccgtgcgcaggaggaggtcaagcggatccagtccgtaccgctcgtcatcgggcagtttatggagatgggcgaacgcacacggggcttcnggggttctaactacggcaggaactactatggtggggatcctcagaaccacaaacgcgagttgctcaggccgcaagattggggcgggtgggatcgcacccccaagttttaaacaaagtgttgccccccgaggccaatccagttttcctttggggggaacctcgaaaaaccc

SEQ ID NO: 33004 - protein, 140 aa, Zea mays
  misc_feature: Ceres CLONE 1410488-F
  misc_feature (64)..(64): Xaa is any aa, unknown, or other
  misc_feature (105)..(105): Xaa is any aa, unknown, or other
MSAATTAPTPAVATPMAPPPSYPASSTISASVAASVEEEDDLYGRLKSLQRHMEFVEIQEEYVXDEQKNLKRELLRAQEEVKRIQSVPLVIGQFMEMGERTRGFXGSNYGRNYYGGDPQNHKRELLRPQDWGGWDRTPKF

SEQ ID NO: 33005 - DNA, 719 bp, Zea mays
  misc_feature: Ceres CLONE 1410491-F
  misc_feature: Encodes the peptide sequence at SEQ ID NO. 33006
aaagctggagctccccgcggtggcggccgctctagaactagtggatcccccgggctgcaggaattcgcacgagaccattacctagaacatcctaatcgaaaaaccctttccctcggtccttgctatctcctagccgccgacgccgccgtggctgaccgatgccctatctacgctcgtcgtctcgttgctctcatttcatctccattctaatggagaaccaacccagccggatgaactgctacggcttgcagctactatcgtcgtcagggacttcgcgtgcctagtgaagtattccccgccgccggagcgatggccaccctcaactctttcgaactccttggcgccgacgacagcggcgacacgagtcacatgattgctgcggcgacggctgctgatgaaaaagccgagacaactaagtcagacgtgccgcctgatgttaaggatgcccagcctgcagcgaccaccaatttcgcgaacaaggccgctcctcactcacagacggctggtgatgcacgcgccgatgtctcataacctcgcggaggatgtgcccgcggtctacgtgttcgtgtcagaggaggacgcgtatatgcgcagaactacggcttcatggggacagtctgatgactatcatggagctatggatgcgtcacctatcgcgatgaagctgtactcggggagactggaaggagaacggggaagagaactgcgtccgccgcccg

SEQ ID NO: 33006 - protein, 73 aa, Zea mays
  misc_feature: Ceres CLONE 1410491-F
MATLNSFELLGADDSGDTSHMIAAATAADEKAETTKSDVPPDVKDAQPAATTNFANKAAPHSQTAGDARADVS

SEQ ID NO: 33007 - DNA, 675 bp, Zea mays
  misc_feature: Ceres CLONE 1410492-F
  misc_feature: Encodes the peptide sequence at SEQ ID NO. 33008
  misc_feature (471)..(471): n is a, c, t, g, unknown, or other
  misc_feature (675)..(675): n is a, c, t, g, unknown, or other
aaagctggagctccccgcggtggcggccgctctagaactagtggatcccccgggctgcaggaattcgcacgagaccattacctagaacatcctaatcgaaaaacgacgcagttcccgtcttcccacgccgtatcgccgttgctatgggcaagaagcggaagctcgagcccaaatcggcggcagggttcacgccggttaaggcctccccgaccaccaggtctgccaccgctaaggccgctggtctatccgaggtcctcgcccccgtcgaggctacgatggagaagctgccgcagggggcaggcggggaggatcgtataggaaatcgaggaggaggtgcaggtcgaggaggaagtggaagtgcaagaggaacaagaaggcgagagcgaccaggcttcgatccaggcgctgctggattcgttccccaaggaccagctcgtcgagatgttacgcgacgctgtcatcgctcacggngacgtgctaaccaccatccggcgcgtggccgacgccgacccggctcagcggaagatcttcgtacacggcctcgggtgagacacacaaccgacaccctcagcgaggtcttcggcccatacggggagatagaggatctcaaggtcgtcaccgaccgcaacccgggcaagtgcaaggtgtaccgattcatcctcttccggcaccgtn

SEQ ID NO: 33008 - protein, 177 aa, Zea mays
  misc_feature: Ceres CLONE 1410492-F
  misc_feature (110)..(110): Xaa is any aa, unknown, or other
MGKKRKLEPKSAAGFTPVKASPTTRSATAKAAGLSEVLAPVEATMEKLPQGAGGEDRIGNRGGGAGRGGSGSARGTRRRERPGFDPGAAGFVPQGPARRDVTRRCHRSRXRANHHPARGRRRPGSAEDLRTRPRVRHTTDTLSEVFGPYGEIEDLKVVTDRNPGKCKVYRFILFRHR

SEQ ID NO: 33009 - DNA, 660 bp, Zea mays
  misc_feature: Ceres CLONE 1410494-F
  misc_feature: Translation starting site: 212
  misc_feature: SWISSPROT Homolog: EC 1.4.1.2 Glutamate dehydrogenase
  misc_feature (648)..(648): n is a, c, t, g, unknown, or other
  misc_feature (660)..(660): n is a, c, t, g, unknown, or other
tggagctccccgcggtggcggccgctctagaactagtggatcccccgggctgcaggaattcgcacgagaccattacctagaacatcctaatcgaaaaatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccaacgaccaggggaaccgcaccacgccgtcctatgtcggcttcaccgacaccgagcggctcatcggcgacgctgccaagaaccaggtcgccatgaaccccaccaacaccgtcttcgatgcctagcggttgatcggcaggaggttctctgatccgtcagtgcagagtgacatgaagctatggccgttcaaggtcatcccagggcctggtgacaagcccatgattgtagtgaactacaagggcgaggagaagcagtttgctgctgaggagatctcctccatggtcctcatcaagatgaaggagattgcctgagcctacctttggttcaccatctagaacgcagntggtgacagtgn

SEQ ID NO: 33010 - DNA, 769 bp, Zea mays
  misc_feature: Ceres CLONE 1410496-F
  misc_feature: Encodes the peptide sequence at SEQ ID NO. 33011
  misc_feature (498)..(498): n is a, c, t, g, unknown, or other
  misc_feature (524)..(524): n is a, c, t, g, unknown, or other
  misc_feature (604)..(604): n is a, c, t, g, unknown, or other
  misc_feature (634)..(634): n is a, c, t, g, unknown, or other
  misc_feature (635)..(635): n is a, c, t, g, unknown, or other
aaagctggagctccccgcggtggcggccgctctagaactagtggatcccccgggctgcaggaattcgcacgagaccattacctagaacatcctaatcgaaaaaggattagtttgaccccctccagtacgtccgcaccgcaaggcctctcgccgtccttggacattctccgtccgtcgcctttgcctggggcagataacaatatctgatatccctgggccttcgccgtccgggcccccctaccttctctcatccgtcctcacacaaagcagaagggggaggagttttaggggaggagggggcggcaggaggagccattattatttcttcttccagcggcaattcctggccaccaccgggcgcgctatattactccgggttcgtggacaagcatgcagaggggcgtgtccttccctggcggaatggcgaaggagtgcccgcccgccgagctctggctcccggacgagttcctggacgacgactccttctccgaggagganaaggcggcggtcgcggccagagcganagcgaccgaggaggaaagggatggacggcctctcgcaccgcgcggccggctcgtcgtcggggggggggggagggaacggnttcccctgcaaaggcgcaagtgttaagcgnnctccgcgcagtcgaattctgtgcggcctgcatgcttttcgggggaggacagccccaaacggggcgggggtcgcaagtcagcttcgccgccgtcgtcgcccgttggaaaaaaaccccggccgaccactgggacct

SEQ ID NO: 33011 - protein, 79 aa, Zea mays
  misc_feature: Ceres CLONE 1410496-F
  misc_feature (36)..(36): Xaa is any aa, unknown, or other
  misc_feature (45)..(45): Xaa is any aa, unknown, or other
  misc_feature (72)..(72): Xaa is any aa, unknown, or other
MQRGVSFPGGMAKECPPAELWLPDEFLDDDSFSEEXKAAVAARAXATEEERDGRPLAPRGRLVVGGGGRERXPLQRRKC

SEQ ID NO: 33012 - DNA, 587 bp, Zea mays
  misc_feature: Ceres CLONE 1410498-F
aagctggagctccccgcggtggcggccgctctagaactattggatcccccgggctgcaggaattcgcacgagaccattacctagaacatcctaatcgaaaacttcccctctctcgcccctcctccctccgtctcgtctcccaggtcatggcaaaagctggagcaccgggaaaaataacagtgggagataacagggagagctaggtgaatacttggagaaaaagtccccccacaccccccacgcaggtggatactaccagtagcagtacaggaaaaaaagcaatctgccctgactgccaaggatttcccgggggggggggtaattgaggccccataattggagggggctttaaaaggaaaaaaaggttttcccctggggccccaaaattttgggtttcccgggaaaaaaaggggaaaaaaaactggggttcccccccacaggggggaaaaacccccccgggaacatgggggttggggggggggggtttttttgggccccccccccaaaaattttctcccgcccgggggggaaaaccccctaaaaaccccttgggaaacccaaaagggggggcccccccggggggcccc

SEQ ID NO: 33013 - DNA, 668 bp, Zea mays
  misc_feature: Ceres CLONE 1410500-F
  misc_feature: Encodes the peptide sequence at SEQ ID NO. 33014
  misc_feature (475)..(475): n is a, c, t, g, unknown, or other
  misc_feature (476)..(476): n is a, c, t, g, unknown, or other
tggagctccccgcggtggcggccgctctagaactagtggatcccccgggctgcatgaattcgcacgagaccattacctagaacatgctaatcgaaaactcccccctgttcccctcgtctcggcgccgcctacgaaaatggctgcgctcgcgaaactcctccgccacagccgccgcagtcatgcccacgtcctccccatctcccgagagctctccaccagcaccccgaccaccggaagaacacgatcccattgccatcacggtgtcccacggcaagagacaactcctccgcgagcgcgatccgtaccgcgtgatctccatcctcgacgtcatcgacacggtggccatctccgctgcttacacccggaacgcgctctccctcgccgagcgccgcatttctcgctcccgccgcttcgctgacgaggaggccctcctctcctcccatctcaccgagaccacaccgaggaccgcctcgcnnaccgtactgtgctactacgcctgcagccacctccccgagaaggtcatcgacgcgttccgctccgctgcgccggtccattctacccccaactcgccgctgcccttcaacgtcctcctctccactttcatacgatgtcggcgctacagacgcgtcctgtcctcttcgctggcttctccaaggagttctccatca

SEQ ID NO: 33014 - protein, 163 aa, Zea mays
  misc_feature: Ceres CLONE 1410500-F
  misc_feature (99)..(99): Xaa is any aa, unknown, or other
MPTSSPSPESSPPAPRPPEEHDPIAITVSHGKRQLLRERDPYRVISILDVIDTVAISAAYTRNALSLAERRISRSRRFADEEALLSSHLTETTPRTASXTVLCYYACSHLPEKVIDAFRSAAPVHSTPNSPLPFNVLLSTFIRCRRYRRVLSSSLASPRSSPS

SEQ ID NO: 33015 - DNA, 738 bp, Zea mays
  misc_feature: Ceres CLONE 1410502-F
  misc_feature: Encodes the peptide sequence at SEQ ID NO. 33016
  misc_feature (388)..(388): n is a, c, t, g, unknown, or other
  misc_feature (448)..(448): n is a, c, t, g, unknown, or other
  misc_feature (449)..(449): n is a, c, t, g, unknown, or other
  misc_feature (608)..(608): n is a, c, t, g, unknown, or other
  misc_feature (655)..(655): n is a, c, t, g, unknown, or other
aaagctggagctccccgcggtggcggccgctctagaactagtggatcccccgggctgcaggaattcgcacgagaccattacctagaacatcctaatcgaaaacccttagttgtatcctctcctcctccttggacctcccatcttccttcctcttcgttcgtttctccaaccgaagcttaccggcattcgctcctggttttccggccaagaaccgatttttttccggttccggcgtagcagcaggcagctagcttgccaccagctgattcattgcctctactagtgtttttcctgagctcggtggggtgatcggtcgatcggccgccgctcgagacacgtacgtacgtacgtacccgatcgagtgtcgctccaagatgatgatgagcgntaaccgtaagcagagggtggcattgtcgccgttgaaggaggccgccgcggtgcccaagtnnagaggtgtggaagtcccgccctgcgtgatgctggtgcataaacgatccccgacgcgtaccccgcgtctgtgcccacatccgcgtcaaggtcaagtcaacggcgtctaccacgagatctacatcattgcccaggcatccttcgcgagctgaagaactgtngtcggaaaaaacggcctgcaccggacgaccagaaggggtgtacaggnacagggagaggactccagggcgtcctggacatggcgcgtcaagacccgtcaaaatgttgatgctgtatgacccgccgcaaggt

SEQ ID NO: 33016 - protein, 73 aa, Zea mays
  misc_feature: Ceres CLONE 1410502-F
  misc_feature (4)..(4): Xaa is any aa, unknown, or other
  misc_feature (24)..(24): Xaa is any aa, unknown, or other
MMSXNRKQRVALSPLKEAAAVPKXRGVEVPPCVMLVHKRSPTRTPRLCPHPRQGQVNGVYHEIYIIAQASFAS

SEQ ID NO: 33017 - DNA, 674 bp, Zea mays
  misc_feature: Ceres CLONE 1410504-F
  misc_feature: Translation starting site: 220
  misc_feature (412)..(412): n is a, c, t, g, unknown, or other
  misc_feature (674)..(674): n is a, c, t, g, unknown, or other
tccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccgggggcctccgggttggccgggtggtggggaacctgttccaggtgatcctgcagcgacggcccttcatgtacgtggtgcgcgacttccgggnagaagtacgggcccatcttcaccatgcggatggggcagcgcacccctcatcgtggtcacctcggcggagctcatccacgaggcgctgggtgaagcagggccccatgttcgcgagccggcccgaggacagccccacccgcctcctcttcagcgtcggcaagtgcaccgtcaactcggcgccctacggcccccctgtggcgtggtctgcgccgcaactccgtcgccgagatcgggtccccgaccgcgttagggcttctcctggn

SEQ ID NO: 33018 - DNA, 676 bp, Zea mays
  misc_feature: Ceres CLONE 1410505-F
  misc_feature: Encodes the peptide sequence at SEQ ID NO. 33019
gctctagaactagtggatcccccgggctgcaggaattcgcacgagaccattacctagaacatcctaatcgaaaaagtttcgacagtcgtcgtcccctctactctcccggcttccgcagaatcccagcttctctggccctctcactccaaacatcgggctccaggccgtctcccgccaacccaaattcgcttcccgccgctccccattaaacccgcttgaaaggtcgcgccctcgagcagagcaacccctgaccacaaatccgatccgtagccgccgtgcctcgatttcgtctcttcccctctgctcgagtacgagcggctactcccggcggcggcggcggcggcggcgatgagcgcggtgagctcgaccatatcaaggagctgatcaagtggggaacagactacatcctcaaaaccttcaattcatctgctgacacgatagacaggattgtcgctccaggtggggtgtaggtgacacctctaaaggcagcagtcaggctaatgaccattaactgctggatggagaccagaggacatccaactacaaaaggcaaggtcaaccgagtggcccttcttgctcaagatctagcggtctggaaatggctggctgcctgggtgacattttccaaaaaggggtcaaaggaaaggaaaaacctactccgacaagcttcgtaaaa

SEQ ID NO: 33019 - protein, 57 aa, Zea mays
  misc_feature: Ceres CLONE 1410505-F
MTINCWMETRGHPTTKGKVNRVALLAQDLAVWKWLAAWVTFSKKGSKERKNLLRQAS

SEQ ID NO: 33020 - DNA, 746 bp, Zea mays
  misc_feature: Ceres CLONE 1410511-F
  misc_feature: Translation starting site: 283
  misc_feature (356)..(356): n is a, c, t, g, unknown, or other
  misc_feature (424)..(424): n is a, c, t, g, unknown, or other
  misc_feature (612)..(612): n is a, c, t, g, unknown, or other
  misc_feature (633)..(633): n is a, c, t, g, unknown, or other
aaagctggagctccccgcggtggcggccgctctagaactagtggatcccccgggctgcaggaattcgcacgagaccattacctagaacatcctaatcgaaaaaggatgacaaaatttcccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgccgccgccatgatctgcgcgatctccggtgaggtgccggacgagccggtggtgtcgaagaagtcggggcttctcttcgagcngcggctcatcgagcgctacattgaggaccatgacaagtgccccatcaccaaggatgagcttactatgnatgatatcgtgccggtcaataccaacaaggtcgtgaagcccaggcctttgcaggctgcaagcattccaggactcctttgggatttttcagagcgagtgggatgctctcatgctttctaattttgctttggagcagcagctactcacagcaagaaaagaactgagtcatgcactctaccagcatgacgnctgctgccgtgtaatacccangtttgaaaaaggaagagatgaggctagagcaccttttggctcaagctgaaagacagattccagcatcagtttgcagagctgctccctgcaagttggttgttcccatgaaaaaa

SEQ ID NO: 33021 - DNA, 726 bp, Zea mays
  misc_feature: Ceres CLONE 1410513-F
  misc_feature: Encodes the peptide sequence at SEQ ID NO. 33022
  misc_feature (458)..(458): n is a, c, t, g, unknown, or other
  misc_feature (477)..(477): n is a, c, t, g, unknown, or other
  misc_feature (486)..(486): n is a, c, t, g, unknown, or other
catagctggagctccccgcggtggcggccgctctagaactagtggatcccccgggctgcaggaattcgcacgagaccattacctagaacatcctaatcgaaaaatccgatttcgattcgatttgccggcggtgcccgcggcggagaggatggcgagctccttctccttcccgctgatgaatccggcggacattgcggaggcgctgcacagctactgcatcgcgcccagccccggcctccgcgccgagcacatcgtcaccccgcagcccggcctcgtcgccgaggtcctcgccctcttcctcgccaacttcgtcggcgacgacgagcccgacgagcagctagagtttcaggcgctgcaggcgatcgacaacccggagcacacatgcgcgccatagcgctctcgcgcctctaccggaggggcaacgccttccctcactccatcctcttcccgggactcangctcggggactttctccgngcgaacggncgcgggttctctacatcctcagggccatattcactttcctcacctaggggagggaaaagctcagttttcttagccccatcgcccaagaggcagcccccctttcgggagcggacccgggagctcggggttaaaaatccccggagcttgcaaagcgaaaaaaaaaccttctcctttagggggcaaatgggggggccccggggtcccaaaaacccggaaaaggggggcccatggccccccagg

SEQ ID NO: 33022 - protein, 81 aa, Zea mays
  misc_feature: Ceres CLONE 1410513-F
MASSFSFPLMNPADIAEALHSYCIAPSPGLRAEHIVTPQPGLVAEVLALFLANFVGDDEPDEQLEFQALQAIDNPEHTCAP

SEQ ID NO: 33023 - DNA, 1917 bp, Zea mays
  misc_feature: Ceres CLONE 1410514
  misc_feature: Encodes the peptide sequence at SEQ ID NO. 33024
agttgccattcctgtcatccggtgtggcctttgggagagggagagagaaggaaggggaggcttcttccgttccggcagcggctccctccgctttcggttctttgcaagatcgagcgagcgcaatcatcgatcgctgccatcatcaccaggcaagcatggcattagcggatggagaggcggattattcttcttgggacagtgacgacgagtaccagaaattcatccaaaacatgaaccctccaagggtcaccatcgacaacacatcatgtccaaatgctacagtcatccatgtggacagcgcgaacaagtatgggatactgttggaggtagtgcaggtcctcaccgacctcaagctcatagtcaagaaggcatacatatcctcagacgggggatggttcatggacgtcttcactgtgacgaaccaaagtgggcacaagataacggacgaatctgtgctgcaaggaataaaagactacatttacaagtctatcgggcctgactcctgcttccttccctcgcggaggaragccgtcggggtggagccgtcctccgaccacaccctgatagagctaacggggaccgacaggccgggcctcctctcggaggtgagcgcggtgctcacgagcctggagtgcaacgtggtgagcgcggagctgtggacgcacaacgggagagccgccgccgtgatgcaggtcaccgacagggagtccgggctggcggtctcggacgcggagagggtcggcaggatcaaggggcggctctacaacgtgttcagagggaggagccgggacgccaagaccgcggtcgcgacgacgggcgccacccacccggagcggaggctgcaccagatgatgttcgaggaccgggactacgagaggcgcggcaaggacgatggcagggcggcggcgagcggcagcaaccccggtccggtggtttcggtcgtgaactggcttcagaaatactactccgtggtgacggtccggtgcagggaccggcccaagctcctgttcgacacggtgtgcaccctgacggacatgcagtacgtggtgttccatggcagcgtggataccgagggccccgaagcttaccaggactactacatcaggcacatcgatgggtgtcccgtcaattcggaggccgagaggaagaggatcatccagtgccttgaagcagccatagaacggagagtgtccgagggcctgaagctagagctgtcgacaggcgacagggtgggtctgctgtcggacgtgacgcgcatcttccgcgagaacggcctgacggtgacgagagcggaggtctcgaccaggggcgacgaggcggtcaacacmttctacgtccgcgacgcggccgggagcgccgtcgagctgaggacgctggaggccatccgccaggagattggccagaccgttctccaggtgaaggggcaccccgagcagccgaagccgccggtagccgcgcaggactcgcccaccaggttcctcttcagcagcctgttgttcagaccgaggtcgctgtgcaacctcgggccctgatgatgagttccagctccagttccagctagcgcagcgcgtgcatgaaaattgagaactgtctgttgtcgggagatgctgctgtaccccaagggcccaagggcaagagttgtacaacgcgatcaggagtgttcattcgtcagaagctcagaacaggtgaccagaagtcgtttaaagcgaagcccacacccaacagctggtgaatactgaatacaccctatagcatcgtccaccgttgagtagtgaaaggtgtagttctgtaaggctatctccattcctgtcgacatggtggtgccccattgcaagtatgattcattcaagcttgctgtaaatactgcctcccacggccatctccatctatttattctccaaaaaaaaaaaaaaaaaa

SEQ ID NO: 33024 - protein, 458 aa, Zea mays
  misc_feature: Ceres CLONE 1410514
  misc_feature (349)..(415): Pfam Name: ACT Pfam Description: ACT domain
  misc_feature (135)..(207): Pfam Name: ACT Pfam Description: ACT domain
  misc_feature (271)..(342): Pfam Name: ACT Pfam Description: ACT domain
  misc_feature: SWISSPROT Homolog: EC 2.7.7.59 [Protein-PII] uridylyltransferase
  misc_feature (124)..(124): Xaa is any aa, unknown, or other
  misc_feature (391)..(391): Xaa is any aa, unknown, or other
MALADGEADYSSWDSDDEYQKFIQNMNPPRVTIDNTSCPNATVIHVDSANKYGILLEVVQVLTDLKLIVKKAYISSDGGWFMDVFTVTNQSGHKITDESVLQGIKDYIYKSIGPDSCFLPSRRXAVGVEPSSDHTLIELTGTDRPGLLSEVSAVLTSLECNVVSAELWTHNGRAAAVMQVTDRESGLAVSDAERVGRIKGRLYNVFRGRSRDAKTAVATTGATHPERRLHQMMFEDRDYERRGKDDGRAAASGSNPGPVVSVVNWLQKYYSVVTVRCRDRPKLLFDTVCTLTDMQYVVFHGSVDTEGPEAYQDYYIRHIDGCPVNSEAERKRIIQCLEAAIERRVSEGLKLELSTGDRVGLLSDVTRIFRENGLTVTRAEVSTRGDEAVNXFYVRDAAGSAVELRTLEAIRQEIGQTVLQVKGHPEQPKPPVAAQDSPTRFLFSSLLFRPRSLCNLGP

SEQ ID NO: 33025 - DNA, 678 bp, Zea mays
  misc_feature: Ceres CLONE 1410515-F
  misc_feature (266)..(266): n is a, c, t, g, unknown, or other
  misc_feature (281)..(281): n is a, c, t, g, unknown, or other
  misc_feature (336)..(336): n is a, c, t, g, unknown, or other
  misc_feature (340)..(340): n is a, c, t, g, unknown, or other
  misc_feature (342)..(342): n is a, c, t, g, unknown, or other
  misc_feature (346)..(346): n is a, c, t, g, unknown, or other
  misc_feature (353)..(353): n is a, c, t, g, unknown, or other
  misc_feature (354)..(354): n is a, c, t, g, unknown, or other
  misc_feature (407)..(407): n is a, c, t, g, unknown, or other
  misc_feature (505)..(505): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (520)..(520): n is a, c, t, g, unknown, or other
  misc_feature (545)..(545): n is a, c, t, g, unknown, or other
  misc_feature (547)..(547): n is a, c, t, g, unknown, or other
  misc_feature (548)..(548): n is a, c, t, g, unknown, or other
  misc_feature (552)..(552): n is a, c, t, g, unknown, or other
  misc_feature (553)..(553): n is a, c, t, g, unknown, or other
  misc_feature (646)..(646): n is a, c, t, g, unknown, or other
  misc_feature (647)..(647): n is a, c, t, g, unknown, or other
cgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaaggncgtggcaagaatcangagagagatagcaggggggctagctagctgagctcgtgcgacgaagaatggccgnattngncagnaacatgnntgacgccgctcctggtgctcaacctcatcatgtacatcatcgtcatcggtttncgcgagctgaaacctgaaccacttcatcaacgggaaaaccaactaccccgggggtggcgaaaaggggcgacgtctaatttcctggggtccccatctgncccnnnggggggggncccgcccccaatttgtggggggggntnncccnngtgccccttggggccccttttcgtcggcccccccgcgccgggggttgccttccccctggggcccccccgggtctcccttctggggttggcggnngggggaccccccccgggggccccccgggggg

SEQ ID NO: 33026 - DNA, 776 bp, Zea mays
  misc_feature: Ceres CLONE 1410520-F
  misc_feature: Encodes the peptide sequence at SEQ ID NO. 33027
  misc_feature (557)..(557): n is a, c, t, g, unknown, or other
  misc_feature (558)..(558): n is a, c, t, g, unknown, or other
  misc_feature (563)..(563): n is a, c, t, g, unknown, or other
  misc_feature (564)..(564): n is a, c, t, g, unknown, or other
  misc_feature (575)..(575): n is a, c, t, g, unknown, or other
  misc_feature (637)..(637): n is a, c, t, g, unknown, or other
  misc_feature (638)..(638): n is a, c, t, g, unknown, or other
  misc_feature (661)..(661): n is a, c, t, g, unknown, or other
  misc_feature (662)..(662): n is a, c, t, g, unknown, or other
tggagctccccgcggtggcggccgctctagaacaagtggatcccccgggctgcaggaattcgcacgagaccattacctagaacatcctaatcgaaaagccgcttccaaatcccaataataccatcgcgtaaatccagatatcagggcagctggaacttgaaggtggcgggagccgagtgatccggcggtgagctgagcggggcgggatggcggcggagcaggggcggtcgcttggcggagacgcccacctggtccgtggcaaccgtcaccacgctcatggtcgcttgcctgcttcctcgtcgagcgctccctctcgcgcttcgccaagtggctgcgcaagaccaagcggaaggccatgctcgccgcgctcgagaagatccgcgaagagctgatgctgctcggagtcatctcgctgctgctcagccagacggcgcgcttcatatcggagatctgcgtgccgtcctcgctcttcaccagccgcttctacatctgctccgagagcgactaccaggacctgctgcgcaacacggacgccaaccagacgggctcgacagaanncatgnntcgtggcaacngctgcacgtcttggtggcgagggcatggaaccttttgttttcgtacgagggccttgagcagnntgcaccggttctctttcatctgnnataactcatggggggggacagtgttttaaaaaaaaggggggttccgcccatgacaaaattattaaggggggggggagaaaggggaaaaactcttaccaggcccaattgtgtggg

SEQ ID NO: 33027 - protein, 111 aa, Zea mays
  misc_feature: Ceres CLONE 1410520-F
  misc_feature (68)..(68): Xaa is any aa, unknown, or other
  misc_feature (70)..(70): Xaa is any aa, unknown, or other
  misc_feature (74)..(74): Xaa is any aa, unknown, or other
  misc_feature (94)..(94): Xaa is any aa, unknown, or other
  misc_feature (95)..(95): Xaa is any aa, unknown, or other
  misc_feature (102)..(102): Xaa is any aa, unknown, or other
  misc_feature (103)..(103): Xaa is any aa, unknown, or other
MLAALEKIREELMLLGVISLLLSQTARFISEICVPSSLFTSRFYICSESDYQDLLRNTDANQTGSTEXMXRGNXCTSWWRGHGTFCFRTRALSXXHRFSFIXXNSWGGTVF

SEQ ID NO: 33028 - DNA, 883 bp, Zea mays
  misc_feature: Ceres CLONE 1410521-F
  misc_feature (11)..(11): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (20)..(20): n is a, c, t, g, unknown, or other
tcccccccccnaanntnaanaacttaaaatacttttccccccccccccaaagctggagctccccgcggtggcggccgctctagaactagtggatcccccgggctgcaggaattcgcacgagaccattacctagaacatcctaatcaaaaaacggtttgcgtataaataagtagtcagtcgctcatcttgttccttgtgaacatcgcagtgctgtagcctccttcgtcttgagcgagcatggagatgtcagccatggaggaagccctccccaaggcgatggagaggaggaaggaaggcctcataaccattccgttcatcatcttaaacgagatattccagaaggtggccacgctcgggctgtccctccaaacacgctccctggcccctcaccggagaggtatctcattgaacgaagctatctgctcacgcccgccccccaacaccgtgctcaagtcactcctccgacctcccctcccccctacccaccccgcacaccgccccccccccacatacccacctctcaagcacgctagacctatatcttcaataattcgtacattctccccccggcgctctcccccctcccctccccacgcgcgacctctgggattatttaaccctcaccatcgacgaccccccctccgagggctcgcgactgccagcccagacgccaaccgccacccccccgactgtcgctacgatatatctcataccacacctccatccccacccccgtacgctaatagtgctcttctccaaccccacgccctactaagtcacccccggcccacacccgaacaaccccacctgaataataccataaagtaaccgacatcacacgtaacgacgccatgtggtggtaaacctctttacacccccaccg

SEQ ID NO: 33029 - DNA, 764 bp, Zea mays
  misc_feature: Ceres CLONE 1410522-F
  misc_feature: Encodes the peptide sequence at SEQ ID NO. 33030
  misc_feature (575)..(575): n is a, c, t, g, unknown, or other
  misc_feature (602)..(602): n is a, c, t, g, unknown, or other
  misc_feature (739)..(739): n is a, c, t, g, unknown, or other
aaagctggagctccccgcggtggcggccgctctagaactagtggatcccccgggctgcaggaattcgcacgagaccattacctagaacatcctaatcgaaaaaccttctccatctccatcgccggcctccatttcttgcctatcccgtgccagccagtcactctcgtccgccacagatcgagaagccaccaccaccgccaccgcatggccatggcagcccagcagcaccggcaccacaagcgccgccgcatcgccctctccccctccccgtccccgtccctcgcgcccatccccggcgcccccacgccgccgctcgactcgctggccgacgagctcctcttcctggtcctggaccgcgtgggccaggccgacccgcgggggctcaagtccttcgcgctggcctcccgcgcctgccacgccgggggagtcccggcaccggccgaacgctccgcccggctccgcggggaacttcctgtccgccgcggctggggcggtaccccgtccgagaacccgcccacttcacccttttgggggtggagtcccctaaagcccgccctcgccttccgcggttgggntccggggtcctcccgcccttcgggggngtaaaacttctcccggttccccggggtttcgggcgccgccctggtgccccccgacttcgcccgccgcgtggccccggcctttgccgaacctctcactttttccaataggggcccccctcgtcggggacccctagcgnctctccgagttctcccctctaccct

SEQ ID NO: 33030 - protein, 130 aa, Zea mays
  misc_feature: Ceres CLONE 1410522-F
  misc_feature (122)..(122): Xaa is any aa, unknown, or other
MAAQQHRHHKRRRIALSPSPSPSLAPIPGAPTPPLDSLADELLFLVLDRVGQADPRGLKSFALASRACHAGGVPAPAERSARLRGELPVRRGWGGTPSENPPTSPFWGWSPLKPALAFRGWXPGSSRPSG

SEQ ID NO: 33031 - DNA, 650 bp, Zea mays
  misc_feature: Ceres CLONE 1410525-F
  misc_feature: Encodes the peptide sequence at SEQ ID NO. 33032
  misc_feature (270)..(270): n is a, c, t, g, unknown, or other
  misc_feature (335)..(335): n is a, c, t, g, unknown, or other
  misc_feature (405)..(405): n is a, c, t, g, unknown, or other
  misc_feature (458)..(458): n is a, c, t, g, unknown, or other
  misc_feature (461)..(461): n is a, c, t, g, unknown, or other
  misc_feature (473)..(473): n is a, c, t, g, unknown, or other
  misc_feature (474)..(474): n is a, c, t, g, unknown, or other
ccccgcggtggcggccgctctagaactagtggatcccccgggctgcaggaattcgcacgagaccattacctagaacatcctaatcgaaaaaacgcaaacccaactgtcttggttgcgcaagcaccaagcaggtggaagatgatggaggtggcgggggctaaggcccgcgcggttcccctcctgctccgcaacaccgcctccctgcggacctccgtctccgtctcctgcacgggctcccgccggagctggggtggcggcggccaccggcgnaagggggacgagacccgcggcttcgacaaggtgcccatggacacccccggcgcgtaccgcctggntagaccggacaccggccgcagcgtcatcgtgtggggcggcaccgacgacagcgacgaggcctccatgcgntccccggcggtgctctcccggacaccgaccgcgcacagccaaggtgttggggnagnaacaggtatcgnnaatttcggcaggttccaggcacagaaaataaaatcttggtcaccgagccagctcacgcaagagggagagtccaatcgctcaagactgcctggtctgaagaatcttccttcatgcctctgaagaggaagagaaagctattttaagagaaaaagcatggtccaaattctgaagccacc

SEQ ID NO: 33032 - protein, 150 aa, Zea mays
  misc_feature: Ceres CLONE 1410525-F
  misc_feature (65)..(65): Xaa is any aa, unknown, or other
  misc_feature (106)..(106): Xaa is any aa, unknown, or other
  misc_feature (107)..(107): Xaa is any aa, unknown, or other
  misc_feature (111)..(111): Xaa is any aa, unknown, or other
MEVAGAKARAVPLLLRNTASLRTSVSVSCTGSRRSWGGGGHRRKGDETRGFDKVPMDTPGAYRLXRPDTGRSVIVWGGTDDSDEASMRSPAVLSRTPTAHSQGVGXXTGIXNFGRFQAQKIKSWSPSQLTQEGESNRSRLPGLKNLPSCL

SEQ ID NO: 33033 - DNA, 685 bp, Zea mays
  misc_feature: Ceres CLONE 1410527-F
  misc_feature: Encodes the peptide sequence at SEQ ID NO. 33034
gctctagaactagtggatcccccgggctgcaggaattcgcacgagaccattacctagaacatcctaatcgaaaaagaagatttgattggtttccccaaatccggtgactccattcctgttgttcttcacgtcgaccccgggaacctcccagaaggctctagcgaccccggccgcccggcgctctgagggctgtgctgccggcggcgagatccaggagctgcctgccatggtgaaggacagcgcctactacgacgtcctaggggtcagcgtcgacgcgtcctccgccgagatcaagaaggcgtattacatcaaggcgaagctggtgcatccggacaagaatcccgggaacccctgacgccgcacttcaagttccaggaacttggagaggcctatccagtttcttagtgatcctggggaaaaaggaggctttatgataagtatgggaaaggagggtattccccaggaaaccatgggggatccctgctgctggctttgggaatgattttttggaacgggctattttgaagattacgttggcccacctggctctaggttctataccccccaggagaggggttggtggaaaaccccaaccggccaaaaaccaaggacgcaaaggttcaagaaaaggattaaaagagttcccaagagaggaggagaaacaaagagttcccccggagcctgg

SEQ ID NO: 33034 - protein, 42 aa, Zea mays
  misc_feature: Ceres CLONE 1410527-F
  misc_feature (6)..(42): Pfam Name: DnaJ Pfam Description: DnaJ domain
MVKDSAYYDVLGVSVDASSAEIKKAYYIKAKLVHPDKNPGNP

SEQ ID NO: 33035 - DNA, 680 bp, Zea mays
  misc_feature: Ceres CLONE 1410528-F
  misc_feature: Encodes the peptide sequence at SEQ ID NO. 33036
aaagctggagctccccgcggtggcggccgctctagaactagtggatcccccgggctgcaggaattcgcacgagaccattacctagaacatcctaaaaaaaaaacggttaaacccatgccgataatcgacgccgccgcctcggcggtcgcgccgcccccaccccggcgagtggctcaactccgcttcttcagcactcgcagacccggaatcctatccctaactgccaccagctgctccccctcccctccgcccccggtcgctgcggaggtgcctgcggcgccacaggaagcgaagtcgaaggcgaggccacggcggtacccgaagcagaaccccggagagtcggagggcgctgctgaggagatgcgctttgtcgccatgcgcctgcgtaaccccaagcgcaccaccataaaagacaagtcggtgacggaggacgcggacgcctccgcgtcagtgtcggagggcgaggctgaggaggacgacggcggcgacgtgaaggaggaacacgaggaggatgactgaggcgatctcgaggaaggcaaatgcatgcccacaatgaaggggctcgtgcgatacctgtcgtacagcaggctcagtcttcgaaccatcaaatgggtcgtggccgagcccaccgatgtcgcctgtgaagcaacagttctcttcccccattactttgctgggga

SEQ ID NO: 33036 - protein, 134 aa, Zea mays
  misc_feature: Ceres CLONE 1410528-F
MPIIDAAASAVAPPPPRRVAQLRFFSTRRPGILSLTATSCSPSPPPPVAAEVPAAPQEAKSKARPRRYPKQNPGESEGAAEEMRFVAMRLRNPKRTTIKDKSVTEDADASASVSEGEAEEDDGGDVKEEHEEDD

SEQ ID NO: 33037 - DNA, 675 bp, Zea mays
  misc_feature: Ceres CLONE 1410528-R
  misc_feature: Pfam Name: Heme_oxygenase Pfam Description: Heme oxygenase
ccaattgggtaccgggccccccctcgaggtcgacggtatcgataagcttttttttttttttttttagccaaacagcggctctgctgatcctggttaactgtggacaaacaaccaaacaagtagacttgttttggtttgcacgaatgcatacaggctatgcccagcctgcatctgggctttgacctggatcacctgatcctgacaaccaaacagccgcatagtgctcgctgaccctcttcatctattacaccaaaaaggaccctccagacttctgacatgttatttagttgataaggatattaactcctcaagagtaactgcactgcgccgcctccagccatactagtgtccctctaatgcatgccgcgagcttaaactgggatttatccaacaaacacaacggctcacaagataattaaccggaccatctttcccaagtactggaagcattttgcagcttctttcaagcacaagttcctgtccttccgagtccagtgcttgctgagctcattcagcttctccctggcatcttttagtagaagttcagcatcagtatcccacttgtagaactccagctcccttccttccagaatcttttcgcagatcttattgcctattgtgacacctccagttatatgagcaaaatagatattgtaataatgagagaggaatgca

SEQ ID NO: 33038 - DNA, 1072 bp, Zea mays
  misc_feature: Ceres CLONE 1410529-R
  misc_feature (995)..(995): n is a, c, t, g, unknown, or other
  misc_feature (1005)..(1005): n is a, c, t, g, unknown, or other
caacaaattatggtcctcgagcgtctcgtttgtttttttttttttatggaattcttgctatagaatgtacaaacggcaacatcttaacacgatttgctctagttctaacaactctcaaaactgttggagacattggataaatataagctgagactatgggcaccaacgacagaacacaggcttagtgcgtaggctgcctgttcttcttcttgacaccagacttggcaaactggaggctgcggtacacagagctcagcctaccaagggccgacttggtcagatcaggcctgtaatagttgtcgccaacctggtttttcacagaccttggccatcttgcggaactccttgagcatcacagaccttgtggctgagcttcacgggtgtgtactgcttctcgggcttgggagccgatgccccacacagccgagtccttttccagcagctggctggattcgttacagtttgcgctgtttgcaacagccagaagtaccttgtagggagtgtaaaagtggagaagagttttgttagggctgcccttgttgaaacaacggcaatatcgacacatgaccgcaaggaggggaaaggtgggtggcagaccacgagaggcatgattgattttttttttcaagcaaccagagtcttgtgattcggtggttagtgcagaatacactagtgttagaattgtgatataataacaatattttgtttactgcttccacacgtaaagctgatgcacaagactgcttatgagagtgtgggtctgttttaggactatgcaccacgaggtgcttcttagtgtagtctccggctacacagggggcgagctaggcggagagaggaacaacgcgctgtcgatggtgccgaaactacatttgctatcacactatcgcctcggtgatcaaccggcatgggtgcatgtacttaattctattcctctgaatgaacggcccgggctgttgtcggtcttaaatttaagatatttttacatttaaggnggaaataaanaaaactgtcacacacaacgcatagcagaatttatggatgatatttgcgttagcgactgatgttgtga

SEQ ID NO: 33039 - DNA, 662 bp, Zea mays
  misc_feature: Ceres CLONE 1410531-F
  misc_feature: Encodes the peptide sequence at SEQ ID NO. 33040
  misc_feature (519)..(519): n is a, c, t, g, unknown, or other
gctctagaactagtggatcccccgggctgcaggaattcgcacgagaccattacctagaacatcctaatcgaaaaaacagcaaagcccaggctgcccagcacacgcgacgcgaaccagctgccgaggaaccctagcggagcactgtgcaggcgaccgcggcgcgctatcacttacggggggatacggcggcatcgtccccctcggcccctcctccatccctggtgcggcggcgccagcctgcaggtgttgaatgctgatttgttgtggctgattaattgggttgatcgtcgattaatcgtgattagtccgctgatcgcccttctggcgatcagaaacgataaggcaatctgaaaacattggccgccaaacctccagagcgactcccgcgagccgtgaccaccatagccaaatcaacgcaccagaagctttcacggagctgtctcgtccacgagtggtccagctgactcctattcccctgcgtcatggcgagctctgcgatgaaagggggggggggggtgnttgacctcggtcccggggggggagtccgtgggttgcccaacaaggaggcgcacgccacgcccccccacggagattgggcccctttgcatgcgctgcggcggaaacggaatcacgaggctttttggcggacgttgatcccgacc

SEQ ID NO: 33040 - protein, 60 aa, Zea mays
  misc_feature: Ceres CLONE 1410531-F
  misc_feature (13)..(13): Xaa is any aa, unknown, or other
MASSAMKGGGGVXDLGPGGGVRGLPNKEAHATPPHGDWAPLHALRRKRNHEAFWRTLIPT

SEQ ID NO: 33041 - DNA, 750 bp, Zea mays
  misc_feature: Ceres CLONE 1410532-F
  misc_feature (324)..(324): n is a, c, t, g, unknown, or other
  misc_feature (574)..(574): n is a, c, t, g, unknown, or other
  misc_feature (599)..(599): n is a, c, t, g, unknown, or other
  misc_feature (600)..(600): n is a, c, t, g, unknown, or other
ctggagctccccgcggtggcggccgctctagaactagtggatcccccgggctgcaggaattcgcacgagaccattacctagaacatcctaatcaaaagtgtctagtgtcttccgtctcgatcccgcgggtgggactcgccggcgacaaaaacgaaaagcgacttgccctccgcggcctccggccttcccactccactcgccctcctctcctagcgtcggtgagccggtgcgctgcagtccccgctccccttccgcgtcgccgcgatggaggtcttccgggagcacggggacgacggagtgccctaggattccatcacgccgccnagcatcagtcccgcagccagggatttcttctccgaccccgaccttcatgtgagtcgcggccttcctcctcgaagcggatccggcggattggaggggccaaccatagcaggtacttccttgcgggtgtaagcatttcgctgcacttggagacgcttatttggagtatttgaaagtatgagttggctctctggtctggtcagttatgtgcctgtgcttcataaaaaagagctacattttcttctactagggnctttgggactgcccagatgaaaagnnagatttcctggtctctgtgccatgggctggtcatggctcaaaatggaaaagggccatgtcgtggcaaatgggggaataatctgaccttgtccttttggtgaaatggaggcagcttttccccgggagggaaagggatcaggagccaagggt

SEQ ID NO: 33042 - DNA, 749 bp, Zea mays
  misc_feature: Ceres CLONE 1410535-F
  misc_feature: Encodes the peptide sequence at SEQ ID NO. 33043
ggagctccccgcggtggcggccgctctagaactagtggatcccccgggctgcaggaattcgcacgagaccattacctagaacatcctaatcgaaaactcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggtgtcgacggcctcccgccggggcctccgggttggccggtggtggggaaccctgtcccagtgatcctgcagcgactgcccttcatgtacgtggtgcgcgacctccgggagaaagtacggcccatcttcaccatgcggatggggcagcgcaccctcatcgtggtcactcggcggagctcatcccacgagcgctggtgaaagcaggccccatggtcccgagccgggccggaggacagccccaccggcctcctcttcaggggcggggaaggggaccgttaaactcggggccctacggcccccttgggggtggggtttgggcccaaaattcgttcccgaaaatcgtgcccccccaccgggtcaagggtttcccctggaacccggaaaggggcccgggaaacgccaatttgcccccccccccgcccaaattctggggaaatggcccctggggtt

SEQ ID NO: 33043 - protein, 91 aa, Zea mays
  misc_feature: Ceres CLONE 1410535-F
MDVNDVLLVVLAAALAAMWWRRCSKTGVDGLPPGPPGWPVVGNPVPVILQRLPFMYVVRDLREKVRPIFTMRMGQRTLIVVTRRSSSHERW

SEQ ID NO: 33044 - DNA, 759 bp, Zea mays
  misc_feature: Ceres CLONE 1410537-F
  misc_feature: Translation starting site: 500
  misc_feature: SWISSPROT Homolog: EC 1.14.99.33 Delta(12)-fatty acid dehydrogenase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (37)..(37): n is a, c, t, g, unknown, or other
  misc_feature (42)..(42): n is a, c, t, g, unknown, or other
  misc_feature (46)..(46): n is a, c, t, g, unknown, or other
nnnnnnnnnnnnnnnaaaannngggggaagaaaaganaaaanaacnccctcctctttacaagctggggctccccgcggtggcggccgctctagaactagtggatcccccgggctgcaggaattcgcacgagaccattacctagaacatcctaatcgaaaaagcaggagcagcgcgcaccggtggagaagcctccgttcaccttgggtcagatcaagaaggccatcccgccacactgcttcgagcgctcggtgctcaagtccttctcctacgtgctccgtgacctcgtcaccgccgcggcgctcctgtacttggcgctggtcaccatcccggcgctcccgagcccgctccagtacgccgcctggccgctctactggatcgcacaaggctgcgtgtgcaccggcctgtgggtcatcgggcacgagtgtggccacaacgcctttctcggagtacccgctccctcgacgacatcgttgggcctggtgctgcactccgcggctgatggtcccgtaccttctcggggaaagtacagccaccgggcgccaccactcccaacattggctcccctggaaccgcgaccaaggtgttttgtgccccaaaaaaaaaggaaggggcttgccgggggtacacccccgttacggtggtgccaacaaccccccgtggggcccgttcttgctgcaaaatacggtccggggcaagcataaaccccctcgggggtgggccccacttgggaacctgggaacccaccaaagcgggggttg

SEQ ID NO: 33045 - DNA, 668 bp, Zea mays
  misc_feature: Ceres CLONE 1410539-F
tccccgcggtggcggccgctctagaactagtggatcccccgggctgcaggaattcgcacgagaccattacctagaacatcctaatcgaaaaaatcaactcatgctcgccagactccctcgcgggggcttcccatttatcgggccgtccatgaccatggtagagacgacgagcgccgccacccagatgcacgccgcgatgaaacggtcgtagtcgctctcgtcactgcgggtcgccttcacggtggtcgcgtggatcgcggcgctggccgtcgcggcggccgtcacgaggtacaaccgcagatacgtgggactgacgttgtctccgggcccgaccgggtggcacgacggccacaacctgaaccaagtggcgtgctccgtcaagctcttcatccagtacatccgctagctccgccaggagtaccgaaccatcctgaggctgcgcatgggggagcgctcgctcgtgatcatcaatagagccgagctcgcaccctagaagctggggaaaaaaaggtggggaattcaagaagcctggccccggtggaactccaagcgcaaacatctttctccctgcaacggggttcgccgaaaaactcactcaatgaaacgggcccgaagtgggccatacgctgggagacaggaaaatggttgttgcgagggatccttaaacc

SEQ ID NO: 33046 - DNA, 751 bp, Zea mays
  misc_feature: Ceres CLONE 1410540-F
  misc_feature: Translation starting site: 242
  misc_feature (610)..(610): n is a, c, t, g, unknown, or other
  misc_feature (661)..(661): n is a, c, t, g, unknown, or other
aaagctggagctccccgcggtggcggccgctctagaactagtggatcccccgggctgcaggaattcgcacgagaccattacctagaacatcctaatcgaaaaagggaccaaatcaactcaagtcatcgagtccacagctcgcgcgcgctgccgccagccaatcgctctgcctccggcctccgcagcccaaaaccacctcggccccacttcttctctccgtcgccccctgtttgcccaacccatggcgacccacgccagcgacaatggcagcgggcacgcggagtggcggttcgctcgtgcggcgaaggagggtgcgctggccgtggccggggacaagatgagcatccgggcggcgcggttcaagatcagcgcgagcgtggacgggcgcgacccgcggcccgtgctgccgcttgcgcacggtgaccacctcggtgttcccggtcttccgcaccgccgcccgagccgagtacgccgtggccgccgcgctccggacgagcaagttcaactgctaccccggcggcgtcggcctcccgaaagcccgccgtgctctggcggagcacctgtaaagtgatcttccgatacagctgtcaactgatgacatcttcctcancgctggagcaccaagcccattttgagtttgtcgtctcagtccttgaccaancaggcgcctacatattgctcccaagacagctatccaaattaatgaggcgcgtgcagactggaacaactacacgtcgtcatttgattgatt

SEQ ID NO: 33047 - DNA, 749 bp, Zea mays
  misc_feature: Ceres CLONE 1410545-F
  misc_feature: Encodes the peptide sequence at SEQ ID NO. 33048
  misc_feature (60)..(60): n is a, c, t, g, unknown, or other
  misc_feature (66)..(66): n is a, c, t, g, unknown, or other
  misc_feature (67)..(67): n is a, c, t, g, unknown, or other
  misc_feature (328)..(328): n is a, c, t, g, unknown, or other
  misc_feature (329)..(329): n is a, c, t, g, unknown, or other
  misc_feature (406)..(406): n is a, c, t, g, unknown, or other
  misc_feature (430)..(430): n is a, c, t, g, unknown, or other
  misc_feature (433)..(433): n is a, c, t, g, unknown, or other
aagctggagctccccgcggtggcggccgctctagaactagtggatccccccgggctgcanggaatnntcgcacgagaccattacctagaacatcctaaaaaaaaaggaattctgccttctttctctcatcttcctgctcaacatcagtagcagctttagctgtagcagcgccaccggccaccgccacgccttggccaccacgttgcacaagcccctgggggcgatcaccgttgacgacctcgccgcggcggcgcctgggtcggacgccaccgcgctccacgcagcgctccggcgcgcgctcgactcgcacggacccaccgaagtgtgnngcgagctctgccggtccgtgctctgtccgtctgtccccttcgcccgtcaccggatgctctactacggttgctttcgncggggtttccgtctcccacgccgncgnctggacgcccgaccccaagggaggctgtctttgaccattgtcggcgtgtcctcgaggggcgtggtaaggacttcatcggcgacgggtacaaggattccatcaacaggtttccagaacttcacaagttctcaacgaaattccaaggggtatttggaaaaatggtttttgggggaattggggttcccaattcagggaaaacccttccggactctggaaagaacctggaattccgggggggggaaggggttaaaagggccaaacccacggggggggaaataggttgagggaaaacccggggagctccccaagccccctt

SEQ ID NO: 33048 - protein, 109 aa, Zea mays
  misc_feature: Ceres CLONE 1410545-F
MLYYGCFRRGFRLPRRRLDARPQGRLSLTIVGVSSRGVVRTSSATGTRIPSTGFQNFTSSQRNSKGYLEKWFLGELGFPIQGKPFRTLERTWNSGGGKGLKGPNPRGGK

SEQ ID NO: 33049 - DNA, 745 bp, Zea mays
  misc_feature: Ceres CLONE 1410547-F
  misc_feature: Encodes the peptide sequence at SEQ ID NO. 33050
tggagctccccgcggtggcggccgctctagaactagtggatcccccgggctgcaggaattcgcacgagaccattacctagaacatcctaatcgaaaataccttcaataagaatggctccatgatatttctggatttgtcatttaatcagcttgactcagagatcccaaaggagcttgggaacatgtactacctcatgatcctgaatcttggccacaacttgctgtctggcgtcatcccaccagaactagctggtgccaagaagcttgctgtactcgacctgtcacacaaccagttggaagggcctattcccaactctttctcgacgttgtccttgtcggagatcaacctttcaaataatcagttgaatggttcaatcccagaagctcggttcgctgttcacatttcccgaagatttcatatgagaataaactctggtctttgtggcttcccactgttgccatgcgggcacatggctggctcaagttcttcccgatgggcacgatccccacggaccagcttcactcggggggtagtggtgctatgggactcttgggtctcgctgtccctgataagtgggattgccatcataattggtgagtgcagaagcgaaacagatcatgggagagcaagtactctcgtgactatactttgatagccgtctcattctgggactataattccattggagactctcgggactacgcctcaggtcaccttgctggttttgaaaggatgcggaccccc

SEQ ID NO: 33050 - protein, 177 aa, Zea mays
  misc_feature: Ceres CLONE 1410547-F
  misc_feature: SWISSPROT Homolog: EC 2.7.11.1 Non-specific serine/threonine protein kinase
MIFLDLSFNQLDSEIPKELGNMYYLMILNLGHNLLSGVIPPELAGAKKLAVLDLSHNQLEGPIPNSFSTLSLSEINLSNNQLNGSIPEARFAVHISRRFHMRINSGLCGFPLLPCGHMAGSSSSRWARSPRTSFTRGVVVLWDSWVSLSLISGIAIIIGECRSETDHGRASTLVTIL

SEQ ID NO: 33051 - DNA, 648 bp, Zea mays
  misc_feature: Ceres CLONE 1410551-F
  misc_feature: Encodes the peptide sequence at SEQ ID NO. 33052
ggagctccccgcggtggcggccgctctagaactagtggatcccccgggctgcaggaattcgcacgagaccattacctagaacatcctaatcgaaaagattgattcacaagacgtcgatcccaaaccctaaccctttcaacggttccactccaccaccaacctcatgtgtcggcgcccgccgccgcacccaacccctccctcctccgtctgctcccggtcctcgcgtagccgcaacctccctcgttgccccacactacccacgtccctagcgtcatgcagatcaaaaccaaggggcaggcggcgacagtggttcagagtccgccgctgacggccctgcgaggaacgggtagattcgcttggtgtccgggcggctccgcgtcgccgaatcgatagcattgtggatctggaggaaggaaaaggcttggtgtaaaaacgggaggacgaggcggttatggcccaaaaaaaagggggaaggcctctccagaattggtttcgggaagggtgggccctcccccccctaaattggaagaagaccccgcgcccaaaaaaaacttcatcaccgcccgtcttaacccacaaaaaatgggcccgcggccataccacattcgatacgaaaattggtaaagacccgggaaaacagctgcccag

SEQ ID NO: 33052 - protein, 39 aa, Zea mays
  misc_feature: Ceres CLONE 1410551-F
MQIKTKGQAATVVQSPPLTALRGTGRFAWCPGGSASPNR

SEQ ID NO: 33053 - DNA, 698 bp, Zea mays
  misc_feature: Ceres CLONE 1410552-F
  misc_feature: Translation starting site: 514
  misc_feature: SWISSPROT Homolog: EC 4.1.1.19 Arginine decarboxylase
  misc_feature (255)..(255): n is a, c, t, g, unknown, or other
  misc_feature (268)..(268): n is a, c, t, g, unknown, or other
  misc_feature (342)..(342): n is a, c, t, g, unknown, or other
  misc_feature (424)..(424): n is a, c, t, g, unknown, or other
  misc_feature (511)..(511): n is a, c, t, g, unknown, or other
  misc_feature (530)..(530): n is a, c, t, g, unknown, or other
tggagctccccgcggtggcggccgctctagaactagtggatcccccgggctgcaggaattcgcacgagaccattacctagaacatcctaatcgaaaaacagcactaaagtctattcatctctggctccccaaattcagctggagagcactttttcccatcatggataagaactacggtgaactctacaacatcctcggatggggtgaggagtacttcgcggtgaacacggagggcacctcagcgtgaagcctttncgccgctggacgnagcccgggcaggagatcgacgtgcactcggtcatcgtggaagctctagcgacccaacccaacgacagcaccagncaaatctcagttccccatgatccttcgccttccccgacgtgctcaagaaccgtatcgagacgctccataacgcattcacagncgccatggagtccacccgggtacacgtccaggtacccaagggcgtgttccccgatcaagggtgaacagaacaagcacgtcgtgaggnaaatgggtttaggttcggncagcaatgggaactatgggcctcgatgctgggcttccagccagaaactgctcatcgccaagagctgcctccccggcacggaagcgaacccaaagccgtacttggatttgaacgggtaacaaggagggggacaacttcgggctcgggtttttcggggggggccagggcg

SEQ ID NO: 33054 - DNA, 753 bp, Zea mays
  misc_feature: Ceres CLONE 1410553-F
  misc_feature: Translation starting site: 170
  misc_feature: SWISSPROT Homolog: EC 3.1.3.2 Acid phosphatase
  misc_feature (283)..(283): n is a, c, t, g, unknown, or other
  misc_feature (297)..(297): n is a, c, t, g, unknown, or other
  misc_feature (315)..(315): n is a, c, t, g, unknown, or other
  misc_feature (339)..(339): n is a, c, t, g, unknown, or other
aaagctggagctccccgcggtggcggccgctctagaactagtggatcccccgggctgcaggaattcgcacgagaccattacctagaacatcctaatcgaaaaccatccatccatccagttagttagttagtaagttagttgagggagaagaagcaggggaggggaagcgatgagcaacatgctgcgggctcgccgccgcctggacctcctgcaggtggtgctcttcgccgctgtgctcctcgtcgtcgtcgccgacgccggcgtgacgagccagtaccggcgnaagctggaggcgancgtggagatgccactggnacgcgacgtcttccgcgtccccgncggggttacatgccccgcagcaggtgcacatcacgctgggtgaccaagagggcacgcgatgatctggtgccggggtgacagccaatggactgggcagcaccaccgtcatgtacagcgaaggggtccccgaacccggaaaaaattgacttccccgggggaaggaaccccaacgcggctacgaataatttaattaaccctcccggttcatccaccaagtgcaccctcccaaacctcaggaataggcaccagtactcacccccccttgggggttcggccccaccgggggaggaggtttttgtttcacacgccccccatgcggggggccctgggggggcccttttaaagttcggcccccattgcgaccggggggcacacaaaagttagatccccaaaaggaagctgtcgactacgagg

SEQ ID NO: 33055 - DNA, 743 bp, Zea mays
  misc_feature: Ceres CLONE 1410554-F
  misc_feature: Encodes the peptide sequence at SEQ ID NO. 33056
  misc_feature (392)..(392): n is a, c, t, g, unknown, or other
  misc_feature (421)..(421): n is a, c, t, g, unknown, or other
  misc_feature (434)..(434): n is a, c, t, g, unknown, or other
  misc_feature (438)..(438): n is a, c, t, g, unknown, or other
  misc_feature (453)..(453): n is a, c, t, g, unknown, or other
  misc_feature (527)..(527): n is a, c, t, g, unknown, or other
  misc_feature (635)..(635): n is a, c, t, g, unknown, or other
  misc_feature (663)..(663): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccattacctagaacatcctaatcgaaaaaatcgatcagtcgcgtgtctaggtttcctctctcaccatagcgcccgctctgtcgcccttcgttcacctctccttcctctcctccctgcctgccagggagaggggaagtcagaggcacggagtggcgcagagcagacgcacgtgaaccattgtagctgtccctgtcgtcgtcgtcgtcgtcaacgaatccacacaaggaaaggatggagaagaagccgaccatcctcatgaacaggtacgagctcgggcgcacgctcgggcagggcaccttcgccaaggtgtaccacggncggaacctcgcgtccggcgagagcgtggncatcaagtcatcngacnaggagaaggtgatgncgcgtcgcatgatcgaccagatcaagcgcgagatctccgtcatgcgcctcgtcgccacccccaacgtcgtgagnctgcaacgaggtgatgggcagcaagagcaagaatcttcgccctgggaataagcccccgggggcggagagctctttcgccgcgtcgcccgggcggggttaaaggagagnccccgggagaggtacttccaccagtttnnggggggccgtcgattctgccaaaaagccgggggggctaccacggggacctcagccgagaacttccctcgtcgagagagg

SEQ ID NO: 33056 - protein, 90 aa, Zea mays
  misc_feature: Ceres CLONE 1410554-F
  misc_feature: SWISSPROT Homolog: EC 2.7.11.1 Non-specific serine/threonine protein kinase
  misc_feature (39)..(39): Xaa is any aa, unknown, or other
  misc_feature (45)..(45): Xaa is any aa, unknown, or other
  misc_feature (50)..(50): Xaa is any aa, unknown, or other
  misc_feature (74)..(74): Xaa is any aa, unknown, or other
MEKKPTILMNRYELGRTLGQGTFAKVYHGRNLASGESVXIKSSDXEKVMXRRMIDQIKREISVMRLVATPNVVXLQRGDGQQEQESSPWE

SEQ ID NO: 33057 - DNA, 814 bp, Zea mays
  misc_feature: Ceres CLONE 1410555-F
  misc_feature: Encodes the peptide sequence at SEQ ID NO. 33058
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (26)..(26): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (355)..(355): n is a, c, t, g, unknown, or other
  misc_feature (814)..(814): n is a, c, t, g, unknown, or other
tttgccccccnnnnnnnnnnnntctngtatggtttcctcctcnnnnnaaaaagtggggctccaccgcggtggcggccgctctagaatagtggatcccccgggctgcaggaattcgcacgagaccattacctagaacatcctaatcgaaaaagcaggagaagagagacgacacagcagctttttgggtttccccttccctttccccgcgcggtgatcgcagggttctccgcgagcgaggcaaagcactgcgcgtcctccgtgacttcctggtgatcgatgggggttctggacgttggtgtttcatttggttgtttggggggtggcagcagccgtggcgagatgaacctgatgatgnccgtgacggtgaaggagaaggggccccccggaagaaaaaaaactaacacttacttttccgcgaaaggaaaaagctcagggggcggagggaggggcatagaacgaaggccgcccccaccccctttcgccggcaaataccgtgtgaccccggggggtcctcaccagagagaaacaaaagagtgaaatcaacccggcgcccccgcgccccacccccggcttccttcattttatcgcctcgcgcaattgttgtctatctaaaaaggaaaaaaaaaacacccccgcccctctcatggtcagagaggggcggcagcgagcgcggaccggataccatcaaccccccgcgccccaccacgcaggagagaacgaagcgggagaggacgcagacggtggaacacgataaaacgcgtgacttctcgcgcccccattaccgtttcatttgcgtgtggagggggtggggggn

SEQ ID NO: 33058 - protein, 86 aa, Zea mays
  misc_feature: Ceres CLONE 1410555-F
  misc_feature (27)..(27): Xaa is any aa, unknown, or other
MGVLDVGVSFGCLGGGSSRGEMNLMMXVTVKEKGPPGRKKTNTYFSAKGKSSGGGGRGIERRPPPPPFAGKYRVTPGGPHQRETKE

SEQ ID NO: 33059 - DNA, 664 bp, Zea mays
  misc_feature: Ceres CLONE 1410557-F
  misc_feature (594)..(594): n is a, c, t, g, unknown, or other
aaagctggagctccccgcggtggcggccgctctagaactagtggatcccccgggctgcaggaattcgcacgagaccattacctagaacatcctaatcgaaaaacgacgcaattcccgtcttcccacgccgtatcgccgttgctatgggcaagaagcggaagctcgagcccaaatcggcggcagggttcacgccggttaaggcctccccgaccaccaggtctgccaccgctaaggccgctggtctatccgaggtcctcgcccccgtcgaggctacgatggagaagctgccgcagggggcaggcggcgaggatgtagaggaaatcgaggaggaggtggaggcgagagaaaaatgggaaagtggaaaaggaagaagaaggcgagagcgaccaggcttcgatccaggcgctgctggattcgttccccaaggaccagctcgtcgagctgttacgcgacgctgccatcgctcacggcgacgtgctaaccaccatccggcgcgtggccgacgccgacccggctcagcggaagatcttcgtacacggcctcggctgggacaccacaaccgaccccctcaccgaggccttcggcccatacggngagatagaggatctcaaggtcgtcaccgaccgcaacacggcaagtgcaagggggtacgggttcatcctct

SEQ ID NO: 33060 - DNA, 680 bp, Zea mays
  misc_feature: Ceres CLONE 1410558-F
  misc_feature (449)..(449): n is a, c, t, g, unknown, or other
  misc_feature (462)..(462): n is a, c, t, g, unknown, or other
  misc_feature (463)..(463): n is a, c, t, g, unknown, or other
  misc_feature (565)..(565): n is a, c, t, g, unknown, or other
  misc_feature (573)..(573): n is a, c, t, g, unknown, or other
  misc_feature (639)..(639): n is a, c, t, g, unknown, or other
tccccgcggtggcggccgctctagaactagtggatcccccgggctgcaggaattcgcacgagaccattacctagaacatcctaatcgaaaaagagcaaaagccaaactggcagccagcacagcagagcgccactcgactcgactcatcctttcggttcccctcccccctccgcgttccacaaccctcgagaagcttccaccctcccctcctgcgacgccgccagagccgcggaaaccctacccaccccggccgctcacgcaccgggcacccgccgccgccggtcgcgtacctgccgccgacaccgcccaaagcgattggatctagagatcgtcagtagccacgatggaggactgggattctgaagaaattccagccagttgcctgttgtgaaagccgagccacttaaaaatcagtgggctggatgaagatgttgaagaagatgatgtanaaagaatcatggnnaagaaagaggagggaggaggagaaacctaagccagcgccaggtggaaaaaggtcgctgcaaaacctagcactaaggctcctgctaaaaagggaaacagcagncattgacnaagtgctgaaagaaacagatggagcctcctcttagtcccacttcacagaaattcgcacaaagaaanttgggggaagaggctgacttcagtctacaccgagctttttg

SEQ ID NO: 33061 - DNA, 687 bp, Zea mays
  misc_feature: Ceres CLONE 1410559-F
  misc_feature (409)..(409): n is a, c, t, g, unknown, or other
  misc_feature (451)..(451): n is a, c, t, g, unknown, or other
  misc_feature (485)..(485): n is a, c, t, g, unknown, or other
aagctggagctcaccgcggtggcggccgctctagaactagtggatcccccgggctgcaggaattcgcacgagaccattacttagaacatcctaatcgaaaacaaagcctttcttcctcctgtgaagccaactcgtcccctcgggccaacgcgaggccaaaaccaatctcacatctcctccccctcccaccaccgaggacccttccccaagaactgctccgagtcctggagcgggagagaggtcgagggaggagcccaataagagtttctcctcgcctctctctctctctttctgctcgaaaaattattgtcgcattggtttggttcccttgccaaaggaggctgcttttctgtcctccctgatctaacatgatggcgagcaccgcatcagcgaccgccgccgccgccgncgtgggattcggggcagccgccaaagcgcggggaccgggggntggggcgctccgcgcaagggcgccggcccgcggnaagccgccccccggggggggggggccccacaaagcaccctaccccgccccctacaccccacgcgccacgcccaccccgtattccattatcaattaggaggtgctctaccaaagccgcccaagaaggagaggacgcaaaacaataccacacaccccactctctaaagcctcgtcaaccacacatccaggcgccctcatcaaac

SEQ ID NO: 33062 - DNA, 692 bp, Zea mays
  misc_feature: Ceres CLONE 1410560-F
  misc_feature: Encodes the peptide sequence at SEQ ID NO. 33063
  misc_feature (420)..(420): n is a, c, t, g, unknown, or other
aagctggagctccccgcggtggcggccgctctataactagtggatcccccgggctgcaggaattcgcacgagaccattacctagaacatcctaatcgaaaaacgccctccgtgccgtgcccactcctctccccgcagcttcgggcccctgccatgccgtcctcgtcgtcgctgatccatggcatctccatctccgtctccgacgacgacgaggccaccggcaaggtgcgcgtccgcgtccgccgcaagcgctcccgcggccccgcatccgcttcggcgcgccgccgccgcatcctcttccgcgccgcgcgggttgggcgtgccgctcctcctcgccgccctcgccgtgtgcctcctcctctacgagtcctaccgcctcacgccttcccgctcctccaactgcctccgccgtccttcgcgnacatcagccgcctctcccgcaacgcccgggccgccgatggcgccaggaagccatgcctgaagtttcttgatcctgagaagcttccaaatttggaacttccagaaattcctgaaacaaatttgccgatgaaggaagttctgtacagatcaagtctggcccataatcgcaagggaaccccaccacatacagagaaattcccggttcaacttggcccacaggaacacccacccccccccgaaccagaaaaaaaggtttcagggtaacctttttcg

SEQ ID NO: 33063 - protein, 176 aa, Zea mays
  misc_feature: Ceres CLONE 1410560-F
  misc_feature (90)..(90): Xaa is any aa, unknown, or other
MPSSSSLIHGISISVSDDDEATGKVRVRVRRKRSRGPASASARRRRILFRAARVGRAAPPRRPRRVPPPLRVLPPHAFPLLQLPPPSFAXISRLSRNARAADGARKPCLKFLDPEKLPNLELPEIPETNLPMKEVLYRSSLAHNRKGTPPHTEKFPVQLGPQEHPPPPEPEKKVSG

SEQ ID NO: 33064 - DNA, 801 bp, Zea mays
  misc_feature: Ceres CLONE 1410564-F
  misc_feature: Encodes the peptide sequence at SEQ ID NO. 33065
  misc_feature (13)..(13): n is a, c, t, g, unknown, or other
  misc_feature (15)..(15): n is a, c, t, g, unknown, or other
  misc_feature (23)..(23): n is a, c, t, g, unknown, or other
  misc_feature (31)..(31): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
ttttccccccccntnttctcctntctctttnttgttnngggtttnnnnnnccaagctggtgctccccgcggtggcggccgctctataactagtggatcccccgggctgcaggaattcgcacgagaccattacctagaacatcctaatcgaaaaacctcatggctcacgcgaataccacacccacaccacaccacacctcacggcgtccattcattcccgtctcgtcttccgctgcttgcctccaactccccccgcgtcgtctcgtgcttcccaatcaccatagagccggttgatccccaaaggcccatggttttctccgacgccgcgtcgcctctcgtagccaccgccgctgactctgcttcctcctgcgtcgcccacctcccctgctgctgtcgcgttagttggttgccgttgttgttgaacacgcgtaagctccgagggttcgtgatttctccgccggatctggttcgggaaactggtaagattatggcatctctcgccggccgcgaatcgttagaactcctagctacgggcatgaactcctcatgcaccaccgcccacgactaggggtgatatgccggcaacccccagcccgctagtcccctcctccaactgcccccacagccgggatagaactcgggggccagggggagcccggacccgaatgtccggataagaccacctacggcggtacttaactcctgcaccagtggattcctacctataaccccccctcctgcgcactccgcgacgccacaagcaacagccagatcagtacaactctccccgcgtcccccggct

SEQ ID NO: 33065 - protein, 86 aa, Zea mays
  misc_feature: Ceres CLONE 1410564-F
MVFSDAASPLVATAADSASSCVAHLPCCCRVSWLPLLLNTRKLRGFVISPPDLVRETGKIMASLAGRESLELLATGMNSSCTTAHD

SEQ ID NO: 33066 - DNA, 745 bp, Zea mays
  misc_feature: Ceres CLONE 1410565-F
  misc_feature: Encodes the peptide sequence at SEQ ID NO. 33067
  misc_feature (274)..(274): n is a, c, t, g, unknown, or other
  misc_feature (333)..(333): n is a, c, t, g, unknown, or other
  misc_feature (345)..(345): n is a, c, t, g, unknown, or other
  misc_feature (386)..(386): n is a, c, t, g, unknown, or other
  misc_feature (394)..(394): n is a, c, t, g, unknown, or other
  misc_feature (395)..(395): n is a, c, t, g, unknown, or other
  misc_feature (413)..(413): n is a, c, t, g, unknown, or other
  misc_feature (414)..(414): n is a, c, t, g, unknown, or other
  misc_feature (660)..(660): n is a, c, t, g, unknown, or other
  misc_feature (712)..(712): n is a, c, t, g, unknown, or other
tggagctccccgcggtggcggccgctctagaactagtggatcccccgggctgcaggaattcgcacgagaccattacctagaacatcctaatcgaaaaatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgccgcngtgtgccagcacgaccggcgtggagattatcgtcaacgaccagcgcgaccgcaccacgncgtgcctatgtncggcttcaccgacaccgagcggctcatcggcgacgctgccnagaaccanngtcgcatgaaaccccacnnacaccgtctcgatggcaagcggttgatccggcaggaggttctctggatccgtccccgcagagtgaatgaccctttcgccccgctcacggcatcctccgggcctgttgaaagccccatggattggaacgactaacagcgggcgccccaaaacagttggtcggttggaggaaacccccccccggcgccccaacaaaggggggaggtgtgttggggagtgcctccctggtgtccccaaaaaaaacttantggttttgttgtgtttgcgctttaatttttggtgttcggtggggggtggccnaatatatggactaggggaatttataaaaaccac

SEQ ID NO: 33067 - protein, 111 aa, Zea mays
  misc_feature: Ceres CLONE 1410565-F
  misc_feature (41)..(41): Xaa is any aa, unknown, or other
  misc_feature (45)..(45): Xaa is any aa, unknown, or other
  misc_feature (59)..(59): Xaa is any aa, unknown, or other
  misc_feature (61)..(61): Xaa is any aa, unknown, or other
  misc_feature (62)..(62): Xaa is any aa, unknown, or other
  misc_feature (68)..(68): Xaa is any aa, unknown, or other
MAKSEGPAIGIDLGTTYSCAAVCQHDRRGDYRQRPARPHHXVPMXGFTDTERLIGDAAXNXXRMKPHXHRLDGKRLIRQEVLWIRPRRVNDPFAPLTASSGPVESPMDWND

SEQ ID NO: 33068 - DNA, 689 bp, Zea mays
  misc_feature: Ceres CLONE 1410568-F
  misc_feature: Encodes the peptide sequence at SEQ ID NO. 33069
  misc_feature (519)..(519): n is a, c, t, g, unknown, or other
ggagctccccgcggtggcggccgctctagtactagtggatcccccgggctgcaggaattcgcacgagaccattacctagaacatcctaatcgaaaaaccaacaagtgcagtcacccgagccgcaaactgcagctctgcaagctacagaggccaccacgagtccacgacgccacgccctccgagagaaagagaaagagaaaaccaaagcacgataatgcccccgacccccacagccgccgcagccggcgccgccgtggcggcggcatcagcagcggagcaggcggcgttccgcctcgtgggccaccgcaacttcgtccgcttcaacccgcgctccgaccgcttccacacgctcgcgttccaccacgtggagctctggtgcgccgacgcggcctccgccgcgggccgcttctccttcggcctgggcgcgccgctcgccgcacgctccgacctctccacgggcaactccgcgcacgcgtccctgctgctccgctccggctccctctccttcctcttcacggngccctacgcgcacggcgccgacgctgccaccgccgcgctgccctccttctccgccgccgccgcgaggagtcttcaaaacggacaactgccgcacgggctccacagtatggctccaccggcttttactttaaatacgcccatccgcaaacatcgtccggggacaggctacc

SEQ ID NO: 33069 - protein, 158 aa, Zea mays
  misc_feature: Ceres CLONE 1410568-F
  misc_feature: SWISSPROT Homolog: EC 1.13.11.27 4-hydroxyphenylpyruvate dioxygenase
  misc_feature (102)..(102): Xaa is any aa, unknown, or other
MPPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTXPYAHGADAATAALPSFSAAAARSLQNGQLPHGLHSMAPPAFTLNTPIRKHRPGTGY

SEQ ID NO: 33070 - DNA, 752 bp, Zea mays
  misc_feature: Ceres CLONE 1410569-F
  misc_feature: Encodes the peptide sequence at SEQ ID NO. 33071
  misc_feature (433)..(433): n is a, c, t, g, unknown, or other
  misc_feature (456)..(456): n is a, c, t, g, unknown, or other
  misc_feature (544)..(544): n is a, c, t, g, unknown, or other
  misc_feature (646)..(646): n is a, c, t, g, unknown, or other
  misc_feature (647)..(647): n is a, c, t, g, unknown, or other
  misc_feature (676)..(676): n is a, c, t, g, unknown, or other
aaagctggagctccccgcggtggcggccgctctagaactagtggatcccccgggcttgcaggaattcgcacgagaccatttaacctaaaacattcctaaatcgaaaagccgcttccaaatcccaataataccattcgcgtaaatccagaatatcagggcagttggaactgaaggtggcgggagccgagtgatccggcggtgagctgagcggggcgggatggcggcggagcaggggcggtcgctggcggagacgcccacctggtccgtggcaaccgtcaccacgctcatggtcgctgcctgcttcctcgtcgagcgctccctctcgcgcttcgccaagtggctgcgcaagaccaagcggaaggccatgctcgccgcgctcgagaagatccgcgaagagctgatgctgctcggagtcatctcgctgctgctcagncagacggcgcgcttcatatcggnagatctgcgtgccgtcctcgctcttcaccagccgcttctacatctgctccgagagcgactaccaggacctgctgcgcaacacggacgncaaccagacgggctcgacagaaaaaattggttcgtggcaacggctggacttttggggggggaggccatgaaaccttttgtttcccaacaagggcctgagaanngtgcaccggttctcttcatctgaatcaanccagggggggaaagatttttaaaaaaaggggggtttcgcccaggaaaaaatttaaggggggggggggtgggaaaca

SEQ ID NO: 33071 - protein, 150 aa, Zea mays
  misc_feature: Ceres CLONE 1410569-F
  misc_feature (72)..(72): Xaa is any aa, unknown, or other
  misc_feature (80)..(80): Xaa is any aa, unknown, or other
  misc_feature (143)..(143): Xaa is any aa, unknown, or other
  misc_feature (144)..(144): Xaa is any aa, unknown, or other
MAAEQGRSLAETPTWSVATVTTLMVAACFLVERSLSRFAKWLRKTKRKAMLAALEKIREELMLLGVISLLLXQTARFISXDLRAVLALHQPLLHLLRERLPGPAAQHGRQPDGLDRKNWFVATAGLLGGEAMKPFVSQQGPEXXAPVLFI

SEQ ID NO: 33072 - DNA, 717 bp, Zea mays
  misc_feature: Ceres CLONE 1410571-F
  misc_feature: Encodes the peptide sequence at SEQ ID NO. 33073
  misc_feature (299)..(299): n is a, c, t, g, unknown, or other
  misc_feature (401)..(401): n is a, c, t, g, unknown, or other
  misc_feature (508)..(508): n is a, c, t, g, unknown, or other
  misc_feature (717)..(717): n is a, c, t, g, unknown, or other
aaagctggagctccccgcggtggcggccgctctagaactagtggatcccccgggctgcaggaattcgcacgagaccattacctagaacatcctaatcaaaaaacatatccccactctagccaagtagtcagtcctctccaatctccactctcctctcgcaccaccaaaaaaccggtcccaccgttcgccatgagctccgaagccggatgctcagctccagccgccgccgcgccggatggggcgggtggcggcagggtggagatcgacacgtccgcgccgttcgagtccgtgcgggaggncgtcgaccgtttcggtggcagcgccgcctggagctccgacctcgtcaggcgcatgttcgcgccctccaagaaacatgaacactctgaccaagctgcaaaggncatcaacgccgaggagcaagctgcacagctagagaacgagctggcagttaaagaaagggagactcttgatgtgctcaaggagctggaggcaaccaagaagatcatancaaacctgaaactgaagatacgggaagaagccactgaaacatcccctgaagaggctgctgaccagggtttctggaggcggagctcaacagcagaaacctgaaaacaccacctttgatgtgggggtgggacatggaaggtggaaaaggaaacccatccagggtcggtttccgggggatctcaaggaggggaagggaaccttggaaaaagn

SEQ ID NO: 33073 - protein, 139 aa, Zea mays
  misc_feature: Ceres CLONE 1410571-F
  misc_feature (37)..(37): Xaa is any aa, unknown, or other
  misc_feature (71)..(71): Xaa is any aa, unknown, or other
  misc_feature (107)..(107): Xaa is any aa, unknown, or other
MSSEAGCSAPAAAAPDGAGGGRVEIDTSAPFESVREXVDRFGGSAAWSSDLVRRMFAPSKKHEHSDQAAKXINAEEQAAQLENELAVKERETLDVLKELEATKKIIXNLKLKIREEATETSPEEAADQGFWRRSSTAET

SEQ ID NO: 33074 - DNA, 688 bp, Zea mays
  misc_feature: Ceres CLONE 1410572-F
  misc_feature: Encodes the peptide sequence at SEQ ID NO. 33075
  misc_feature (253)..(253): n is a, c, t, g, unknown, or other
  misc_feature (266)..(266): n is a, c, t, g, unknown, or other
  misc_feature (335)..(335): n is a, c, t, g, unknown, or other
  misc_feature (378)..(378): n is a, c, t, g, unknown, or other
  misc_feature (382)..(382): n is a, c, t, g, unknown, or other
  misc_feature (383)..(383): n is a, c, t, g, unknown, or other
  misc_feature (387)..(387): n is a, c, t, g, unknown, or other
  misc_feature (389)..(389): n is a, c, t, g, unknown, or other
  misc_feature (390)..(390): n is a, c, t, g, unknown, or other
  misc_feature (393)..(393): n is a, c, t, g, unknown, or other
  misc_feature (395)..(395): n is a, c, t, g, unknown, or other
  misc_feature (651)..(651): n is a, c, t, g, unknown, or other
  misc_feature (679)..(679): n is a, c, t, g, unknown, or other
tccccgcggtggcggccgctctagaactagtggatcccccgggctgcaggaattcgcacgagaccattacctagaacatcctaatcgaaaactctattagaatagccaggggcctcgctcctctccaccacgtactccactccatccatccatcatcgtctatccatgaagagcttgcaggaggagagggcggcgttggtgccgtcgccgtggccccagcaacagagaaaggacggcggcgagcatgatccgnagcagctgatggnatgagatgacggtgacgatgagggagatctggcagatgagcagcacacagacaattaggacgtcgaccnagacgggcggagcatcgtatcacggaaccggcggtggcccccntggnngaancnnccncnggcccaaaaactggggcccacaaagggggggggcgggccaccccgggcccccccgggggggttttggcccccccccccgggggggggaaaaccacagcgggggggtggggccccccccaaaaggacgggtttttaaaaaaagaaggggcgccgcggctttataaaaaaaaaagaggcctccccccacgtttcttctgccgggggggggcgcggcccaatccctgtggcgggggggactaactgccgccgccccggnaaacaaaaaacatcccaccctcctcggncgcatgata

SEQ ID NO: 33075 - protein, 33 aa, Zea mays
  misc_feature: Ceres CLONE 1410572-F
  misc_feature (30)..(30): Xaa is any aa, unknown, or other
MKSLQEERAALVPSPWPQQQRKDGGEHDPXQLM

SEQ ID NO: 33076 - DNA, 709 bp, Zea mays
  misc_feature: Ceres CLONE 1410573-F
  misc_feature: Encodes the peptide sequence at SEQ ID NO. 33077
  misc_feature (382)..(382): n is a, c, t, g, unknown, or other
  misc_feature (383)..(383): n is a, c, t, g, unknown, or other
  misc_feature (434)..(434): n is a, c, t, g, unknown, or other
  misc_feature (477)..(477): n is a, c, t, g, unknown, or other
  misc_feature (486)..(486): n is a, c, t, g, unknown, or other
aagctggagctccccgcggtggcggccgctctagaactagtggatcccccgggctgcaggaattcgcacgagaccattacctagaacatcctaatcgaaaaaaccttcgcctctcctcccgttgtcagccgccgtgcctgttctctctgcctttctaaaagtgcggcgactggttgggctgccgccgactgccggggccttcgccgacctcttcgccggcgaagaggtcccatcaggagaaggagtagatcgtcgacccagaaccctcgctgatggcgactttcgcgaaacctgagaacgcgctgaagagagccgaagaattaatccatgttggtcaaaagcagtcagccctgcaggctttacatgatctcattacctcgannaggtacaggtcatggcagaagcctctcgaaagatcatgatgaagtatgtanaactctgtgttgaccctgagaaagcagatttgcaaaagatggncttattcantataaggatgggctgccagcaaggaaacgggccatcttttggagaatggctaaaagcctctcggggccgttttcaaaggaaaaacttgaaaagctaaaaggccggcccaaaccccggaaaaaggttttgggatttccaaaaaattgtaaaaaaaaaaaggtccccgagacccttgtggtttttttttttttggggggaaaaaacaaaccccccctcccatgtg

SEQ ID NO: 33077 - protein, 49 aa, Zea mays
  misc_feature: Ceres CLONE 1410573-F
  misc_feature (37)..(37): Xaa is any aa, unknown, or other
MATFAKPENALKRAEELIHVGQKQSALQALHDLITSXRYRSWQKPLERS

SEQ ID NO: 33078 - DNA, 796 bp, Zea mays
  misc_feature: Ceres CLONE 1410575-F
  misc_feature (23)..(23): n is a, c, t, g, unknown, or other
ggccccccccccccccccccccnatacggaaggtggaacaccccgcccacgacgatgaggctccccgcggtggcggccgctctagaactagtggatcccccgggctgcaggaattcgcacgagaccattacctagaacatcctaatcgaaaaaaaatccgacaaaccgctctctccctctcgcctcccgcccctaattcccatcccccacctccaaatcccacatcactcaaaaccctcgccgcgcccctgctgcgcgcccccccgatggcagccgtcgcgtcctcggaggaggccgtcaaggcggcgaaggtgctgatggccgaagccgtgagccatcggctgtgaactgctcaagacgctcgctctctccggattcagcgacataacacatcattgatttgcatataattgaaggtagcaatctgaaaagacagtctcttgtttcgacagagccatgttgggcaatcccaagctaaagttgctcgggatgccgcggttgaaatttaaggccaaatatcaatataaccccctaccatgggaacggggaaggaattcccatttccgagggcggatttttttcaagaaaatttaaagggttgtcctggacagggccttaaaaaacctttgcgatgccacaaacgccagtgttaaacccgccttttccccttggctgctagaaagcccccttttcggttcggaaagatggaaacaccacccgggtacttttttgggaaaaaacggatttaacccgggtcacaggcaaccaggggggccaaaacaccgacacaccccat

SEQ ID NO: 33079 - DNA, 777 bp, Zea mays
  misc_feature: Ceres CLONE 1410577-F
  misc_feature: Encodes the peptide sequence at SEQ ID NO. 33080
  misc_feature (55)..(55): n is a, c, t, g, unknown, or other
  misc_feature (365)..(365): n is a, c, t, g, unknown, or other
  misc_feature (372)..(372): n is a, c, t, g, unknown, or other
caaagctggagctccccgcggtggcggccgctctagaactagtggatcccccggngctgcaggaattcgcacgagacccattacctagaacatcctaatcgaaaagtcctcttctagtcgcctctacccagttacttgcatcgccccgtcaagcacgccgccggcacgcggccctcggtctccccgccgcgccctctgcctccgcccgaacaaagccgtctcgccgtcgtgttgccttccttaccgtccaccgcgggcagccgtcctagtactcggttggtcctcccctgctgcccttctacggtggaggagcggagatcctgccgttttccggctgatttcttctaattgcggggcaagtccgncgatagncaatactggcttgtgctggtgagctaatattaggttcctgctgggaagaacttcttgcagtttcctattgcaaagcctctcaatggcaaggggccgtaacttggcaaaatcaaatgggggaagggggtccaaatttccgccaaatgaaggggccatgctggggaaaaccgggttgggaaccccttccccaaagggaaaaataaccaggtttccctttcccttggaaagattctccctatatttagaaaaaggggaatttgggacaaaaacccaaaattttggaaccaaggggtggggccctcaaaaaatataaaaaaaaaaaatttgaatctcacccgggggaaatcccgcaaatttttgtccccaccccccaagaggggggggagaaatcccccccggtgtttt

SEQ ID NO: 33080 - protein, 76 aa, Zea mays
  misc_feature: Ceres CLONE 1410577-F
MARGRNLAKSNGGRGSKFPPNEGAMLGKTGLGTPSPKGKITRFPFPLERFSLYLEKGEFGTKTQNFGTKGWGPQKI

SEQ ID NO: 33081 - DNA, 648 bp, Zea mays
  misc_feature: Ceres CLONE 1410578-F
  misc_feature: Encodes the peptide sequence at SEQ ID NO. 33082
  misc_feature (327)..(327): n is a, c, t, g, unknown, or other
  misc_feature (337)..(337): n is a, c, t, g, unknown, or other
  misc_feature (340)..(340): n is a, c, t, g, unknown, or other
  misc_feature (366)..(366): n is a, c, t, g, unknown, or other
  misc_feature (408)..(408): n is a, c, t, g, unknown, or other
  misc_feature (409)..(409): n is a, c, t, g, unknown, or other
tccccgcggtggcggccgctctagaactagtggatcccccgggctgcaggaattcgcacgagaccattacctagaacatcctaatcgaaaagatttcgaggtcggttttctgttgcacagggagaaaggtcacgtccaaccgccgcgaactgcgcatgtgaactgtgcccgacgaggcgcgcggcacgggtgaggggagctgcgccggagccccaggcctagggttttcaccgccctgccgcgagatggacgtccgggacctgcaccagcagccgcagcatcagcagcagcaggcgcccgccgcgcgtgggatcccccgccgcaggncggccgccgncgntgtcatgatgcagcatacccgcgcgntcgggctcggcggcgccgccgccggcccgggttgccgcaggnncctcgcggccaacgttatggaaggggatgtccccttgcctttaaaccctaatggcttccgcccggaggccttcggccccccaataaacaggatggaaaaattgggggacttggccgttgggggtctaaggtacccgcccctggattcccgggggggaggggttttggaaaaaaaaaaaacccgggctccggggggggttggggcccccggggggggggttttccccgccccccaggggg

SEQ ID NO: 33082 - protein, 134 aa, Zea mays
  misc_feature: Ceres CLONE 1410578-F
  misc_feature (28)..(28): Xaa is any aa, unknown, or other
  misc_feature (31)..(31): Xaa is any aa, unknown, or other
  misc_feature (32)..(32): Xaa is any aa, unknown, or other
  misc_feature (41)..(41): Xaa is any aa, unknown, or other
  misc_feature (55)..(55): Xaa is any aa, unknown, or other
MDVRDLHQQPQHQQQQAPAARGIPRRRXAAXXVMMQHTRAXGLGGAAAGPGCRRXLAANVMEGDVPLPLNPNGFRPEAFGPPINRMEKLGDLAVGGLRYPPLDSRGGGVLEKKKTRAPGGVGAPGGGVFPAPQG

SEQ ID NO: 33083 - DNA, 699 bp, Zea mays
  misc_feature: Ceres CLONE 1410581-F
  misc_feature: Translation starting site: 163
  misc_feature (94)..(94): n is a, c, t, g, unknown, or other
  misc_feature (95)..(95): n is a, c, t, g, unknown, or other
  misc_feature (104)..(104): n is a, c, t, g, unknown, or other
  misc_feature (108)..(108): n is a, c, t, g, unknown, or other
  misc_feature (239)..(239): n is a, c, t, g, unknown, or other
  misc_feature (243)..(243): n is a, c, t, g, unknown, or other
  misc_feature (256)..(256): n is a, c, t, g, unknown, or other
  misc_feature (298)..(298): n is a, c, t, g, unknown, or other
  misc_feature (399)..(399): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (546)..(546): n is a, c, t, g, unknown, or other
  misc_feature (547)..(547): n is a, c, t, g, unknown, or other
  misc_feature (549)..(549): n is a, c, t, g, unknown, or other
  misc_feature (604)..(604): n is a, c, t, g, unknown, or other
  misc_feature (606)..(606): n is a, c, t, g, unknown, or other
  misc_feature (621)..(621): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (657)..(657): n is a, c, t, g, unknown, or other
  misc_feature (658)..(658): n is a, c, t, g, unknown, or other
  misc_feature (664)..(664): n is a, c, t, g, unknown, or other
  misc_feature (665)..(665): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
aagctggagctccccgcggtggcggccgctctagaactagtggatcccccgggctgcaggaattcgcacgagaccattacctaacatcctaatnncgaaaaaancaancttccgtccactcaccccctctttgctctgcctcgccgcgccgcagagcagagcatggcgcccccacgccctctcctcgccgccgtcttcctcgccgcggcggttctgctcctcctttctccggcagaggncggngacggtgggcgtngactacggccgcgtggcgaacacctgccacccccagcgcggntgtgcagctgctcaagcagcagggcgtcgcgcaggtgaagctgtacgacgccgaccccacgtgctgcgcgcctcgcgaacacggatcagggtggggggggncctccccacgacaaggtcccggggggggggccccggggcccaacgggggggggggggggccccgacccgggnnnnnaacacaccggacacaaaaaggggggaaccccgggggaaaaaagggggccccaccgcaaaaaaagaggcggnnangggcccccaaaacgggaaaaaaaacgcgcgggggggaggaaaccgggggcggggngnaaaaaaggaaaaaanannnacaaaannnnncacaccgannnnggcgcgggnncgcaannaaaaggcacccaaaannnnaaaacnnnaaggggg

SEQ ID NO: 33084 - DNA, 764 bp, Zea mays
  misc_feature: Ceres CLONE 1410583-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
nnnaaaannnnnaaaannnnnnnnccaaatccnnnnnncaaccttnnnnnnncccaaagctgggactccccgcggtggcggccgctctagaactagtggatcccccgggctgcaggaattcgcacgagaccattacctagaacatcctaatcgaaaagtgagacgactgacgagtgaggcctgacgaggcgaaaacctcgctgactcgccctgccgccgccccgccccgcccgtgcgttctccgccgtcgtccccggaaggtttttgcctcagggcatgcggatctgctactccacctgctgcaagcaaggatagctataggtgtgaccagcgcacaagtatgaatccttactttgtgtgggattcttgtcccccgtcgtggtctccctgctgctccgcaagaggagaaaggcccaaaggatgaggggagtgccagctgcggttggtggggagcctggatgatgcaggccgcaactatcggtttgaacaacctggtgagacacactgggaggcgctgcccaccctgggtggtctgtttgaacaatcttgcaaagagtatgtatacatgccactccttggaaccagggagggtccttttcaagggaaaagtggagctggaacctggggggcagacccctttgagaaatgtgcatcctggacccaggaatgaatggaaaaatggcaatggcgcattcgccttccaagaaagcgaattgcgcgaaatttttcaatcctgggacctaaattaaaacgaaaggggccac

SEQ ID NO: 33085 - DNA, 777 bp, Zea mays
  misc_feature: Ceres CLONE 1410589-F
  misc_feature: Encodes the peptide sequence at SEQ ID NO. 33086
  misc_feature (333)..(333): n is a, c, t, g, unknown, or other
  misc_feature (677)..(677): n is a, c, t, g, unknown, or other
  misc_feature (715)..(715): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (747)..(747): n is a, c, t, g, unknown, or other
  misc_feature (748)..(748): n is a, c, t, g, unknown, or other
ctggagctccccgcggtggcggccgcttctagaacttagtggatcccccgggctgcaggaattcgcacgagaccattacctaagaacattcctaatcgaaaaaaaatagcaatttttccccctgggagcccgagacgcagcgcgaggtgcggccccgtcccctcgccaccggaggagcaggacgacgaggtggcgtcggcgcgaggtagtcgcgcgcctgggagagcggcggcatcggagtcgcaggcggaggcgaggaagtgaggggagagccctatagccaccgccgcggggcgtcgtgctcgctgcacgcactccccacatttttgtccnactcaaagctcaaactcgggctggtcggttggggacgacccctcccctagaatcccaagcttctaattggaaaaacagggaatgggaaaaaaaccgggaaaacaaattgggcccggaccccaaaaaaatcccgaaaccccccccccccccgggggagttcgatttttttaaaccccccctccccccgaaagaaaacccctgggggggggggccccccaaaaaaaggggaaatattctcctcttcccccccccccccccccaaaaaaaaaagcggggggggggaaaaacccccaaaaaaaaccccccgcgggggaaaaaaacgcgccgaaaaaaaaggccccccncggggttttttttccgcgcccccccccccccccctctnaaaaagaaaaaaggggggggggnnnnnggggnncccaaaatatcttttttgtggggtggggg

SEQ ID NO: 33086 - protein, 35 aa, Zea mays
  misc_feature: Ceres CLONE 1410589-F
WSSPRWRPLLELSGSPGLQEFARDHYLRTFLIEKK

SEQ ID NO: 33087 - DNA, 657 bp, Zea mays
  misc_feature: Ceres CLONE 1410593-F
  misc_feature: Translation starting site: 119
  misc_feature: SWISSPROT Homolog: EC 2.3.1.92 Sinapoylglucose--malate O-sinapoyltransferase
ggagctccccgcggtggcggccgctctagaactagtggatcccccgggctgcaggaattcgcacgagaccattacctagaacatcctaatcgaaaaatctctctcgctttctctagccatgacgctggtgaggatgccttgccgcctctgctgcttcctgctcgtcgtcgccgcctccgccgtctccgggcgggggcgggtggtcaccaccctcccgggctacgagggccgcctccccttccacctcgaaacagggtatgtggaggtggacgaggacgccggcgcggagctcttctactacttcgtccgggccgagtccggcgccgacgacagcgacaccccgttcgtcctccggatccccggcggccaacgctgctcctccttcagcggcctcgcctacgagataggtcccatcatggtttgtcgtggagccctacaacggcagcttgccgcgcctgcgctacaacccaaactcgtgggacaaaggtggcgcataattctttttgtggattcaccagttgggggcccgggttttccttctccagagatgccaaaggttacaccggctggagcggtatcaaccacgatgaacctttggcgaagttcctccaccaagtggttcaatgaccatccccgagtaccatgcaaatccttttc

SEQ ID NO: 33088 - DNA, 750 bp, Zea mays
  misc_feature: Ceres CLONE 1410595-F
  misc_feature: Encodes the peptide sequence at SEQ ID NO. 33089
  misc_feature (367)..(367): n is a, c, t, g, unknown, or other
  misc_feature (368)..(368): n is a, c, t, g, unknown, or other
  misc_feature (568)..(568): n is a, c, t, g, unknown, or other
  misc_feature (569)..(569): n is a, c, t, g, unknown, or other
  misc_feature (675)..(675): n is a, c, t, g, unknown, or other
  misc_feature (694)..(694): n is a, c, t, g, unknown, or other
  misc_feature (702)..(702): n is a, c, t, g, unknown, or other
  misc_feature (715)..(715): n is a, c, t, g, unknown, or other
  misc_feature (739)..(739): n is a, c, t, g, unknown, or other
  misc_feature (740)..(740): n is a, c, t, g, unknown, or other
aagctggagctccccgcggtggcggccgctctagaactagtggatcccccgggctgcaggaattcgcacgagaccattacctagaacatcctaatcgaaaaaacaacagcgaacacatctgcttcgcatttcttcccatcccccttcgcaacccaaaccccaactcgctccgcatcgatggcccccaaggccgagaagaagcccgcggcgaagaagccggcggaggaggagcccgcggctgagaaggcgcccgccgggaagaagccgaaggcggagaagcgggtccccgctggcaagtccgctgccaaggagggcggcgagggcaagaggggcaggaagaaaggcaagaagagcgtggagacctacnnagatctacatcttcaggtgctgaagcaggtgcacccggacattggcatctccctcaaggcagtgaggatgtctctggaccccagaaagaagggcatttaatatatacatttgaaattacagagggcagaggatcatgaaaaaaaaaatgtcaagattggtctagatatcgagaatgcaaaatgcagcatatgcctgaatnntgtggcatgaatggtggtactgttgctccatgcctgcacactctgggaatgatggttcccagaggggggtaaaaggagtcttccatctatttcacgtgataaaagncagagcgctgcatgcccancagggtangacacaggtcaanttccagtggaagggatcaccctgnnaaaaaatatg

SEQ ID NO: 33089 - protein, 96 aa, Zea mays
  misc_feature: Ceres CLONE 1410595-F
  misc_feature (64)..(64): Xaa is any aa, unknown, or other
MAPKAEKKPAAKKPAEEEPAAEKAPAGKKPKAEKRVPAGKSAAKEGGEGKRGRKKGKKSVETYXDLHLQVLKQVHPDIGISLKAVRMSLDPRKKGI

SEQ ID NO: 33090 - DNA, 730 bp, Zea mays
  misc_feature: Ceres CLONE 1410597-F
  misc_feature: Translation starting site: 538
  misc_feature: SWISSPROT Homolog: EC 3.2.1.4 Cellulase
  misc_feature (562)..(562): n is a, c, t, g, unknown, or other
  misc_feature (563)..(563): n is a, c, t, g, unknown, or other
  misc_feature (620)..(620): n is a, c, t, g, unknown, or other
  misc_feature (630)..(630): n is a, c, t, g, unknown, or other
  misc_feature (631)..(631): n is a, c, t, g, unknown, or other
tggagctccccgcggtggcggccgctctagaactagtggatcccccgggctgcaggaattcgcacgagaccattacctagaacatcctaatcgaaaaagtttcgacagtcgtcgtcccctctactctcccggcttccgcagaatcccagcttctctggccctctcactccaaacatcgggctccaggccgtctcccgccaacccaaattcgcttcccgccgctccccattaaacccgcttgaaaggtcgcgccctcgagcagagcaacccctgaccacaaatccgatccgtagccgccgtgcctcgatttcgtctcttcccctctgctcgagtacgagcggctactcccggcggcggcggcggcggcggcgatgagcgcggtgagctcgaccatatcaaggagctgatcaagtggggaacagactacatcctcaaacctttcattcatctgctgacacgatagacaggattgtcgctcaggtgggtgtaggtgacacctctaaaagcagcagtcagcctaatgaccattactgctggatgagaccagaggacatcgactacnnaaggcaggccaccgagtgtcactcctgctcaaatctagcgtctgaaatggctgctgncctggctganntttcattagggttcaaagacagcaaacctactccgacagctcgtcaagcgcaaggccctggaaaaaagttcggaaggctgcagcgcggcgaacaggccc

SEQ ID NO: 33091 - DNA, 586 bp, Zea mays
  misc_feature: Ceres CLONE 1410601-F
  misc_feature: Encodes the peptide sequence at SEQ ID NO. 33092
gctctagaactagtggatcccccgggctgcaggaattcgcacgagaccattacctagaacatcctaatcgaaaaatcttcctgctcaacatcagtagcagctttagctgtagcagcgccaccggccaccgccacgccatggccaccacgttgcacaagccccttggggcgatcaccgttgacgacctcgccgcggcggcgcctgggtcggacgccaccgcgctccacgcagcgctccggcgcgcgctcgactcgcacggacccaccgaagtgtggggcgagctctgccggtccgtgctctgtccgtctgtcccctttcgccgtcaccggatgctctactacggttgcttcgccgggttccggtccccacgccggcgggctggacgcccgacccaaggagtttgtcttgaccatgtcgggcgtgtctccaagcgcgtggaaagaaatttgatcggggaccggtaaaagaatccattacccaggttcccaaactccacaagtttttccaacaaaaacccagaggggtactgggaaaaggggattttggaggatatggggaattcacaattcaggggaaaaccccttct

SEQ ID NO: 33092 - protein, 108 aa, Zea mays
  misc_feature: Ceres CLONE 1410601-F
MATTLHKPLGAITVDDLAAAAPGSDATALHAALRRALDSHGPTEVWGELCRSVLCPSVPFRRHRMLYYGCFAGFRSPRRRAGRPTQGVCLDHVGRVSKRVERNLIGDR

SEQ ID NO: 33093 - DNA, 804 bp, Zea mays
  misc_feature: Ceres CLONE 1410602-F
  misc_feature: Encodes the peptide sequence at SEQ ID NO. 33094
  misc_feature (16)..(16): n is a, c, t, g, unknown, or other
  misc_feature (17)..(17): n is a, c, t, g, unknown, or other
  misc_feature (28)..(28): n is a, c, t, g, unknown, or other
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
cccccccccccccccnncccccccccgnaanntntttaagcccaccgcaaaagtggagctccccgcggtggcggccgctctagaactagtgaatcccccgggctgcaggaattcgcacgagaccattacctagaacatcctaatcgaaaatctctcttcctccttccacaagcgccgccgcagccccttctcgatctttgaggcaaagctacgactccaccaccgctggcatggcgttcgagaagatcaaggtctccaacccaatcgtcgagatggacggtgatgagatgaccagagtattctggcagtctatcaaggacaagcttatctttccatttctggacctggacatcaagtactatgacttggggatactgcaccgtgacgcaactgatgacaaggtcacagtggaggctgcagaggctactctcaagtacaatgtggccattaagtgtgcgaccattactccagatgaaactaagggttaaggagttcaatttgaagcacatgtggaagagcccaaatggcacaattaggaacattataaaatgggaactgtgttccagagaaccaattatattgcaaaaacgtctccaagggcttggttccaaggactggacgaaaccccatctcggcaatttggaaagtcatggccctttcccgcgattcagaaaccgaggccaaactgagatggcaggatccttagaaagggcggctcgcggggaaagccacgaagaggacaaaggttcgattaggaggagagacaataacaagatagaccgcatgcggagacacgcgggggga

SEQ ID NO: 33094 - protein, 85 aa, Zea mays
  misc_feature: Ceres CLONE 1410602-F
  misc_feature: SWISSPROT Homolog: EC 1.1.1.42 Isocitrate dehydrogenase (NADP(+))
MAFEKIKVSNPIVEMDGDEMTRVFWQSIKDKLIFPFLDLDIKYYDLGILHRDATDDKVTVEAAEATLKYNVAIKCATITPDETKG

SEQ ID NO: 33095 - DNA, 705 bp, Zea mays
  misc_feature: Ceres CLONE 1410603-F
  misc_feature: Encodes the peptide sequence at SEQ ID NO. 33096
atagctggagctccccgcggtggcggccgctctagaactagtggatcccccgggctgcaggaattcgcacgagaccattacctagaacatcctaatcaaaaaacagtcccacgccctccagtcaaagcaagccgctgcttggccggccgggaaggctcgttcgcagcgccgaggaatggctgccaagccggtcaccgtcggcgacctcatccaccgcgtcgcctcttcctgcctctccaaccgcctgccgtgcaaccacaccttccgcgactccgtggacagcgactttgacgacgacgacgacgacgacgaccccttcgccgacgccgtctccagcagcgagaaatgccagcggtcccgcccgctgcggaggtcgaggaagaggaccgagagcacgagaacctcacgagtctgggagattaggaaccatgcaccaggagacgctggcggccgggtcaattgccccctagccctaccccagagcatcttccactgcagacggaaggagttgactgcctcctccgaagaagggccgcgcctcaattccccacgagggactttgcgccacgctgaggcccccctgggaccaaccgcatcatcaaggacccggcggggggagtaaccttcccaaaaccttgcgaagggccggggagagtgccaaacccccgggagctggtttttgggccctccccttggaaaaaattg

SEQ ID NO: 33096 - protein, 148 aa, Zea mays
  misc_feature: Ceres CLONE 1410603-F
MAAKPVTVGDLIHRVASSCLSNRLPCNHTFRDSVDSDFDDDDDDDDPFADAVSSSEKCQRSRPLRRSRKRTESTRTSRVWEIRNHAPGDAGGRVNCPLALPQSIFHCRRKELTASSEEGPRLNSPRGTLRHAEAPLGPTASSRTRRGE

SEQ ID NO: 33097 - DNA, 669 bp, Zea mays
  misc_feature: Ceres CLONE 1410605-F
  misc_feature: Translation starting site: 238
  misc_feature (400)..(400): n is a, c, t, g, unknown, or other
tccccgcggtggcggccgctctagaactagtggatcccccgggctgcaggaattcgcacgagaccattacctagaacatcctaatcgaaaagggtctccgtgtcgtctctgcgactccacttgctcttttcgctggccctggctacttgcggcaactcccatctccacgcgctctcccatccgagatctcaaccgcctcgccggcgagcgactgacgggcggacggtcccgccggctatggggaactgctgctccgatgaggtgagccacgccggtgctcatcccgtcggctccgccaccgccaaagccgcctccgcagcctccgccgcggccgatcgctttctccgctcccgtggtgccggcgcgtccacgcagatcgagttatctctctctgcatcanatttgggtgatcaagaatattttcccaagagaatccccatgggtggttgtgtattccaaaaagagagatggtacactagaagaaattgggcgcagtgaagtaattttaaattcattgaacccattttggacgaccaaaatcagtgtgcagtacccagttttgaggttcttcagcaattggggtgttttcaggcctttgacatccaccaagcagttcccgtgatggcaggtgaaaagatgctttaagctagaaggaacaagaggtttctt

SEQ ID NO: 33098 - DNA, 673 bp, Zea mays
  misc_feature: Ceres CLONE 1410606-F
  misc_feature: Encodes the peptide sequence at SEQ ID NO. 33099
ggagctccccgcggtggcggccgctctagaactagtggatcccccgggctgcaggaattcgcacgagaccattacctagaacatcctaatcgaaaactgggaggcagagacgaaagcctactagcttccctttgggtcggtctcgcgctcccgctgcgcgtctgtctgtctgtctgtcttggagcctcatcaatggctaccatcagagaggagtccgactacgacagcagccggtcctcgctgacggcgccgggcggctcccgccggagctggatcagcgacattggcagcgccagctcggtctcggcgcgctccgtggcggggcgaggctgggacgcgccggggtgccgccaccgccacaagcctcacaaggcgaaccaggccgagtgggaggccatcgggtgcgtccgcgccgccgcgggccgcgtctgcctggagcacttccgcctgatgcggcgcctgggcagcggcgacctcaggaacgtctacctctgccagctgcgcgagacctggtacaccacgtctggcctgtgccccacgaaggcgcgggacaaagctcctccggcttccgccatcaagatgccgtgcaagaggtggtgccccccggtaaacccgttcgaacgacccattctcccccgccgcaaacgcgcccattttcaggaaaatggataac

SEQ ID NO: 33099 - protein, 159 aa, Zea mays
  misc_feature: Ceres CLONE 1410606-F
  misc_feature: SWISSPROT Homolog: EC 2.7.11.1 Non-specific serine/threonine protein kinase
MATIREESDYDSSRSSLTAPGGSRRSWISDIGSASSVSARSVAGRGWDAPGCRHRHKPHKANQAEWEAIGCVRAAAGRVCLEHFRLMRRLGSGDLRNVYLCQLRETWYTTSGLCPTKARDKAPPASAIKMPCKRWCPPVNPFERPILPRRKRAHFQENG

SEQ ID NO: 33100 - DNA, 679 bp, Zea mays
  misc_feature: Ceres CLONE 1410608-F
  misc_feature (436)..(436): n is a, c, t, g, unknown, or other
  misc_feature (437)..(437): n is a, c, t, g, unknown, or other
aaagctggagctccccgcggtggcggccgctctagaactagtggctcccccgggctgcaggaattcgcacgagatcattacctagaacatcctaatcaaaaactccgccacctctccacccaacaacaaaacaagcctaatgggtaatggcttcctcagttcctctccatctcacgccactgcgctgccctagaaccttcgccgccgcccctctttaggattaccgtgtccccgatcgccccctggcacgcccgccccgatcgccccctggcacgcccgcccggatcctgcaccggaattccgtgtggaattccggacccgatcgaaatcgaaccgcctccctgcgtgctcccctgatcaagaaattctcacgccgcgcgaacgcacgcctgaggcggttggatcctctggtggggttccttggtctcgatttgtnntgtgtgggaaatgggggcgccgaaacagcgctggacgccggaggaagaggccgctctcaaaggccggcgtcgcccagcacgggcccggcaagtggcgcaccatcctccgagactcggacttcagcgcgctcctgcgcctccgctccaatgttgacctcaaggacaagtggcgcaacttgagcgtccctgcaaggaaggttatgggtcctagagagagagcaagggatggcgttgaagaaggg

SEQ ID NO: 33101 - DNA, 710 bp, Zea mays
  misc_feature: Ceres CLONE 1410609-F
  misc_feature: Encodes the peptide sequence at SEQ ID NO. 33102
  misc_feature (552)..(552): n is a, c, t, g, unknown, or other
  misc_feature (665)..(665): n is a, c, t, g, unknown, or other
  misc_feature (679)..(679): n is a, c, t, g, unknown, or other
ctggagctccccgcggtggcggccgctctagaactagtggatcccccgggctgcaggaattcgcacgagaccattacctagaaacttccttagctaacttcccagccccgacaccttggccgccgctccgtgcgcacccagttgctgaggttgcaacgctgcagccggcgaggatcggatgaaccaccaacccctcctataaatcctaaccgagtcctctgcttctgctctcatccatctgtagagtgcaacatgcagtgccccatggacactgctgctagtggaacctcgccagtgatgcaattccatagcaatgctgatgagtctatcgcccattcatctccattggcaacattaatacaacgttcacagcgccattgctatggggatggatccccaggcgaatttccccttgctgtgagcccctccattgttctccatgtgctctcatcttgtgatctaagtccgaaagatctcgccaatctggaggctacatgcgtatttttcggcaaaccctgcagttttgcaccagactttgcattgtcacttccnggagcttgcggcattttgatatgtgcccagaaaaggacccatgttaagcgatgaagcagaaagatcaggagtgctgaaacaacggtgtggagctcttggaagcaatgtctggntacttctggtaggnaaaaaaaaggttcttcgggtgattgcggccc

SEQ ID NO: 33102 - protein, 113 aa, Zea mays
  misc_feature: Ceres CLONE 1410609-F
MDTAASGTSPVMQFHSNADESIAHSSPLATLIQRSQRHCYGDGSPGEFPLAVSPSIVLHVLSSCDLSPKDLANLEATCVFFGKPCSFAPDFALSLPGACGILICAQKRTHVKR

SEQ ID NO: 33103 - DNA, 728 bp, Zea mays
  misc_feature: Ceres CLONE 1410615-F
  misc_feature (336)..(336): n is a, c, t, g, unknown, or other
  misc_feature (351)..(351): n is a, c, t, g, unknown, or other
  misc_feature (369)..(369): n is a, c, t, g, unknown, or other
  misc_feature (388)..(388): n is a, c, t, g, unknown, or other
  misc_feature (389)..(389): n is a, c, t, g, unknown, or other
  misc_feature (397)..(397): n is a, c, t, g, unknown, or other
  misc_feature (411)..(411): n is a, c, t, g, unknown, or other
  misc_feature (412)..(412): n is a, c, t, g, unknown, or other
  misc_feature (417)..(417): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (628)..(628): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (636)..(636): n is a, c, t, g, unknown, or other
  misc_feature (639)..(639): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (645)..(645): n is a, c, t, g, unknown, or other
  misc_feature (646)..(646): n is a, c, t, g, unknown, or other
  misc_feature (648)..(648): n is a, c, t, g, unknown, or other
  misc_feature (649)..(649): n is a, c, t, g, unknown, or other
  misc_feature (651)..(651): n is a, c, t, g, unknown, or other
  misc_feature (660)..(660): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (698)..(698): n is a, c, t, g, unknown, or other
  misc_feature (699)..(699): n is a, c, t, g, unknown, or other
  misc_feature (702)..(702): n is a, c, t, g, unknown, or other
  misc_feature (705)..(705): n is a, c, t, g, unknown, or other
  misc_feature (706)..(706): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (718)..(718): n is a, c, t, g, unknown, or other
  misc_feature (719)..(719): n is a, c, t, g, unknown, or other
aaagctggagctccccgcggtggcggccgctctagaactagtggatcccccgggctgcaggaattcgcacgagaccattacctagaacatcctaatcgaaaaagatcgttccgtaagggcacccatcgtcatagatacgattcatagcttctgccactacttgtgcgcgaagagccaagaaatgcgtcaggggttgtgaagggaaggagtgccgatggccggtggccacccggcgccgctgcggccggtggtggttgcgatgaaagccaccccaggtctggcaagtcacggcggcgcgcggcatcgcgaccgcgctttgctgtccgctcctggacnaggacgatgtgaggnactgcatgttgcccctanagggcttgcctgctgctgnnatgctcancgacctctcctacnncgtgntggggcggatggctgaccgccagtaaggtcggaactgcttgcgtcatcaatccccgctggcacgccgttctccctcgaatggtgaacgcctaccgggggggctttgggcccccgggaagggccccctggggaaaacaggaagggccccaaagttgaaaaacccggggtcgttttccaaaaaaggggggggnnnnnnnnnnnnnnnnnnntntnnncccnccncnnngnncnncnccccccccnccnnnnaannnnnaaaaagccggnnnnntgnnnnnngnntcncgnngnnnnnnttctnncgacgccgg

SEQ ID NO: 33104 - DNA, 720 bp, Zea mays
  misc_feature: Ceres CLONE 1410618-F
  misc_feature: Encodes the peptide sequence at SEQ ID NO. 33105
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
caaagctggagctccccgcggtggcggccgctctagaactagtggatcccccgggctgcaggaattcgcacgagaccattacctagaacatcctaatcgaaaaactaaccgcaggttcgggagtactccggaacccgccgccgcatccacacgacgccacgactgacgacggagagccccggtctccttccacggctccaccgccaccaccccgcataaaagtagggaagagagctttgcagcgagaaccgtatcgatctattctcgtctgaagcaattcgcccctgtcgtgagcagaatcctacagctcgtattcgcctcatctcgcagcagcagcagaagaacaagggtatggcgaaggatgggggtcccgactggaacggcctgctcaagtggagcctcgcccacggcgacagcaccaacccgccgcgtgctctcagcgaggaagacagaaaatggttcatggatgctatgcaagccaacacggtagatgttgtgaagaggatgaaggagatcactcaggtgatgaaacaccagaagatgtcttgcagtctcagggtgtgaccccgaggaacattgaagatatggtggatgagctacaggagcatgttgaatccatgacatggcaatgactactttctattggggggggctggatctctacttagttactgaaaaaatcaaatgctgcatcgagcaaggnnncaaaaaatggttaaa

SEQ ID NO: 33105 - protein, 70 aa, Zea mays
  misc_feature: Ceres CLONE 1410618-F
MAKDGGPDWNGLLKWSLAHGDSTNPPRALSEEDRKWFMDAMQANTVDVVKRMKEITQVMKHQKMSCSLRV

SEQ ID NO: 33106 - DNA, 730 bp, Zea mays
  misc_feature: Ceres CLONE 1410622-F
  misc_feature: Encodes the peptide sequence at SEQ ID NO. 33107
  misc_feature (232)..(232): n is a, c, t, g, unknown, or other
  misc_feature (278)..(278): n is a, c, t, g, unknown, or other
  misc_feature (283)..(283): n is a, c, t, g, unknown, or other
  misc_feature (316)..(316): n is a, c, t, g, unknown, or other
  misc_feature (430)..(430): n is a, c, t, g, unknown, or other
  misc_feature (568)..(568): n is a, c, t, g, unknown, or other
  misc_feature (618)..(618): n is a, c, t, g, unknown, or other
  misc_feature (629)..(629): n is a, c, t, g, unknown, or other
  misc_feature (630)..(630): n is a, c, t, g, unknown, or other
  misc_feature (632)..(632): n is a, c, t, g, unknown, or other
  misc_feature (633)..(633): n is a, c, t, g, unknown, or other
tggagctccccgcggtggcggccgctctagaactagtggatcccccgggctgcaggaattcgcacgagaccattacctagtacatcctaatcgaaaaacctgccacatctggccatctctcagtctcacacgcgctgccatggacggatccatgtggtgcgctgccaactacgtgcctctgacgccgctcagcttcctggagcgcgccgcggtcgtgtacggcgaccgcgcnggcgtcgtttgcggcgataggcggttctcgtggcgcgagacgaggnagcgntgcctcgcccgggcagccgctctcgctcgtctncgcgttgccgccgcgacgtggtcgcggtcatcgcctcgaacgtaccggcgatgtacgagctccatttcagcgtgcccgatgaccggcgcccgtctgtgcacgctcaacacccgncacgacggggcccatggttgtccgtcctgctgaaacactcggaaagccaggtctttcctcgtgggaggcccagttcccccgccgtggcccgcgacgcgctcaggctccttcgcgacgccaaaagaaggcttctctcgnaaattaaaggtttcctgaccctagcagagcagaaccgggggggggtggcnaaacacgacgnnanngggcccgcgggcccggaaaaaaaaaagccttttggggagcgcgcccggggatttcaaaaacccgggggccggccaaaaacgcgcccccgaatccttg

SEQ ID NO: 33107 - protein, 107 aa, Zea mays
  misc_feature: Ceres CLONE 1410622-F
  misc_feature (47)..(47): Xaa is any aa, unknown, or other
MDGSMWCAANYVPLTPLSFLERAAVVYGDRAGVVCGDRRFSWRETRXRCLARAAALARLRVAAATWSRSSPRTYRRCTSSISACPMTGARLCTLNTRHDGAHGCPSC

SEQ ID NO: 33108 - DNA, 716 bp, Zea mays
  misc_feature: Ceres CLONE 1410623-F
  misc_feature: Encodes the peptide sequence at SEQ ID NO. 33109
  misc_feature (317)..(317): n is a, c, t, g, unknown, or other
  misc_feature (381)..(381): n is a, c, t, g, unknown, or other
  misc_feature (392)..(392): n is a, c, t, g, unknown, or other
  misc_feature (402)..(402): n is a, c, t, g, unknown, or other
  misc_feature (405)..(405): n is a, c, t, g, unknown, or other
  misc_feature (413)..(413): n is a, c, t, g, unknown, or other
  misc_feature (424)..(424): n is a, c, t, g, unknown, or other
  misc_feature (436)..(436): n is a, c, t, g, unknown, or other
  misc_feature (439)..(439): n is a, c, t, g, unknown, or other
tccccgcggtggcggccgctctagaactagtggatcccccgggctgcaggaattcgcacgagaccattacctagaacatcctaatcaaaaactcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgccctgcgnacttcctgcagtcgttgaaccctcagtacgtgcgcctcgggtacactacctcatcaggcacggngtggtactggnccacatcccngtncatcgtgntggtggggcgngccgaagctggncancctcccccggcgagagttggggccaaaaggggggggggggaaacccacctaaggactccgccacggggtcgcttttcctcggggggcctcgccttaaacatctccgggaaaattaggggcggggcccgaggcccggggccccctataaaattttcgggggaaaaaaggcgggcagaaggttttaggggggcccacggggggatttttctcccccgggggcggaaaatccccaataattccaaaaggaacccctgggggttccaacgggggtgtggcg

SEQ ID NO: 33109 - protein, 172 aa, Zea mays
  misc_feature: Ceres CLONE 1410623-F
  misc_feature (40)..(40): Xaa is any aa, unknown, or other
  misc_feature (61)..(61): Xaa is any aa, unknown, or other
  misc_feature (65)..(65): Xaa is any aa, unknown, or other
  misc_feature (68)..(68): Xaa is any aa, unknown, or other
  misc_feature (69)..(69): Xaa is any aa, unknown, or other
  misc_feature (72)..(72): Xaa is any aa, unknown, or other
  misc_feature (80)..(80): Xaa is any aa, unknown, or other
MAREEQALLSTEIVNRGVEPSGPDAGSPAFSVRVRRRPAXFLQSLNPQYVRLGYTTSSGTXWYWXTSXXIVXVGRAEAGXPPPARVGAKRGGGETHLRTPPRGRFSSGGLALNISGKIRGGARGPGPPIKFSGEKRRAEGFRGAHGGIFLPRGRKIPNNSKRNPWGFQRGCG

SEQ ID NO: 33110 - DNA, 741 bp, Zea mays
  misc_feature: Ceres CLONE 1410624-F
  misc_feature: Translation starting site: 203
  misc_feature (338)..(338): n is a, c, t, g, unknown, or other
  misc_feature (461)..(461): n is a, c, t, g, unknown, or other
  misc_feature (520)..(520): n is a, c, t, g, unknown, or other
aaagctggagctccccgcggtggcggccgctctagaactagtggatcccccgggctgcaggaattcgcacgagaccattacctagaacatcctaatcgaaaaatccgactaataagggccagggccagggccttcgcttgcttactactcctgcttaccacactctaccttgtctcttcacgtgcacacgacgcctcccccaatggctgcgctggaggaggaggaggtgatcgtcgtcggcgcgaggcagtcggcgctagcggtgacggcgtgcctgtccctgcgcgctgtgcgtccgctgctcctgtagcgcgactactgcgtgacgtcgctgtggngaaagcgctgactaagacgcctccacctgcacatcaccaagaagtactgcgcgctgccgcacgcgccgcaccgggcagaggccctcgcgtacatgcaccgcgacgacttcaggcgatagctgnacggctacgccgctgcggttcgccggcggttcgcacgtgcagcggagagggccttcagntaatgttctttctcgcagacgtacagggacactttgatgtcaccgttgctcttcacagactgctaaggtccgttgtctagagaaaaatgcctcggcttgccaaaattgaaattgaaatgcccccattgaagattctcctctgtcgcacaaaaaggaaaattatatttgcttttccggatgacctcggccgaaaaattttcaaaaaaggcccttgctttcaa

SEQ ID NO: 33111 - DNA, 729 bp, Zea mays
  misc_feature: Ceres CLONE 1410625-F
  misc_feature: Encodes the peptide sequence at SEQ ID NO. 33112
  misc_feature (543)..(543): n is a, c, t, g, unknown, or other
  misc_feature (571)..(571): n is a, c, t, g, unknown, or other
  misc_feature (587)..(587): n is a, c, t, g, unknown, or other
  misc_feature (607)..(607): n is a, c, t, g, unknown, or other
  misc_feature (699)..(699): n is a, c, t, g, unknown, or other
  misc_feature (701)..(701): n is a, c, t, g, unknown, or other
aaagctggagctccccgcggtggcggccgctctagaactagtggatcccccgggctgcaggaattcgcacgagaccattacctagaacatcctaatcgaaaagctgaactgctgacgcttcgcgcgggtccgaggtcaggcggcagcagcacggagtagcaccagggcgaccgcccaggttatcgtcggccgccggcgacctgtaccccggcgagaagatgcatctgagcgcgaacgaggggatcgagggtctgcgattcgcggtgacgggcgggcagggcttcgtcggagctgccctcagcctcgagctgctccgccgcggtgcccgcgaggtccggtccctcgatctccgcgcctcctcctcctggtcccagcagctcctcgacgccggcgtccgaatcatccaaggggacataagaaagaaggatgatgtgcggaaggctttccgtggagtggactgtgttttccaccttgcttcttatggcatgtcagggaaggagatggtgcagactggggagatctgatgaggttaatataaatggnaccctgcatgtactggacgcttgcatgnagcagagtcagaaggnctgtgtatgtagcacatacnatgtgggtattcgagggaaaagcgatgtcacggaaaatgaggcgttgctttatttccgattgagaaccatgtttgatgcttatgggcgcagncnatcagtggctgacagcttggtatggaaa

SEQ ID NO: 33112 - protein, 101 aa, Zea mays
  misc_feature: Ceres CLONE 1410625-F
  misc_feature: SWISSPROT Homolog: EC 5.1.3.2 UDP-glucose 4-epimerase
MHLSANEGIEGLRFAVTGGQGFVGAALSLELLRRGAREVRSLDLRASSSWSQQLLDAGVRIIQGDIRKKDDVRKAFRGVDCVFHLASYGMSGKEMVQTGEI

SEQ ID NO: 33113 - DNA, 668 bp, Zea mays
  misc_feature: Ceres CLONE 1410632-F
  misc_feature (313)..(313): n is a, c, t, g, unknown, or other
  misc_feature (314)..(314): n is a, c, t, g, unknown, or other
  misc_feature (320)..(320): n is a, c, t, g, unknown, or other
  misc_feature (326)..(326): n is a, c, t, g, unknown, or other
  misc_feature (332)..(332): n is a, c, t, g, unknown, or other
gctctagaactagtggatcccccgggctgcaggaattcgcacgagaccattacctagaacatcctaatcgaaaaacgacgcaattcccgtcttcccacgccgtatcgccgttgctatgggcaagaagcggaagctcgagcccaaatcggcggcagggttcacgccggttaaggcctccccgaccaccaggtctgccaccgctaaggccgctggtctatccgaggtcctcgcccccgtcgaggctacgatggagaagctgccgcagggggcaggcggcgaggatgtagaggaaatcgagagggaggtggaggcnnagaggnaagtgnaagtgnaagaggaagaagaaggcgagagcgaccaggcttcgatccaggcgctggctggattcgttccccaaggaccagctcgtcgagctgttacgcgacgctgccatcgctcacggcgacgtgctaaccacaatccggggcgtggccgacgccgacccggttcagcggaagatcttcgtacacggcctcggttgggacaccacaaccgacacccttcaccgaggccttcggcccatacgggggagatagaggattctcagggtcgtcaccgaccgcaacacgggcaagtgcaagggggtacgggttcattcctctttcgccccggttccggggcccgagctg

SEQ ID NO: 33114 - DNA, 716 bp, Zea mays
  misc_feature: Ceres CLONE 1410633-F
  misc_feature: Encodes the peptide sequence at SEQ ID NO. 33115
  misc_feature (611)..(611): n is a, c, t, g, unknown, or other
  misc_feature (694)..(694): n is a, c, t, g, unknown, or other
tggagctccccgcggtggcggccgctctagaactagtggatcccccgggctgcaggaattcgcacgagaccattacctagaacatcctaatcgaaaaatcgcacaaatcctcttcctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggtttcggcggttaggtcgcccctctcccggtggcgaattacgtggtgccggtggcggtcgtgttgtgttcttgtctagttaggctgtgtggtctttatcggtgctgttttccgggggtgggtgtactgcatcgtcctagtttctagnccatgtgctgtatatctcgctgctgaatccaatgaaatggcctccgttcaagcccaaaaaaaaaaaaaaaagctatcgaacgncgaccccccaggggggggggcc

SEQ ID NO: 33115 - protein, 103 aa, Zea mays; identical to SEQ ID NO: 6459
  misc_feature: Ceres CLONE 1410633-F
  misc_feature (25)..(94): Pfam Name: Histone Pfam Description: Core histone H2A/H2B/H3/H4

SEQ ID NO: 33116 - DNA, 647 bp, Zea mays
  misc_feature: Ceres CLONE 1410634-F
  misc_feature (300)..(300): n is a, c, t, g, unknown, or other
  misc_feature (370)..(370): n is a, c, t, g, unknown, or other
  misc_feature (461)..(461): n is a, c, t, g, unknown, or other
gctctagaactagtggatcccccgggctgcaggaattcgcacgagaccattacctagaacatcctaatcaaaaacggcggggttgttgtcgcttgtggccagccgccagcaccagcacaaggcgatcgagagtggtgaccaccagtaaactgcaaagtgcaaaccaaacaccacccacgagaaagcggaggagggagcaatggcggagccgagccagcagctgcggtcgttcgtggaggtgccggcgggctcccacttccccatccagaacctgcccttcggggtcttccgccggcgggngggtgcaggcgcaggcgccgcgccccgcggtggccatcggggacttcgcgctcgacctcgccgccgtcgncgacgcggggttcttcgacgggcccgcgctctccggttccccgtgcttcaccaggagacggctcacatgttcctggggatggcccggccgnggtggaggaaggcccccccccgctcagaaaaaccttatcgccgaagaggccggtttgtggtggaaacaaaacactggggaacaagggtgcgggaaccaatggagggaattagaagtgggttcacaccaacacgggtggggaggttataacgggattttttttttgttttgggtccccatggacaaa

SEQ ID NO: 33117 - DNA, 773 bp, Zea mays
  misc_feature: Ceres CLONE 1410635-F
  misc_feature (1)..(1): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (726)..(726): n is a, c, t, g, unknown, or other
  misc_feature (729)..(729): n is a, c, t, g, unknown, or other
nccccttccctttnnnnnnntctacctccccccatgtaaatggaatataaaagtggggctccccgcggtggcggccgctctagaactagtggatcccccgggctgcaggaattcgcacgagaccattacctagaacatcctaatcaaaaaactgccccatggcccattgcttacgcataactgcggcggggacacgcgacgctaccgacttcgccgccgcctccttccttccgcccgtcgagtcgaccgatcgattgttcgcggcctccctcctagtcagatccactcaatcccaagaggccaagtccaaaccctacccaccacccttctcaaccagcgatgatggcagcggagcactccgccgtcggttccctccaccgccgctgacgccctgaaaaccctcgccctcgactcattcctcgtcggccgccgccgctaccgcctccacttccaccgacccccctcctccggccacctacctccccgacccgccgccgcgagcgaccgacctattttgtcatcgacgacctggcgaacgaggacgacttctccaccgccccggggcccaacgtcgcccgcctgcgcggcagctgcgcgtggtcgatgccgcgccccccccagtggtcgccaaaatcacccccgtatcggaatcccaagaagaccggaccccaaggggcgcgggggggggcccaccgcggtagcaaatttacccgggcaacgacagantanattatcgaatccctgtaccccatgccacaacctccctaccgccc

SEQ ID NO: 33118 - DNA, 672 bp, Zea mays
  misc_feature: Ceres CLONE 1410640-F
  misc_feature: Encodes the peptide sequence at SEQ ID NO. 33119
gctctagaactagtggatcccccgggctgcaggaattcgcacgagaccattacctagaacatcctaatcgaaaaattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctccagtacatcaagcggtgtgatcctcttcgaggagaccctctaccagaaggaccaaggatggcaagctttttttgtcgatgcctcaagggggaggggaaggcgtcctccttgggcatcaaggtcgacaggccccccttttggggggggtggtggccaccggacaagggagaccaccacccagggggccacgatggacctcggcaagcggctgcgctaaaaactacccaaagggccggtgccgcttttgcccaagggggggggggttgttttcccaaagattggcccccaacgaagccgtcacagttttggcatttgacctgaaa

SEQ ID NO: 33119 - protein, 172 aa, Zea mays
  misc_feature: Ceres CLONE 1410640-F
  misc_feature (11)..(168): Pfam Name: Glycolytic Pfam Description: Fructose-bisphosphate aldolase class-I
  misc_feature: SWISSPROT Homolog: EC 4.1.2.13 Fructose-bisphosphate aldolase
MSAYCGKYADELIKNAAYIGTPGKGILAADESTGTIGKRLSSINVENVEENRRALRELLFCCPGALQYIKRCDPLRGDPLPEGPRMASFFCRCLKGEGKASSLGIKVDRPPFWGGWWPPDKGDHHPGGHDGPRQAAALKTTQRAGAAFAQGGGGCFPKDWPPTKPSQFWHLT

SEQ ID NO: 33120 - DNA, 682 bp, Zea mays
  misc_feature: Ceres CLONE 1410642-F
  misc_feature (316)..(316): n is a, c, t, g, unknown, or other
  misc_feature (405)..(405): n is a, c, t, g, unknown, or other
tggcggccgctctagaactagtggatcccccgggctgcaggaattcgcacgagaccattacctagaacatcctaatcgaaaaaacgcatttcgctccccacagcggctcggccacaacccacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacagctccgccaggttgctgtgtgaangtccaaggttgtcacatggattcagcacaagatttccaacccaggaattctcctaataaagttgtggccaccaagtgaaagcacacggnatcaatgcttgtttgacaggatgacaaacaatctggtctacaggagtccattttctctcgcaattattcgcctttttgggaaaagcaagagggctcatgagaatgcaaaaaacgattggaagaactttgctttggccttgcctgatggacattttcagagaggagcaagaggggggggaggggaaagttctggtggtccagctatatgcaaagaaaacgagccaaattgggtggtgggaaagttctgaaaaaaaagccccaggcactacttgcagaa

SEQ ID NO: 33121 - DNA, 650 bp, Zea mays
  misc_feature: Ceres CLONE 1410644-F
  misc_feature: Translation starting site: 182
  misc_feature: SWISSPROT Homolog: EC 3.6.3.14 H(+)-transporting two-sector ATPase
  misc_feature (284)..(284): n is a, c, t, g, unknown, or other
  misc_feature (304)..(304): n is a, c, t, g, unknown, or other
  misc_feature (305)..(305): n is a, c, t, g, unknown, or other
  misc_feature (395)..(395): n is a, c, t, g, unknown, or other
  misc_feature (447)..(447): n is a, c, t, g, unknown, or other
  misc_feature (451)..(451): n is a, c, t, g, unknown, or other
  misc_feature (487)..(487): n is a, c, t, g, unknown, or other
  misc_feature (536)..(536): n is a, c, t, g, unknown, or other
  misc_feature (537)..(537): n is a, c, t, g, unknown, or other
cgctctagaactagtggatcccccgggctgcaggaattcgcacgagaccattacctagaacatcctaatcgaaaacctccccatcgcgtctgtccgctacccctccccgaccagatcgctacgagacgccgcgcgatccgacccaggccgacgccgacgacccctctcgccgccggcggccatggcgtacggcgaccgcgtcaccaccttcgaggactccgagaatgagagcgagtacggctatgtccgcaaggtctctggacctgtggttgtggctgatgggnaatgggtggtgctgccatgnntatgaacttggttcgtgtcggacatgataacctcattggggaaattatcccgtcttgagggcgattcagctacaatcccaagtttatgangaaacagctgggactggatggttaatggacccctgtattgagaacaagaagncctnctttcagtttgaattggggacctgggaattcttggnaacaattttttgacggtatccagcgacctctaaaacattcgctattagnncccggagatgtgtatttccccgggggggggttcagttcctggccttgaaaaaaatggattggtgggaatttcgccaccgaagctaggggttggagatgtctcaccagtggaaa

SEQ ID NO: 33122 - DNA, 667 bp, Zea mays
  misc_feature: Ceres CLONE 1410645-F
  misc_feature: Encodes the peptide sequence at SEQ ID NO. 33123
  misc_feature (364)..(364): n is a, c, t, g, unknown, or other
aaagctggagctccccgcggtggcggccgctctagaactagtggatcccccgggctgcaggaattcgcacgagaccattacctagaacatcctaatcgaaaacccttttttcctgcgaccaatccgcgcgcttttgtttttgttcctgctcctcggccctcgcaccgcgcgccgccgacgccgcatccatgaacggtgacggcagcaaggaggacgccaacaggcgcctcgagtgggccaccttgaacatggagcgcgccgtcgtcgtgagcgagacgacgaagggcgacggcaatggcaatgcaggccggaaggcgccgataagcatcgtccggctcttcttggcctgcatggtctccggcgncatccagtacgggtgggcgctgcagctctccctcctctcgccctactctcagactcttgggatctcgcacagctacgtgtctctgacatggatctgcgggcctatcgccggatttgtggtgcaacccatcgtgggctactacagcgaccggtgcaactcaaagatggcccggaggaagcccctcctccctcgggggatggatcatcatctggccctctggggtgggggatcgggttccccggggaacatcggcgggggcctccgcgaccccaaggaccactgaaaaacgttcccgggctcccg

SEQ ID NO: 33123 - protein, 152 aa, Zea mays
  misc_feature: Ceres CLONE 1410645-F
  misc_feature (59)..(59): Xaa is any aa, unknown, or other
MNGDGSKEDANRRLEWATLNMERAVVVSETTKGDGNGNAGRKAPISIVRLFLACMVSGXIQYGWALQLSLLSPYSQTLGISHSYVSLTWICGPIAGFVVQPIVGYYSDRCNSKMARRKPLLPRGMDHHLALWGGGSGSPGNIGGGLRDPKDH

SEQ ID NO: 33124 - DNA, 686 bp, Zea mays
  misc_feature: Ceres CLONE 1410652-F
  misc_feature: Encodes the peptide sequence at SEQ ID NO. 33125
  misc_feature (189)..(189): n is a, c, t, g, unknown, or other
  misc_feature (494)..(494): n is a, c, t, g, unknown, or other
aagctggagctccccgcggtggcggccgctctagaactagtggatcccccgggctgcaggaattcgcacgagaccattacctagaacatcctaatcgaaaagatgctcagcacacttatatgatgcattgttctctcagttttttccagcctgtataatgataagacacagggagcaactgcatgagcnggagcatacattcttgaactagaaatgaaactcaatgacaaggatagagaactaaatgctctgaagattgatcatcagacggtgtgggcaaatcaagatcttattagagaacagaccaaagagctggcaactgtcagaggggaacgcgacaactctgaagctgaaagagccaacatcttacacaaattcatgagctccaagaacatctgcgagaaaaagaaagcagttcattgcattagaggacagcatagggctgctcaagacacattctttacaagatgagcagttgagggaacccatgcttnggtatctcaagttcaaaaatggatgctttcagtctcaatcctacaaggtgagttccgtgagcgcatgaaccatttaatcaaaattgaataactcccaacaacagtatgctgaaatggcacggattcttctccataaaaaaaacacctccggaaaaatttacttgagcaagggaacggtctgttgcaaaaaaa

SEQ ID NO: 33125 - protein, 85 aa, Zea mays
  misc_feature: Ceres CLONE 1410652-F
MKLNDKDRELNALKIDHQTVWANQDLIREQTKELATVRGERDNSEAERANILHKFMSSKNICEKKKAVHCIRGQHRAAQDTFFTR

SEQ ID NO: 33126 - DNA, 651 bp, Zea mays
  misc_feature: Ceres CLONE 1410653-F
  misc_feature: Encodes the peptide sequence at SEQ ID NO. 33127
tacagctggagctccccgcggtggcggccgctctagtctagtggatcccccgggctgcaggaattcgcacgagaccattacctagaacatcctaatcgaaaaatcttcgccgccgctaaacgttccccccacgccccaacctatccacgcgaaaccttctttcccccgggagacgattcgtcagggagaggaaagaggcaagaggggccatggacgctgccaagttggtgacgccggtcgctgtgtctcacattctggcgcacccgtcggcgggctccgacggcgcagtgaccgatctcgtcgttcaggtcctcgacctgaagtccgtcggcacgggcagccggttcagtttcacagcaactgacgggaaggataagatcaaggcgatgcttcccaccaacttcgggtcggaggtccgctctggcaacctggaagaactccggcctcatccgcatcatcgactacacttgcaacgtcgtcaaaggaaaaatgacaaaagcttggttggcatcaaatgggagcttgtgtgccaagcgcttgaccgccaaaataacggggaggccaaaaaaaagggccttccattgggcttaaaccctaaggacaaatggatggggcggacatcccccctccctttgaaaccccagcgggggg

SEQ ID NO: 33127 - protein, 147 aa, Zea mays
  misc_feature: Ceres CLONE 1410653-F
  misc_feature (6)..(108): Pfam Name: Rep-A_N Pfam Description: Replication factor-A protein 1, N-terminal domain
MDAAKLVTPVAVSHILAHPSAGSDGAVTDLVVQVLDLKSVGTGSRFSFTATDGKDKIKAMLPTNFGSEVRSGNLEELRPHPHHRLHLQRRQRKNDKSLVGIKWELVCQALDRQNNGEAKKKGLPLGLNPKDKWMGRTSPLPLKPQRG

SEQ ID NO: 33128 - DNA, 689 bp, Zea mays
  misc_feature: Ceres CLONE 1410654-F
  misc_feature: Encodes the peptide sequence at SEQ ID NO. 33129
  misc_feature (255)..(255): n is a, c, t, g, unknown, or other
agagctggagctccccgcggtggcggccgctctagaactagtggatcccccgggctgcaggaattcgcacgagaccattacctagaacatcctaatcgaaaaacatgttacagcgactcggcctgccgcgatttttataatgcgccgcggtggccgtcgctagtggtacatatcagcaccgcccctgcctcgaggttgcgtgttttgttctctgtgagcgccgtgggtgttgatggcgtcaacggcgtactcgcnggcatccaagccgccagggccggcggccggagacaggagcggaccgcggctgggccaggagctcggcaggatcgagcccaagaagctgggcatcgggctggttgccggctgctgcttcgcgctgctcacctacctctcctttgcccggctgtttgcatctactcggcggttttcaacagctcgtcgtccatggggttgaagaacatggcgccagcaacgacgacgggggccggtacagctacaggggcgctgccggtggagcaaaaagcccaagtggaggacaagaagaaggttcgtgaacctgagggggacccgcacatgccaaaattacggaagccacaaaaaaggatccgcaggaggaggcccccgcgacaaaacccgcccggggggcctttattaacgaggccaaaatcacctggcaaggagaagggggg

SEQ ID NO: 33129 - protein, 73 aa, Zea mays
  misc_feature: Ceres CLONE 1410654-F
  misc_feature (8)..(8): Xaa is any aa, unknown, or other
MASTAYSXASKPPGPAAGDRSGPRLGQELGRIEPKKLGIGLVAGCCFALLTYLSFARLFASTRRFSTARRPWG

SEQ ID NO: 33130 - DNA, 661 bp, Zea mays
  misc_feature: Ceres CLONE 1410659-F
  misc_feature: Translation starting site: 218
tccccgcggtggcggccgctctagaactagtggatcccccgggctgcaggaattcgcacgagaccattacctagaacatcctaatctaaaagacaaccagacgcgccagggtttcaggcttccacgaatctccccgccgccctcaattcccctcggcgccgccgcctcctcccctcgcttcggtcctcggttagttaaccatccaggttctgtcaagatgtctgatagccatgagactgacaggaacattgagatttggaaaattaagaaactgatcaaggcattggaatcagccagaggcaatggcacaagcatgatctctctgatcatgcctccacgtgatcaggttgctcgagtggctaagatgttaggtgatgaatatggtactgcttcgaacatcaagagtagagttaatcgtcaatctgtgttggctgccatcacctcagctcagaagaggttgaagctctacaacaaaggcccctaaacggattggttctggacactggaactattgttactgaaaacggagaggaaaagaaagtaactattgattttgagccattcaagcctatcaatgtatcactcctacttttgggacaaaaagttccaaactgaggtttaaaaagactcctggaacctggagacaagtttgggttccttg

SEQ ID NO: 33131 - DNA, 638 bp, Zea mays
  misc_feature: Ceres CLONE 1410660-F
  misc_feature: Encodes the peptide sequence at SEQ ID NO. 33132
  misc_feature (191)..(191): n is a, c, t, g, unknown, or other
  misc_feature (399)..(399): n is a, c, t, g, unknown, or other
  misc_feature (400)..(400): n is a, c, t, g, unknown, or other
  misc_feature (407)..(407): n is a, c, t, g, unknown, or other
  misc_feature (542)..(542): n is a, c, t, g, unknown, or other
tccccgcggtggcggccgctctagaactagtggatcccccgggctgcaggaattcgcacgagaccattacctagaacatcctaatcgaaaacttgtgaacatcgcagtgctgtagcctccttcgtcttgagcgagcatggagatgtcagccatggaggaagccctcccaaggcgatggagaggaggaaggnaggcctcagaaccattccgttcatcatcttaaacgagatattcgagaaggtggccacgttcgggctgtcggccaacatgatcctgtacctcaccgagcggtatctcatgaccaacgcctttgccaccgtcgtcctctacttctggcatgccttctccaacttcctgcccatcttaggcgccgtgctcgccgacgcccgcctcggccgnntccgggncatcaccctcggctcctgcgttagcctcttcgggatgtgcctgctgtggctgacggcgatccttccggatgacaaaaacaccccggagggggcgccagaaccgccaggagggtacacccttgatcaaagtaatcngccgctacccataactgtgacgaaacggtggaccacacggagacaaataacacacaaagcggtaaagataaccaaagacaaaaagaaaaaagaagg

SEQ ID NO: 33132 - protein, 154 aa, Zea mays
  misc_feature: Ceres CLONE 1410660-F
  misc_feature (6)..(6): Xaa is any aa, unknown, or other
  misc_feature (76)..(76): Xaa is any aa, unknown, or other
  misc_feature (78)..(78): Xaa is any aa, unknown, or other
  misc_feature (123)..(123): Xaa is any aa, unknown, or other
MERRKXGLRTIPFIILNEIFEKVATFGLSANMILYLTERYLMTNAFATVVLYFWHAFSNFLPILGAVLADARLGRXRXITLGSCVSLFGMCLLWLTAILPDDKNTPEGAPEPPGGYTLDQSNXPLPITVTKRWTTRRQITHKAVKITKDKKKKE

SEQ ID NO: 33133 - DNA, 711 bp, Zea mays
  misc_feature: Ceres CLONE 1410661-F
  misc_feature: Encodes the peptide sequence at SEQ ID NO. 33134
aagctggagctccccgcggtggcggccgctctagaactagtggatcccccgggctgcaggaattcgcacgagaccattacctagaacatcctaatcgaaaagaattttaacttgttgcttctctccctcttctgttctgtctcgtccccttcacgaatcacgacagtattgaagcaattcctgattgctgatcctccacaatttctcccgtggattggagcgatctgaatgggagccgtttactgctgacatgccgggaactgatcgcctctaccctgaaattggacctatgacctgaagcccccgcaggtcccagcctccgccgggggcagcggcgaagaggacgccgggttttgcaacgcactggtgatgtggaagaccaatccaacgcgtgtccctcccatggagcggcccccatcatatttgaaaagggcactagggatcctcctcctaaattttcaaggaagaaagtttggatgttgcccttattccaaagtccacgatgaaatggccactgaaaagggatttccaaaaaaaaaactatgacagtttccccttcttgggaaaaaacaggcatcattatggggggccccccctttgtttcccctttatgcaaaaatttgttccccaatgggggggaaaaaggggtttttgataaaacaaaaacccggtggtttccccgaaaggaaaaaaaatattaaggggggattt

SEQ ID NO: 33134 - protein, 58 aa, Zea mays
  misc_feature: Ceres CLONE 1410661-F
MWKTNPTRVPPMERPPSYLKRALGILLLNFQGRKFGCCPYSKVHDEMATEKGFPKKKL

SEQ ID NO: 33135 - DNA, 660 bp, Zea mays
  misc_feature: Ceres CLONE 1410665-F
  misc_feature: Translation starting site: 210
  misc_feature: SWISSPROT Homolog: EC 1.6.5.4 Monodehydroascorbate reductase (NADH)
cagagctggagctccccgcggtggcggccgctctagaactagtggatcccccgggctgcaggaattcgcacgagaccattacctagaacatcctaatcgaaaacttgtcctccgactcttccattccattctattcccgcttccacacgtcggtcggcgcccttcgcgatcgtgtcgtttcttcccgcagcctgcctgcgtgtggggtgatggctaggcacttcaagtacgtcatcctcggcggcggtgtcgcggcggggtacgcggcgagggagttcgccaagcagggcgtcaaccccggcgagctcgccatcatctccaaggaaccagtggccccttatgagcgccctgcactcagcaaggggatacctcttccctcagaacgctgcaagactgcccagctttcacacgtgtgtgggcagcggtggagagagactacttcctgaatggtactctgagaaaggcattgaactgatcctgagtactgagattgtgaaggcccgaccttgcttcaaagactctgaccagtgcagctgcggaaaccttcacatatggaaaccttgctcatggctacgggctcctcggacataaagctcactgattttgggggtcaggagcaaaatcccaacaacttatggtatctaagggacatcgcggatg

SEQ ID NO: 33136 - DNA, 711 bp, Zea mays
  misc_feature: Ceres CLONE 1410666-F
  misc_feature: Encodes the peptide sequence at SEQ ID NO. 33137
caaagctggagctccccgcggtggcggccgctctagaactagtggatcccccgggctgcaggaattcgcacgagaccattacctagaacatcctaatcgaaaaacgcagctcacgtacacgcgatgagcacaccgcgtcgcggcgggcagcaccacggcgacaagcgcaccgtgacacgagcagcctcccgaaacagcgacggacacggcgcaggcgacttgagcttcgggtccacggcggggcctcggttcgccgtcgccccgccgcgcccttgggcgccgccgcctgagcacgcgggcgtcttcgcgcagccaccagacgatccgtcgacgttgaccatgctgtggggaccgcccggggaggtgcccgttgccggcttcgctgcggcaccggaaggccgaccggatgcgttcgctggcagcgcgtcgtgcctgccgctcgcgagcaggtcggcggccagcaggggggcgcgcaacggccaaactcctgggggcggccggtgtcggttcacgcggggctcccccttgtgggccccggggcgcgcggggccaaaacccaagggggagctccttgggcttcttgggactcccaaagtccctggggccgaggctgcaccgccgcccccggggaacggggttttgggccccagggttcaagggacctccccgaagggggtcctttcgccctgggggggggtctggggggagaac

SEQ ID NO: 33137 - protein, 124 aa, Zea mays
  misc_feature: Ceres CLONE 1410666-F
MLWGPPGEVPVAGFAAAPEGRPDAFAGSASCLPLASRSAASRGARNGQTPGGGRCRFTRGSPLWAPGRAGPKPKGELLGLLGTPKVPGAEAAPPPPGNGVLGPRVQGTSPKGVLSPWGGVWGEN

SEQ ID NO: 33138 - DNA, 694 bp, Zea mays
  misc_feature: Ceres CLONE 1410669-F
  misc_feature: Encodes the peptide sequence at SEQ ID NO. 33139
aagctggagctccccgcggtggcggccgctctagaactagtggatcccccgggctgcaggaattcgcacgagaccattacctagaacatcctaatcgaaaaaaacccgaaacccactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggcaacagccggccccgccgccgcaggggctccgctctacctctccctctccgcccggtggccgcgcactctgctcggattggctggtgagatgcccaaagcctttgtgatcttagatgatgttgtgcaacacaccctgactaatttgcacagtattcacaaaagcttactattttgccagggccaaggtgaggggacaaattctcagaaagtgtactttatgatatttgagagaggtccaaggggcctttggtgatgcaacatatcaaacactcactagactccgggacaatgggacggcctggccaatacattttgcatcctgcattctgaaatggtggaaacaaaactcgcttgccctgacaagaa

SEQ ID NO: 33139 - protein, 89 aa, Zea mays
  misc_feature: Ceres CLONE 1410669-F
MATSPPQNPSSGEPSDASSLAAAALEAPVRVWRSLVARFPPLPDSSSFLAGVSDLQLRYFGNSRPRRRRGSALPLPLRPVAAHSARIGW

SEQ ID NO: 33140 - DNA, 638 bp, Zea mays
  misc_feature: Ceres CLONE 1410672-F
  misc_feature: Encodes the peptide sequence at SEQ ID NO. 33141
gctctagaactagtggatcccccgggctgcaggaattcgcacgagaccattacctagaacatcctaatcgaaaaattaagtctcgttcactgcctgtgctgctcagtgctctgctcacacatcctcgtcgccaatggcggctcccgtccgggccatcccgctcccgtcgcccgtcctgtacccccgcatgtccttatggggccgcagcagctgcagccggcgacgtgcccccggagttcgcgcagcagtggaggccggcggaggtttgcttcgcgggcgacgagcccggtggaggtggtcggcgtaggcagccggaaagacgccgtcatcgacttctgcctgggctcacgcacgctgtcctccacccccatccgcttctggacagtacatgtgatggataattctaaagcccagttaatacaaaaaggtcatggaaatggatgcagtgttcaaagacttggaacctcccttaatttcttcatcctgcccacctgcggttattcttgtttctagtgcaggaaaggatgctgatcatattactgcaatggattacctagcgttgtcaaatcggggggaaatctggctgcatcaatatttttgaaacccttctggttcgagggacaaaaaaggcagtaaag

SEQ ID NO: 33141 - protein, 105 aa, Zea mays
  misc_feature: Ceres CLONE 1410672-F
MGPQQLQPATCPRSSRSSGGRRRFASRATSPVEVVGVGSRKDAVIDFCLGSRTLSSTPIRFWTVHVMDNSKAQLIQKGHGNGCSVQRLGTSLNFFILPTCGYSCF

SEQ ID NO: 33142 - DNA, 809 bp, Zea mays
  misc_feature: Ceres CLONE 1410675-F
  misc_feature: Encodes the peptide sequence at SEQ ID NO. 33143
  misc_feature (21)..(21): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (544)..(544): n is a, c, t, g, unknown, or other
tgccccccccccccccccccncccccacccctnnnntttattannnntcaaactggggctccccgcggtggcggccgctctagaatagtggatcccccgggctgcaggaattcgcacgagaccattacctagaacatcctaatcgaaaatatatacgccactctccgtcttcgcctttggtctccatcactgattctgattctgattccagccaccctgaccggcgaagcgcggctgacttttccccccaccataccgccaccacctgagaagagatcgatccaatcagattaaccaattagcagggaggtaggagaagggcaaaggcaatggccgggacggaggtggaagacccgccggcggcggcgctggaggtgcccccgaaacgcggccttctggggaacaaccccccgctggcccaagtgtcccctgctgggcctcatctggtttctggtggcccggacatgtttaaacccgctagccgggcctcggggggggggaggccaagttcaaccccccccattcggcgaaaaacgccaaagancggggcttctaaggccttgtttcggcggggggtccgggcgtggctgggcgggggcccccccaacaaaccttgttggggcccccccccccaaaacgttttcttggccgagccccgcttcacgtaaccccggttctaaacgccggggtcccttccctttaaattaacaaacccccccgacccgggggtttccaaaagggggttcccccccgcacacggggagggccgcacctttgcttttggggccgcggtgtctttgtcttttcct

SEQ ID NO: 33143 - protein, 112 aa, Zea mays
  misc_feature: Ceres CLONE 1410675-F
  misc_feature (72)..(72): Xaa is any aa, unknown, or other
MAGTEVEDPPAAALEVPPKRGLLGNNPPLAQVSPAGPHLVSGGPDMFKPASRASGGGRPSSTPPIRRKTPKXGASKALFRRGVRAWLGGGPPNKPCWGPPPQNVFLAEPRFT

SEQ ID NO: 33144 - DNA, 650 bp, Zea mays
  misc_feature: Ceres CLONE 1410682-F
  misc_feature: Encodes the peptide sequence at SEQ ID NO. 33145
ggagctccccgcggtggcggccgctctagaactagtggatcccccgggctgcaggaattcgcacgagaccattacctagaacatcctaatcaaaaaacggattcgccggccgtactcttctgagttggcaaccgtcgctgagagctacgagctgcacctgtttgttgttgcgtgactgggtgtgtgcgggtccaccactgaccccgcgcgcgccctgcggccctggacgtccagtccacttgctcactcagtcggtctcgtcgcggccctgttcccccccggtcaatggatgtacgcgctgcgcctagggacgtgcctcctccccgtgcgaaccggtgcgagccgcccgcgagatcattttctaccaccatgttgttccataaaggaaaatggtgaaggacgaatttgcttttctagccaaagggacccaaggtcctaccttgcatcaccatcagaaattcttcgaatggaaatcctcctattgtaggatatcacatcggacattaaatacttctgttaatgcttcggagcaacagctgcagtctgaacctgaaacacatgattctacacccatctggagggaatatcatcttctctagatgcatttacagattttcccggcacatactgtcataggaacagattagcat

SEQ ID NO: 33145 - protein, 69 aa, Zea mays
  misc_feature: Ceres CLONE 1410682-F
MVKDEFAFLAKGTQGPTLHHHQKFFEWKSSYCRISHRTLNTSVNASEQQLQSEPETHDSTPIWREYHLL

SEQ ID NO: 33146 - DNA, 697 bp, Zea mays
  misc_feature: Ceres CLONE 1410684-F
  misc_feature: Encodes the peptide sequence at SEQ ID NO. 33147
  misc_feature (325)..(325): n is a, c, t, g, unknown, or other
  misc_feature (408)..(408): n is a, c, t, g, unknown, or other
  misc_feature (409)..(409): n is a, c, t, g, unknown, or other
  misc_feature (605)..(605): n is a, c, t, g, unknown, or other
ggagctccccgcggtggcggccgctctagaactagtggatcccccgggctgcaggaattcgcacgagaccattacctagaacatcctaatcgaaaagttcgggattcaaacccttcgatcccaaatctgccctgcacgcctcgccgccggccacacccccggcggtcgtcgccctacccgctcgacccttctccttacctctaaccccgccggagcccaacacctccccaccatgccgcgaaacttccgcaagcggggcatcgagcaggacactgacgaccgctccgacgacgaggacactcgccgcatcgccctcgaggagatncagtacatgcagaagctccgggagaggaagctgggtatccccgccgaccctcgccgcgcatccactaacgggtcctccgcccnngtgtctatgggcaccggggcagcggttcgccggtgaggccgaaaaggagacctcgttctccaggacccttcgctcaggagaccggcgtcactatcgaggacccccacatgttgaggtacctggaaaaccgacctgcaaaaaaaaagggtaaggatggttgatgggggcaccaaggaaaaaatgcccttgtgggacnagtcttacccgggggcaaaaccccctaaggtaaaaaaaaaaaacttcgaggagaacctcccccaaggggacacgtggttgtctaaaattccc

SEQ ID NO: 33147 - protein, 70 aa, Zea mays
  misc_feature: Ceres CLONE 1410684-F
  misc_feature (31)..(31): Xaa is any aa, unknown, or other
  misc_feature (59)..(59): Xaa is any aa, unknown, or other
MPRNFRKRGIEQDTDDRSDDEDTRRIALEEXQYMQKLRERKLGIPADPRRASTNGSSAXVSMGTGAAVRR

SEQ ID NO: 33148 - DNA, 675 bp, Zea mays
  misc_feature: Ceres CLONE 1410687-F
  misc_feature (20)..(20): n is a, c, t, g, unknown, or other
  misc_feature (56)..(56): n is a, c, t, g, unknown, or other
  misc_feature (58)..(58): n is a, c, t, g, unknown, or other
  misc_feature (65)..(65): n is a, c, t, g, unknown, or other
  misc_feature (66)..(66): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
tttttttggtgggttggtgntttgtgttgttgggtgtttttttgggttttgtgttngnggggggnnatacttnnnnnnaaaaatggagctccccgcggtgggggccgctctagactagtggatcccccgggctgcaggattcgcacgagaccattacctagaacatcctaatcgaaaaccctcccccaccgccattgctcagcagcagtagtaaagccacgcctgacagacagtggttcatttctggtgctgccttgctgggggagccctcggcgcagcagccagaaagagagagcgaaatggatggtgaaacgacgtgctgctaatgggggctgggggcgcgctgcttgcaggggggggctccgggctccaaaaaccgggggggaaaagccccccccgggggcccccgggatggggcgggaggaggaaaaaggttacacgcggtcctggaaggaggggttcttttatgatgggagaagcggccccacccgagtaaatagtgatgaatgtttgaggaggtgaggagggaagacgccccccccggccgacaatatggaagtcgagtgattcagaggtcggtcggttctcgacagatcccacccccatcaccactacgtacaaccgacgtagaggcgagcacgcgcgagggagacagaggaagagtctcacgtacgg

SEQ ID NO: 33149 - DNA, 640 bp, Zea mays
  misc_feature: Ceres CLONE 1410688-F
  misc_feature (265)..(265): n is a, c, t, g, unknown, or other
  misc_feature (266)..(266): n is a, c, t, g, unknown, or other
aagctggagctccccgcggtggcggccgctctagaactagtggatcccccgggctgcaggaattcgcacgagaccattacctagaacatcctaatccaaaagaaggggaggaatcccttcctccgcgagtcgcgagccgtggagatccgtcccactccacccctccgctccgccccagacctcgctacaaacctgccgcgaaaatagcagccgcccgtttgctctctcccgtctccgcactccctccgcgatgagcgacccgcgnngccgcgccgccccgtccgacggctacggggacgaaccgcacgacctcccgctcgccgaggacgcaaacgccgagaaacggtgcaaacccaaaaaaaaaggcggttgcccgggcgaagggggcccttgcccggaaaggggaaaaccacccggaccttaaaagggaaaggtttgccgaaagaaaaggggtggcccccccggatagggggaacccaaggggggggggggggggggaacccccccggggccccatggtggggccccaagggtatctttcccccccccaaaggggggaaaaaaaagggggggcccccctcccgctggccccccggagaggggaggggaccctacccgtttcccccccccgggggggggg

SEQ ID NO: 33150 - DNA, 594 bp, Zea mays
  misc_feature: Ceres CLONE 1410693-F
  misc_feature: Encodes the peptide sequence at SEQ ID NO. 33151
  misc_feature (139)..(139): n is a, c, t, g, unknown, or other
  misc_feature (341)..(341): n is a, c, t, g, unknown, or other
  misc_feature (367)..(367): n is a, c, t, g, unknown, or other
  misc_feature (420)..(420): n is a, c, t, g, unknown, or other
cgcggtggcggccgctctagaactagtggatcccccgggctgcaggaattcgcacgagaccattacctagaacatcctaatcgaaaactccttcccctccctctttcccgacaccaaaagaaaccgaaaaccatcgacngcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctggcacacccgagcctcccggccccggncacatccaagcccgccgccctccggncccgggcacacccaaagcgggcgccttccggccccgggcaaacccaagcgggncgccaaggggggaagaggaaaaaaggcccgggggcccccgcgcaggaacctcaggggcagaccgggagaagggaaacccggggggcccgccccgcgcggccacaaacgggggccagacgagggggggccgggaaaccaaacccaacaaagcggaggaaaaaacgcgcaacgggg

SEQ ID NO: 33151 - protein, 126 aa, Zea mays
  misc_feature: Ceres CLONE 1410693-F
  misc_feature (51)..(51): Xaa is any aa, unknown, or other
  misc_feature (69)..(69): Xaa is any aa, unknown, or other
MGAVTSTVAARFAFFPPSPPSYGFEQPAPLPAPGTPEPPGPGHIQARRPPXPGTPKAGAFRPRANPSGXPRGEEEKRPGGPRAGTSGADREKGNPGGPPRAATNGGQTRGGRETKPNKAEEKTRNG

SEQ ID NO: 33152 - DNA, 675 bp, Zea mays
  misc_feature: Ceres CLONE 1410694-F
  misc_feature: Encodes the peptide sequence at SEQ ID NO. 33153
  misc_feature (369)..(369): n is a, c, t, g, unknown, or other
  misc_feature (370)..(370): n is a, c, t, g, unknown, or other
cgcggtggcggccgctctagaactagtggatcccccgggctgcaggaattcgcacgagaccattacctagaacatcctaatcaaaaacccgctccgcttcacccagtcccataccccagccgaccagcccggcgcgcggtggcactgtggcagcgctcacacggcaatgcggaaggacgctgccgccgccggcattgcgccgggttcggcgcccgcgtttctctgcttcgaccttaagcccttcctcgccgcgctcaccgtgctgacgctcctcgccgccgcctggcagctccggccttaccaatccctcctcgcttccccattctccgccgcgtgcccgcaaccaaccgccggcgtctcgctccccgnngcgctcgccgtcaaaggccaagaagggctcctccgccaccaactccacagcttggttcctcgccgtcccgccgcccgggcccgaaaggggggggaggtcccacgccgtgggcagcgcgggcgggcgctggttcttgcaaatgggcgcgaatcccgcggggggccctaacaccttcgcggggggaggcttctaccccccaacaccacaaccactacaaccacaaaacccgcgaaacagtaatatatgggaagcgcaggacaaccccacccgcccccgctaaccgaccagcgcccacactctctcaa

SEQ ID NO: 33153 - protein, 46 aa, Zea mays
  misc_feature: Ceres CLONE 1410694-F
MGANPAGGPNTFAGGGFYPPTPQPLQPQNPRNSNIWEAQDNPTRPR

SEQ ID NO: 33154 - DNA, 792 bp, Zea mays
  misc_feature: Ceres CLONE 1410695-F
  misc_feature: Encodes the peptide sequence at SEQ ID NO. 33155
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (27)..(27): n is a, c, t, g, unknown, or other
ggggcccccccnnnnnnnnnnnnccangcgcccaggaatttaggttgtgcaaagctggtgctccccgcggtggcggccgctctagaactagtggatcccccgggctgcaggaattcgcacgagaccattacctagaacatcctaatcgaaaaagccagcaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggcggaatctcccgggacgcctctccgtccgcgcctccgcgacggtggtagcggcaccgcggcgggagacggatcccaagaagcgggtggtgatcacgggggatggggctgggcctccgttttcgggaacgatgtagacgcttactacaaccgcctgctagttcggggagagcggcatcggggcccattcgaccggcttcgaacgcttcttaagtcccccacccgcttttggccggtccagatccgggggcttctccctccggaggggatacatccaagggaaagaacgaccggcgcccttggatgattggccctcccgatactgggattcctcagggggaaaaaaaggggttcctcgaagggcctccgggtatcggccacacgggttcccaaggcccatgggaaaaagatttgaccaagaacccccgggcccggggggggctttggggggcaac

SEQ ID NO: 33155 - protein, 64 aa, Zea mays
  misc_feature: Ceres CLONE 1410695-F
  misc_feature: SWISSPROT Homolog: EC 2.3.1.41 Beta-ketoacyl-acyl-carrier-protein synthase I
MQSLLLPTAAVAPVAPPCGRRNLPGRLSVRASATVVAAPRRETDPKKRVVITGDGAGPPFSGTM

SEQ ID NO: 33156 - DNA, 693 bp, Zea mays
  misc_feature: Ceres CLONE 1410699-F
  misc_feature (349)..(349): n is a, c, t, g, unknown, or other
  misc_feature (468)..(468): n is a, c, t, g, unknown, or other
  misc_feature (469)..(469): n is a, c, t, g, unknown, or other
  misc_feature (502)..(502): n is a, c, t, g, unknown, or other
  misc_feature (583)..(583): n is a, c, t, g, unknown, or other
  misc_feature (628)..(628): n is a, c, t, g, unknown, or other
aaagctggagctccccgcggtggcggccgctctagaactagtggatcccccgggctgcaggaattcgcacgagaccattacctagaacatcctaatcgaaaaatccccatcgcgatcgcctctctccagctaagcgatgaagaaccctaaccctcctccctcgcgtccctccgccgcaggcaaggagccccccgcaggcatggcgccgccccgcaaatctcgctggggcccaccgccaccgggcgttgccggcgacaaggccgcgccatccacctccgcccgccgcaccccgaccccgacccccacccgcacagcggactccaggcgccatccggggggccctcacgcngcagcaccgcacgcccgcaaccccgggtcgcaggcggtcgctctccggccgcaggctcgtccgcaacctccggcggtggagactcctccccccgcagcgtacggcttccacaacctggnnacgcgcgtcatgcccctcgcccgacgcaccgtncgaacctacttcgccctgccccctgactacagcttcgagccggtgcccctggcacccctcccaaaacgcctcctcccccgngccgccccggacctctggccgccgccgctacatttgcagatgccngcgcacgaagctaggcgcaaacaccctgccgaacaggacgagggctccgcgaggcaccccagcag

SEQ ID NO: 33157 - DNA, 705 bp, Zea mays
  misc_feature: Ceres CLONE 1410706-F
  misc_feature: Translation starting site: 200
  misc_feature: Pfam Name: Phytochel_synth Pfam Description: Phytochelatin synthetase-like conserved region
  misc_feature (705)..(705): n is a, c, t, g, unknown, or other
aaagctggagctccccgcggtggcggccgctctagaactagtggatcccccgggctgcaggaattcgcacgagaccattacctagaacatcctaatcgaaaacaggatcggggatcggagcttgtgctgctactgctactataccagcgctagctagcagcagccgccggccggctcgcgcaagctaaggaaggtcgacatgacgatggggctccgcgtccgcgactcctccgcgctgctggctctggccgtcgcgctcgcctgctgctccgttgcagtggtggcctacgaccccctggacccgaacggaacatcaccatcaggtgggacgtgatctcgtggacgcccaacgggtacggggcgatggtgaccatgaccaactaccagatggtccgggcacatcatgggccccgaggtgaacctttggggtgggcctgtggccaaaaaaagaggggatctgggcccattcgggggggtgcaagccaacgggaacagggggacttgcttcccaagttaagggggggaattcccgcactggttgaaagggccccccgggccggggtggaacctcctccccgggggggcccttaaaaccaaaaaaaaccccaaactggtggaaaggccgggggggggttccgggaaaccggacaagaaccccgggggggccccctcccccccgttccaagggccccgggcgggcggggn

SEQ ID NO: 33158 - DNA, 643 bp, Zea mays
  misc_feature: Ceres CLONE 1410708-F
  misc_feature: Encodes the peptide sequence at SEQ ID NO. 33159
  misc_feature (52)..(52): n is a, c, t, g, unknown, or other
  misc_feature (298)..(298): n is a, c, t, g, unknown, or other
aagctggagctccccgcggtggcggccgctctagaactagtgggatcccccngggctgcaggaattcgcacgagaccattacctagaacatcctaatcgaaaaccatccatccatccagttagttagttagtaagttagttgagggagaagaagcaggggaggggaagcgatgagcaacatgctgcgggctcgccgccgcctggacctcctgcaggtggtgctcttcgccgctgtgctcctcgtcgtcgtcgccgacgccggcgtgacgagccagtaccggcggaagctggaggcgancgtggagatgccactggacgccgacgtcttccgcgtcccgccgggggtacatgccccgcagcaggtgcacatcacgctgggttgacaggaggggcacggcgatgatcgggtccttgggtgacggccaatgaactgggcagcaacaccgtcatgaacagggaggcgtccccgcacccgaaaaaaatgggactccggggggaagggacccccacgggttaaaataacttaaactaaccccccgggttttttcccccctgggccctccaaaaccttgggtttgcccccaggtttccctccccctgggggttccccccccccgggagggagctttttgttccccccccc

SEQ ID NO: 33159 - protein, 70 aa, Zea mays
  misc_feature: Ceres CLONE 1410708-F
  misc_feature: SWISSPROT Homolog: EC 3.1.3.2 Acid phosphatase
  misc_feature (43)..(43): Xaa is any aa, unknown, or other
MSNMLRARRRLDLLQVVLFAAVLLVVVADAGVTSQYRRKLEAXVEMPLDADVFRVPPGVHAPQQVHITLG

SEQ ID NO: 33160 - DNA, 880 bp, Zea mays
  misc_feature: Ceres CLONE 1410710-F
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (20)..(20): n is a, c, t, g, unknown, or other
  misc_feature (21)..(21): n is a, c, t, g, unknown, or other
nctttttnnttnnncccttnntcctcctcccccctccccccccccaagctggtgctccccgcggtggcggccgctctagaatagtggatcccccgggctgcaggaattcgcacgagaccattacctagaacatcctaatcgaaatctagaaatccacttcgattcgccctggacgctcctgcctcctgctagtcgacgcgcaatccttggcaatctggcagacaggtgaggcgctgagcctgctactactaactaggagccgcggcgggaaatgagggatgcggaggcggcggcgcgccggaggtgaacgctggagcatgagaaacatggcgtcggtgctggagaaagaagaccaagtggttgctgccccgccgggaaaaaggaggcgcgccacggcgcttgggccgcctttcctcccaacccgaaggtgggcttcccctccccccctctggcccgggacgctccgttcccagcccgcctggctacctccggttccggcagactttaagccttccggggcggccaacgaatccagacccccgtggaccagtccgccggggggaaatctcttcccttctgggggccgggccggccgacccttttcctcgggacggaccggtcctcccggggaaggtttcccctccaggaattgggcaaacctccccccggggccccctcaaaggcggagattctcgcccccccccgcccgggcccccccgcccggcagaagcaagcgatcgggttcgggcacacccgaagctacgagcgggagggacccaccagcccggggggggggggggccttatgcgggggcgtggtgaagaaaggacctgtggagacccctcgggtccccactccggtgggggcgatctctcttccg

SEQ ID NO: 33161 - DNA, 706 bp, Zea mays
  misc_feature: Ceres CLONE 1410711-F
  misc_feature: Encodes the peptide sequence at SEQ ID NO. 33162
cagagctggagctccccgcggtggcggccgctctagaactagtggatcccccgggctgcaggaattcgcacgagaccattacctagaacatcctaatcgaaaagacccgcgcgtgtgttctggggcgctctcctcctcctcctcctccgtctctcctctctccactctcccccctatccgtctctctctgtcctttctggatcgacggctgggcgccgccgcccttcgtcaggtcttcgccggcggcgattacacaccaggttgagcaaatattcttccaccaatggcgagagaaccgagtcctgaaatagatgatgaacttttcaatgaagtttatgggaaagcatacagcggcccagttgcatcagctacaaatagtgtgactcctaaaggaaatgctgagaagaggcccctgactcgtgataagtcagatgatgaagatgaggccccagatcctaatgctgttcccacggacttcactagccgagaggctaaggtctgggaggctaaagctaaggctacagaaaggaactggaagaagaggaaggaggaagaaatgatttgtaaaatatgtggagacccaggccattttactcagggttgcccctccacacttggggcaaataagagaaatgcagactttttttgaagagttccagcaagagataagcaagtcagagatcttttcaatgagagggtaataagc

SEQ ID NO: 33162 - protein, 121 aa, Zea mays
  misc_feature: Ceres CLONE 1410711-F
MAREPSPEIDDELFNEVYGKAYSGPVASATNSVTPKGNAEKRPLTRDKSDDEDEAPDPNAVPTDFTSREAKVWEAKAKATERNWKKRKEEEMICKICGDPGHFTQGCPSTLGANKRNADFF

SEQ ID NO: 33163 - DNA, 648 bp, Zea mays
  misc_feature: Ceres CLONE 1410716-F
  misc_feature: Encodes the peptide sequence at SEQ ID NO. 33164
gctctagaactagtggatcccccgggctgcaggaattcgcacgagaccattacctagaacatcctaatcgaaaaagcctgcgctccccttctttcccgttcggctcacagcgaagaaggaagccggttagggtttccacctcctttcccctcctctccttcagcgacgaccgcgggccacaccctcgatatccttcccctcggacccggaggcgagcagcagcctccagcgcctgccacgcctgcccgtctcgttattgggaggattcgccatgtctgacatggagtccgtcacagctcttatgaactcgacaagctccaagatacagcagcttcaggaggcatttgctgagcttgagagccagagcacggtttccatgaacctcaagtggaggcagcttgagacccacttttcgtggccttgaacagtccttcaaagaaaaagtttgacgagctaaagagcggggagaagggagtcccaggaagattgtcgccaaatcagaggcagattctgggagcagcggaaggccagctggttggggcaaaggaactgacctccttttggaggaaggtggcgggaagaacaagggaggctggcattaggcaaggaacctttaaaaggggccaggggctttgcgttacccggggc

SEQ ID NO: 33164 - protein, 50 aa, Zea mays
  misc_feature: Ceres CLONE 1410716-F
MSDMESVTALMNSTSSKIQQLQEAFAELESQSTVSMNLKWRQLETHFSWP

SEQ ID NO: 33165 - DNA, 665 bp, Zea mays
  misc_feature: Ceres CLONE 1410717-F
  misc_feature: Encodes the peptide sequence at SEQ ID NO. 33166
  misc_feature (263)..(263): n is a, c, t, g, unknown, or other
  misc_feature (465)..(465): n is a, c, t, g, unknown, or other
  misc_feature (476)..(476): n is a, c, t, g, unknown, or other
  misc_feature (480)..(480): n is a, c, t, g, unknown, or other
  misc_feature (485)..(485): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (552)..(552): n is a, c, t, g, unknown, or other
  misc_feature (553)..(553): n is a, c, t, g, unknown, or other
aaagctggagctccccgcggtggcggccgctctagaactagtggatcccccgggctgcaggaattcgcacgagaccattacctagaacatcctaatcgaaaaatcttttcctttcctatccctcgtctcgtctcgtcttcgttcccctttcctcctgcgcaccccgtcttctcctcaccgcgtcaaaccccagcacaaatcaaccgcccgccgcctccgctcccctcccgtcccgaatcagccgccgcggtgcccaatccggncgatcccccctcctatccgccgcagagtcggcgcctctgggcctaccccgatgtatagcaacttcaaggagcaggcgatcgagtacgtcaagcaggcgggtcaggaggacaatgccggcactacgtcaaggcgtccctctctacatgaacgcgctcgagtacttcaagacccatctcaagtacgagaagacccccagatcangggaggcatcnacgncaagntcaccgagtacctccccgcgcgcgaggagatccgggccgtcctcgacgannnggcgcgcggggccgnnggccaacgaggtgacgcagccgtcgccacgcgccccaagacaagggcagggacggcgacgggggaacggaggggatgacttcgagcagtccaagctcagggcggggctcact

SEQ ID NO: 33166 - protein, 105 aa, Zea mays
  misc_feature: Ceres CLONE 1410717-F
  misc_feature (51)..(51): Xaa is any aa, unknown, or other
  misc_feature (55)..(55): Xaa is any aa, unknown, or other
  misc_feature (56)..(56): Xaa is any aa, unknown, or other
  misc_feature (58)..(58): Xaa is any aa, unknown, or other
  misc_feature (74)..(74): Xaa is any aa, unknown, or other
  misc_feature (75)..(75): Xaa is any aa, unknown, or other
  misc_feature (80)..(80): Xaa is any aa, unknown, or other
MYSNFKEQAIEYVKQAGQEDNAGTTSRRPSLHERARVLQDPSQVREDPQIXGGIXXKXTEYLPAREEIRAVLDXXARGAXGQRGDAAVATRPKTRAGTATGERRG

SEQ ID NO: 33167 - DNA, 683 bp, Zea mays
  misc_feature: Ceres CLONE 1410718-F
  misc_feature (445)..(445): n is a, c, t, g, unknown, or other
aagctggagctccccgcggtggcggccgctctagaactagtggatcccccgggctgcaggaattcgcacgagaccattacctagaacatcctaatcgaaaaagcacaccactcgtagccgccggcaaggcgactgacctctttcctgctgccgagggccatcgtctcctcggaccatctcacctcagagctgctgcgaccgccggccaacccgtctaggtcttgtccctgccgcttcctgagcctagaacatctttgcattttggagagtctccactcgcagctattgtacagtctccatccctttcaacgagatggcacgacagtctgctctctcgcttgtgaggatcgagcaaagacgggagcgctgaagcgtctgactctgagttcatctgaacacggctgctaggaactcatctggacgcatcacctcttttcaccgtggngcatgggccaaaaaggtgcataagaaggtccatgtgcaacacgacgcctgatacacgggtatggcggagggtatcgagaccacctgaatcgctcctcgagccttgctcttgtgcgaggggtgcaatgcgtgcatttccgccgccccaagagtccacaagaactcaggccatgtctcaattcaacatctgctacggttgatgcctccggccggtttcccttgctgcatatctagaaggg

SEQ ID NO: 33168 - DNA, 684 bp, Zea mays
  misc_feature: Ceres CLONE 1410720-F
  misc_feature: Encodes the peptide sequence at SEQ ID NO. 33169
  misc_feature (523)..(523): n is a, c, t, g, unknown, or other
  misc_feature (524)..(524): n is a, c, t, g, unknown, or other
  misc_feature (561)..(561): n is a, c, t, g, unknown, or other
  misc_feature (647)..(647): n is a, c, t, g, unknown, or other
aaagctggagctccccgcggtggcggccgctctagaactagtggatcccccgggctgcaggaattcgcacgagaccattacctagaacatcctaatcaaaaaagcaccgtccacctccaccatctttcctcttcctcctcgcctccaccccttcccttccatctcctcccacccggcgactcctcttcctctctgccgcgccgatcgattggcccacccatcgatcgagcacggggaagaagattccagtccggagtggtttcaattcggtcgggttcgttgcccgtgtgggtgggcgctatggcggcgatggatgcctcggcagataagaacgccgtcttccgcaagcttcgcgccaaatcggacaacaagatgtgctttgattgcaacgccaagaacccgacgtgggcgtccgtcacctacggcgtcttcctctgcatcgactgctcggcggcgcaccgcagcctcggcgtccacgtctccttcgtcaggtcaacaaatttggattcatggactccagaanncactgaaatgatggtctatggcggaaataccgtgcgncagctttctttaagcagcatgggtggacagatggtggaaaaaatgagcaaagtatactttcagagctgctgacttgtaccgacagntgcttgctaaaagacgtgctaaaagctctacagaaga

SEQ ID NO: 33169 - protein, 110 aa, Zea mays
  misc_feature: Ceres CLONE 1410720-F
  misc_feature (11)..(110): Pfam Name: ArfGap Pfam Description: Putative GTPase activating protein for Arf
  misc_feature (75)..(75): Xaa is any aa, unknown, or other
MAAMDASADKNAVFRKLRAKSDNKMCFDCNAKNPTWASVTYGVFLCIDCSAAHRSLGVHVSFVRSTNLDSWTPEXTEMMVYGGNTVRQLSLSSMGGQMVEKMSKVYFQSC

SEQ ID NO: 33170 - DNA, 712 bp, Zea mays
  misc_feature: Ceres CLONE 1410732-F
  misc_feature: Encodes the peptide sequence at SEQ ID NO. 33171
  misc_feature (630)..(630): n is a, c, t, g, unknown, or other
  misc_feature (651)..(651): n is a, c, t, g, unknown, or other
  misc_feature (670)..(670): n is a, c, t, g, unknown, or other
caaagctggagctccccgcggtggcggccgctctagaactagtggatcccccgggctgcaggaattcgcacgagaccattacctagaacatcctaatcgaaaattctgcccgcttggagtccccgtcttcgtcgtcttgtagtagcactgagtgcgggagtactggccggccggcggcgaggctcctccactttctctgcacccatacatacgtatatgcttgttctccgccgtctccgcctccgcctcccactgccacgccctcttctcgtctcctccttctcctccacctccccctcctcctcaccctcgacctctagctcctcctcctgttggtcgtcgacaggcgaaagtagaagggccatggcgtcatctccttctcccgattcggccgcggtcgttgccgagggctccgcggctcgccgcttctggatcgctgcctccacgcgcgaggccgccttcgccgcatacacgcccttcctcctctccctcgccgccggcaatctgcgggctcaacgtgtttcgccactacatcgcgcaggacgcgcacttccttcacgccttcgctcgcgcgtacgaaatggccgaggactgcgctgatgatgacgacgacatggccaccatagccgncctcaggaaggccatcctccnagagctcacctccactctncgttctgagggagaaggggggaagtgatcctaccaagagata

SEQ ID NO: 33171 - protein, 38 aa, Zea mays
  misc_feature: Ceres CLONE 1410732-F
  misc_feature (17)..(17): Xaa is any aa, unknown, or other
  misc_feature (24)..(24): Xaa is any aa, unknown, or other
MAEDCADDDDDMATIAXLRKAILXELTSTLRSEGEGGK

SEQ ID NO: 33172 - DNA, 724 bp, Zea mays
  misc_feature: Ceres CLONE 1410733-F
  misc_feature: Encodes the peptide sequence at SEQ ID NO. 33173
aaagctggagctccccgcggtggcggccgctctagaactagtggatcccccgggctgcaggaattcgcacgagaccattacctagaacatcctaatcgaaaaccccgtccctccactcctcccgtcgagcacttggcactgccaatggcggcagccgcccacaccccttcgatgcgtgcaagccgcctcctttcctcctgagatcgacgcacctcctcctctcgtactccattcccgctccaagtttgtttcttcggcaccgagccatcgcacggccgcccccgcatctcgtcctgctctcaggtccctgggctcccgcgttcctcgacaggggcgcgaccccgtgcccactccgcgaaatccaagtccctcgtgcagctccgaaaggtggaagaaaacccatcaggcggggaacggtaggagggcccccaacaactgagggggcggccaatggcggccggggaaagccccctctgcacggggtctctttcccggggttttttcttcggttttggaaccccaaaaactacaacctttaaaatttgcttcccccgggggaaaggcggctttgggggggggtatattttttcgggccaagccccccccccccctggggggggggggggacccggtttttgcgcccccccccaaaaagggcatagggcgctcgcccccctcacaaccgcaaaaaaaaaggggtctcttaaaaaaaaacaaaaccccc

SEQ ID NO: 33173 - protein, 91 aa, Zea mays
  misc_feature: Ceres CLONE 1410733-F
MAAGESPLCTGSLSRGFFFGFGTPKTTTFKICFPRGKGGFGGGYIFSGQAPPPPGGGGGPGFCAPPQKGHRALAPLTTAKKKGSLKKKQNP

SEQ ID NO: 33174 - DNA, 695 bp, Zea mays
  misc_feature: Ceres CLONE 1410736-F
  misc_feature: Encodes the peptide sequence at SEQ ID NO. 33175
  misc_feature (695)..(695): n is a, c, t, g, unknown, or other
aaagctggagctccccgcggtggcggccgctctagaactagtggatcccccgggctgcaggaattcgcacgagaccattacctagaacatcctaatcgaaaaaatcgaaaccaacagtgaatcagccggcgccgcagcatgcctgtacctctcggctctcgctcttatccccacccacctcgctttctcccctctacaagaaagcgaccaccgctgtgaatcagcagagctgcagtgagagcaagtgagaggatcagaggaggcatccgtgaccaaagatcgagtagccaagaagaagagagatgaacgccgacttcggcgcgcccaaggagctcgcgggaggcctgcagcagcggcgggccctgtaccagccccgcctcccgccatgcctccagggaccgacggtaagggcgcagtacggtgacgcgaccacaaccatcgatcccacctgtgcccaagccgtcgcgcaggccttcccgcacacctttggccagccgctcgtcagcttcgtcgcgccggccgccggcgccggcgccgttgaggagcgccacccgatcagggtgggcgtggtgttctctgggaggcagtcgccgggagggcacaacggcgtctggggcctccatgactcacttaaagcctacaatcctcagagcttgctctacggattcgtcgggggcacggagggactgtttgcn

SEQ ID NO: 33175 - protein, 131 aa, Zea mays
  misc_feature: Ceres CLONE 1410736-F
  misc_feature: SWISSPROT Homolog: EC 2.7.1.90 Diphosphate--fructose-6-phosphate 1-phosphotransferase
MNADFGAPKELAGGLQQRRALYQPRLPPCLQGPTVRAQYGDATTTIDPTCAQAVAQAFPHTFGQPLVSFVAPAAGAGAVEERHPIRVGVVFSGRQSPGGHNGVWGLHDSLKAYNPQSLLYGFVGGTEGLFA

SEQ ID NO: 33176 - DNA, 915 bp, Zea mays
  misc_feature: Ceres CLONE 1410737-F
  misc_feature (1)..(1): n is a, c, t, g, unknown, or other
  misc_feature (16)..(16): n is a, c, t, g, unknown, or other
  misc_feature (29)..(29): n is a, c, t, g, unknown, or other
  misc_feature (30)..(30): n is a, c, t, g, unknown, or other
ncccttcacccccccnccccttccccccnnacacgtgggggcaaattcaaaactgggactcaccgcggtggcggccgctctagaactagtggatcccccgggctgcaggaattcgcacgagaccattacctagaacatcctaatcgaaaaattcaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtgcggcgctgcagctcccgcctgggttccgcttccaccccaccgatggagagctgggtgatgcattatcccctccgcaagtgcggagccctggccgctcgccggcgcgggtcatcacccgagggtggatcttctacaagccccgaacccatgggccacctctccagaaaaaaggccccccgggtgggggaagaagggactggggaaccttcctgtttcccacagggggggacccgaaaagggaacccgcgaaagggcgcttccagttgcctcataaggccgggaggggtccccgggaacaaaggggtccactctgggcacaaggccctacccgggtatcgccgcgatccagagctccggggtaaggggattcccccccgtcgcgcccgcccggggggccatatccatagaaaaggggccccttctgttctcgtcctaaccagccgcgggtaaaacacccttcccacaagggcgctcccacaggcaccacaatgtggtgaactaacgggaacaaaaagaacaacgcacgccggggaggaatagctttatatacgcagcccctaaaccgccccgcaattcacataataaaggtacacgagcgaactgggacgccgtcgggggtcggg

SEQ ID NO: 33177 - DNA, 836 bp, Zea mays
  misc_feature: Ceres CLONE 1410740-F
  misc_feature (12)..(12): n is a, c, t, g, unknown, or other
  misc_feature (21)..(21): n is a, c, t, g, unknown, or other
  misc_feature (28)..(28): n is a, c, t, g, unknown, or other
  misc_feature (32)..(32): n is a, c, t, g, unknown, or other
  misc_feature (35)..(35): n is a, c, t, g, unknown, or other
  misc_feature (836)..(836): n is a, c, t, g, unknown, or other
gggccccttctnccccccccnccccccnatgnaantctcctttttttcaaaggtggagctccccgcggtggcggccgctctagaatagtggatcccccgggctgcaggaattcgcacgagaccattacctagaacatcctaatcgaaaacctccccatcgcgtctgtccgctacccctccccgaccagatcgctacgagacgccgcgcgatccgacccagggccgacgccgacgacccctctcgccgccggcggccatggcgtacggcgaccgcgtcaccaccttcgaggactccgagaatgagaggcgagtacggctatgtccgcaaggtctctggacctgtggttgtggctgatggcaatgggtgctgctgccatgtatgaccttgttcgtggcgggacatgatacccctcatttgggggaaaatttatgccggcttgggaggggcgattcagcttacaatccccaggtttatggaggaaaacagcttggacctggagggtaattggacccctggatttgaagaacaaaaaaagcccctctttttcaggttggaagttgggggaccctgggaaatttctttgggaaaacatttttttgcgaccggagattcccggcggaaccttctaaaaaaacccatcggttattaaaggtccagggagaatggggaaataatccccccggcggggggcttccaactccccggccccttggaccaaaaatgcgattcggggggaaattttccccccaacccgaaacctaagggggctgggaaaaaggctattccacacgggggggagatctatttccccctcctggtttttgagaaaaaccgn

SEQ ID NO: 33178 - DNA, 721 bp, Zea mays
  misc_feature: Ceres CLONE 1410743-F
  misc_feature: Encodes the peptide sequence at SEQ ID NO. 33179
  misc_feature (308)..(308): n is a, c, t, g, unknown, or other
  misc_feature (470)..(470): n is a, c, t, g, unknown, or other
  misc_feature (487)..(487): n is a, c, t, g, unknown, or other
  misc_feature (500)..(500): n is a, c, t, g, unknown, or other
  misc_feature (522)..(522): n is a, c, t, g, unknown, or other
aaagctggagctccccgcggtggcggccgctctagaactagtggatcccccgggctgcaggaattcgcacgagaccattacctagaacatcctaatcgaaaaatcaagttttgtagtgttgttagtgtttctaccgtatgtctgatttgtactttattagtacttaagtctgtctttgagaaatataagatactagtctgttcactgaagaatgtggccttaaacactagtttgatttcagggtggttatgttctttatcgcctcttctggaaaccagaggagaaaactgtgcgctccagcccagaanaaatggatagaagtggcaactcgcctactactccccgttcttcacgtgacaaccaagaggcgaatgaggaaagctatacaccattaaataagaaatctctagaatctgctctgcatgatccgattgagctgcccaattctgctgaaaccccctgctgggccnaggaaatgtgcctggcngacagaaatgatnatttggtggctactgcacccgntggttccatatacctttccggggaatgctgctggggaactaagcttgatccttcaggtggtgttacagcccctttcgtttatccccaaaagggaattgccacggccacattttttggctggtttcccccccttttaccccttgaaaaggcatttttcggggggaccaaaaaaaaattttttggttttggaggaaagggc

SEQ ID NO: 33179 - protein, 137 aa, Zea mays
  misc_feature: Ceres CLONE 1410743-F
  misc_feature (54)..(54): Xaa is any aa, unknown, or other
  misc_feature (64)..(64): Xaa is any aa, unknown, or other
  misc_feature (71)..(71): Xaa is any aa, unknown, or other
MDRSGNSPTTPRSSRDNQEANEESYTPLNKKSLESALHDPIELPNSAETPCWAXEMCLADRNDXLVATAPXGSIYLSGECCWGTKLDPSGGVTAPFVYPQKGIATATFFGWFPPLLPLEKAFFGGTKKKFFGFGGKG

SEQ ID NO: 33180 - DNA, 619 bp, Zea mays
  misc_feature: Ceres CLONE 1410747-F
  misc_feature: Encodes the peptide sequence at SEQ ID NO. 33181
  misc_feature (371)..(371): n is a, c, t, g, unknown, or other
  misc_feature (519)..(519): n is a, c, t, g, unknown, or other
cgctctagaactagtggatcccccgggctgcaggaattcgcacgagaccattacctagaacatcctaatcgaaaaagagcagccgacaactctctaccgtccgagaccccaagcaccagcgcggcggcggcggcggcggcgaccatggctgtcgggaagaacaagaggatctccaagggaaagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggagncgcgaagaagttccagtctgctgcttactccaactgcgcaaagaagccatcctgatatcccttttggcttcctcgttctagtaggttaggatttcttttctgacacttcgattcttaccaatccccctggcctgctgctttcctgacnatcgaccagttccccagtctggctccctgcagtcctccctctccatctcccgggttgtgttctgactcactgcaccaatggctgttctttctgctgctgg

SEQ ID NO: 33181 - protein, 50 aa, Zea mays
  misc_feature: Ceres CLONE 1410747-F
  misc_feature (1)..(50): Pfam Name: AdoMetDC_leader Pfam Description: S-adenosyl-l-methionine decarboxylase leader peptide
  misc_feature (33)..(33): Xaa is any aa, unknown, or other
MESKGGKKSSSSRSMMYEAPLGYSIEDVRPAGXAKKFQSAAYSNCAKKPS

SEQ ID NO: 33182 - DNA, 691 bp, Zea mays
  misc_feature: Ceres CLONE 1410752-F
  misc_feature: Translation starting site: 232
aaaagctggagctccccgcggtggcggccgctctagaactagtgtatcccccgggctgcaggaattcgcacgataccattacctagaacatcctaatcgaaaaaccctcccccaccgccattgctcagcagcattagtaaagccacgcctgacacacagctggttcatttctggttgctgccttgctggaggtagccctcggagtacgcagccaagaacagagagagcgagatggatgtgaacgacctgctgctagtggtgctggcgacgaccctgtctgccatgtggtggagtcggtgctccaagaccggcgttgtcacacggcctcccgccggagcctcccgattggccggaggtggtgaacctgttccaggtgatcctgcagcgacggtccttcatgtacgtggtgcgctacctccggtagaagtacggccccatcttcaccatgcagatggtgcagtcaccctcatcgtggtcacctcggcggagctcatccacgaggcgctagctgaatcaaggtcccatgttctcgagccggcccgaggacagacccacccgcctcctcttcaacgtatgctagagcaccgtcaactcggcgacctacggtccctctgtggcgtgctctgcgccgcaacttcgtacaccgagatcgtgtccacgcaccgcatcaagggcttctcctggtatcggg

SEQ ID NO: 33183 - DNA, 656 bp, Zea mays
  misc_feature: Ceres CLONE 1410754-F
  misc_feature (223)..(223): n is a, c, t, g, unknown, or other
  misc_feature (255)..(255): n is a, c, t, g, unknown, or other
  misc_feature (656)..(656): n is a, c, t, g, unknown, or other
aaagctggagctcaccgcggtggcggccgctctagaactagtggatcccccgggctgcaggaattcgcacgagaccattacctagaacatcctaatcgaaaagaagaaagctgccggcctgccgctgcctgctcgcagttgccagcccccgccgccgcggaggacggaaggaagcgaaatcaacgcgactgtctccgacggggaataaagcagcgaaggcagncggtcgcggaaccccccattctcagctgcggncggcgatcgagtccgttcccgtcccgcggcgatgcggatcccgcgggggaaggggggggcccggccgctcccttgtcggggtggcccacaaggggggggaaagtttccccggtccttccgctcccccgaatggtgggggggttcccgggtttaaaaaaaaaacccaaattcgcccccttctttgggaaggaccgggggccccaaagaagttaacccaagctccctcccttttaaaaggggccaccctgggtcccccaaattttcaaaaaaaaaaaagggcggggggccgcggccccgggaaaaaaaaaaacagggcgccgggaaaaaatgggaaaaatatggcgaaattatcccccccctggaaaggggaggaaaagaaatataaggaaggccccttttan

SEQ ID NO: 33184 - DNA, 709 bp, Zea mays
  misc_feature: Ceres CLONE 1410760-F
  misc_feature (1)..(1): n is a, c, t, g, unknown, or other
  misc_feature (503)..(503): n is a, c, t, g, unknown, or other
  misc_feature (504)..(504): n is a, c, t, g, unknown, or other
  misc_feature (642)..(642): n is a, c, t, g, unknown, or other
naaagctggagctccccgcggtggcggccgctctagaactagtggatcccccgggctgcaggaattcgcacgagaccattacctagaacatcctaatcgaaaaatcctcccccaccgtcattgctcaacagcagtagaaaagccacgcctgacagacagttggttcatttctggctgctgccttgctggtggtagacctcggcgcaggcagccaagaacacagagagctgagatggatgtcgacgacctgctgctagtggtgctgtctgcgtttctcgctgccatgctgtggcgtcagtgctcaagaccggggtgtcgatcgcctcccggcgggcctcagggttggcgggggggggacctgttcaggtgatctggcggacgcccttatgaaggttgggccacctccggaaaaatcggcccttttcaaagggggggggggggcccctttttgggacctcgcgggtatttccaggggtgggaaaaggccccatttgtaacggggnnaaaaaacccccccccccctttttggggggagggggtatattttggggcacccccccgggggggggggtgggccatttttgggaagagggtcccccccccccggggggttttttttttttggggggggggggggggggntttccccccccccccctttggggggggggggggggggggggggggaaccccccccccccccccccct

SEQ ID NO: 33185 - DNA, 719 bp, Zea mays
  misc_feature: Ceres CLONE 1410761-F
  misc_feature: Encodes the peptide sequence at SEQ ID NO. 33186
  misc_feature (489)..(489): n is a, c, t, g, unknown, or other
aaaagctggagctccccgcggtggcggccgctctagaactagtggatcccccgggctgcaggaattcgcacgagaccattacctagaacatcctaatcgaaaagatccgatggcccgcgccgccgctcgcctcctccccatcttcctcccatggcggcgtcctcccccgccctgcctcctccgccggggcttcctaaaccctagcagccccagaacctccgcgcgcgtcgacaccctcgttctccctggagacgagcgcttgcccttcccctcgcccccacgcctcccgaaccagctgcgtcctgactacgggagtggcggcggaggcggcgctccctcgaccatcgcggccatcgtcacctcactcggcggaggccctgcagcggtggggatcgtgcggatctcggccccgatgccgtcgccgtcgccgaccgcgttttccgccccagcgggacccagagggcgtcgacgccgtgggcaccgcgcagncacttttgttgagtacggactcgcgctcgacgcggacgcagcgttatggacgaggggttttggtgttggccattgttctcccccgagtcctaaccgggaaaaggatgttgggggagcttccaggcatgtggaacaatttttgtttggccccggggctcagggtttgcttggaaatttgaacccaactggttaacccgggggaatcccccctttgggtttctgaaaggggg

SEQ ID NO: 33186 - protein, 190 aa, Zea mays
  misc_feature: Ceres CLONE 1410761-F
  misc_feature (127)..(127): Xaa is any aa, unknown, or other
MARAAARLLPIFLPWRRPPPPCLLRRGFLNPSSPRTSARVDTLVLPGDERLPFPSPPRLPNQLRPDYGSGGGGGAPSTIAAIVTSLGGGPAAVGIVRISAPMPSPSPTAFSAPAGPRGRRRRGHRAXTFVEYGLALDADAALWTRGFGVGHCSPPSPNREKDVGGASRHVEQFLFGPGAQGLLGNLNPTG

SEQ ID NO: 33187 - DNA, 676 bp, Zea mays
  misc_feature: Ceres CLONE 1410762-F
  misc_feature (261)..(261): n is a, c, t, g, unknown, or other
  misc_feature (265)..(265): n is a, c, t, g, unknown, or other
  misc_feature (269)..(269): n is a, c, t, g, unknown, or other
ggagctccccgcggtggcggccgctctagaactagtggatcccccgggctgcaggaattcgcacgagaccattacctagaacatcctaatcgaaaaacgctcgtggcaccgcactcactccgaatcctgaagcaacaaacaccagaagcgcaccaactccccaaccaccggagaccgcaccccagcaaaggatggcatctgactccacggccgccgtgacggtggacggcagcgcgctgcgggcgccgcgcttgcccgcgncggncacncggcacatggtccggggtggtgggcatccccgtcacctccctcggcgtccgtgccggcgggggccggggtccgcttcctccgttttcggaaacgagaagtccccggggggtacccccgcccgccgcctacgggtttcctaacggggtcccccggggggccctaatcaccggtttccggccccaggaagggtccaccggggttccggggggcttttcccaggccaacggaaaacccgggggggggttccccaggatatcccgggaacctgggaaaaaggggggaaaccccggagggggcaacattccagggggcccaaaaaaaaaccccccccacaaaaacccttccccaaattccgcggggaaaaggaaaaaaaactttggcccaaattccccgggccttcttgttt

SEQ ID NO: 33188 - DNA, 721 bp, Zea mays
  misc_feature: Ceres CLONE 1410763-F
  misc_feature: Translation starting site: 187
  misc_feature (327)..(327): n is a, c, t, g, unknown, or other
  misc_feature (328)..(328): n is a, c, t, g, unknown, or other
  misc_feature (498)..(498): n is a, c, t, g, unknown, or other
  misc_feature (521)..(521): n is a, c, t, g, unknown, or other
  misc_feature (571)..(571): n is a, c, t, g, unknown, or other
  misc_feature (660)..(660): n is a, c, t, g, unknown, or other
  misc_feature (702)..(702): n is a, c, t, g, unknown, or other
  misc_feature (721)..(721): n is a, c, t, g, unknown, or other
tccccgcggtggcggccgctctagaactagtggatcccccgggctgcaggaattcgcacgagaccattacctagaacatcctaatcgaaaaacgctcgtggcaccgcactcactccgaatcctgaagcaacaaacaccagaagcgcaccaactccccaaccaccggagaccgcaccccagcaaaggatggcatctgactccacggccgccgtgacggtggacggcagcgcgcttgcggggcgcgcgctggccgcggcgggcacgcggcacatgttctggggtggtgggcatccccgtcacctccctcgcgtcccgtgccgccgcggnncgggtccgcttcctcgctttccgcaacgagcagtccgcggggtacgccgccgccgcctacgggtttcctaaggggccccccggacgccctactcaccgtctccggcccaggaggcgaccacggggttcgcggggcctctccccaggccaccggccaacccccgggccggntcctccatgaatctcccggatcntggaaaatcagggctgaacgcccggcaagggggcgaacttcccagggagnctccaaccaggaagcgccggacaacataaacgccctttccgcaaaaggtcggcaagttaaaaggcaaaccaacccattccgccgcgacnttccccgggggccctgcggtactacacaaagaaccacaacgncggatccgaccgaggtaan

SEQ ID NO: 33189 - DNA, 731 bp, Zea mays
  misc_feature: Ceres CLONE 1410764-F
  misc_feature: Encodes the peptide sequence at SEQ ID NO. 33190
  misc_feature (262)..(262): n is a, c, t, g, unknown, or other
  misc_feature (301)..(301): n is a, c, t, g, unknown, or other
  misc_feature (316)..(316): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (365)..(365): n is a, c, t, g, unknown, or other
  misc_feature (377)..(377): n is a, c, t, g, unknown, or other
  misc_feature (378)..(378): n is a, c, t, g, unknown, or other
  misc_feature (380)..(380): n is a, c, t, g, unknown, or other
  misc_feature (419)..(419): n is a, c, t, g, unknown, or other
  misc_feature (431)..(431): n is a, c, t, g, unknown, or other
aagagctggagctccccgcggtggcggccgctctagaactagtggatcccccgggctgcaggaattcgcacgagaccattacctagaacatcctaatcgaaaacgaaaaattcgaaagatccctccaggaaagatttttcttccctcctccgacgccccagcccaccaacacactctataaagcagccctcagtcacacacagaacgcacaagcgcaagccgggcaagaaaactccgtaggccagtctgcgagttggatggncttcttcttggccctcgtgtgcatcctcatcttgctagncatcgcctcctacgntcagtacactcgctggcaaaaggggaaaggcnnngcttcgcggcatggnaggtctgctccnntngagctgcctcctggttccatgggctgggcttaccttggnaagaccctcagnttaacctccaagacccagtttctttttcgtttccaaagaaaaaaggaccggggaaattttaaaaacccccttggggttcccccggggggaaggttggaaacccagaggggggggggttcgggtgggggaccaagggcccctttttaaccccccccccccccgaaaaaaggggcaaataattgcccccttttttttcttttatcccggggggaacaccccccctccccccaaaaatttacggggggggttcccccccaaaagggggggggggttttttataaggaggggccgccccccccc

SEQ ID NO: 33190 - protein, 106 aa, Zea mays
  misc_feature: Ceres CLONE 1410764-F
  misc_feature: SWISSPROT Homolog: EC 1.14.13.93 (+)-abscisic acid 8'-hydroxylase
  misc_feature (2)..(2): Xaa is any aa, unknown, or other
  misc_feature (15)..(15): Xaa is any aa, unknown, or other
  misc_feature (20)..(20): Xaa is any aa, unknown, or other
  misc_feature (31)..(31): Xaa is any aa, unknown, or other
  misc_feature (41)..(41): Xaa is any aa, unknown, or other
  misc_feature (58)..(58): Xaa is any aa, unknown, or other
MXFFLALVCILILLXIASYXQYTRWQKGKGXASRHGRSAPXELPPGSMGWAYLGKTLXLTSKTQFLFRFQRKKDRGNFKNPLGVPPGGRLETQRGGGSGGGPRAPF

SEQ ID NO: 33191 - DNA, 635 bp, Zea mays
  misc_feature: Ceres CLONE 1410775-F
ccccgcggtggcggccgctctagaatagtggatcccccgggctgcaggaattcgcacgagaccattacctagaacatcctaatcgaaaaaacagcttggaagcagtaagcacgcatcgccgctccccatctcccccgcaccgcgcacctctatggccgccggcgaagggcggagtggggacatcggcgccgactcggagcggcgccggaaaagctatggatagctctaccacttccccagcccaagtcgagtacaccgggtggttccaggccttcttcgtcgacctcggctcaagctccggagaggggggggggaaaaagccccgccggagcccccaggaggttcccgggggggggggggggttccggactcccgaaaaaaaggggggccagggaaaagaatttccccccccccggccgggggcccccgggggaaccggcccacccctaggggggggttgggggtattttaaaacaaggagacggggttcccccaccccggggttttttttcccccctaaatggggggaaaaaaaggggggcataaatttggggggggggggttttaaaagggggggggggggggggggaaaaaactccgggtgtcccccaccccttcccgggggggaaaaaagg

SEQ ID NO: 33192 - DNA, 576 bp, Zea mays
  misc_feature: Ceres CLONE 1410779-F
  misc_feature (214)..(214): n is a, c, t, g, unknown, or other
  misc_feature (219)..(219): n is a, c, t, g, unknown, or other
  misc_feature (220)..(220): n is a, c, t, g, unknown, or other
  misc_feature (238)..(238): n is a, c, t, g, unknown, or other
ggagctccccgcggtggcggccgctctagaatagtggatcccccgggctgcaggaattcgcacgagaccatacctagaacatcctaatcgaaaaaccaccatctccagctccatccgcaccaacatctccaccaaccgacacggcgaggagatgaacgcgtcgcagttcatggacaaagcagatcctcggcctcgcggcctcgcctccccgtcngaagnngccgcggggggccgtggngtttggaatctcagcgatttgaagatcccgatcccccaggaggacggcggaggaccgcctccgtccccggggtaacagtaacagcggtaacggaacatcaaaggaaatggtacccagctaccatttcccacccgatccgaccgggggcgcccccgccgccgcccccggtgtttcaggcctcggggggattcctccaactccaaggaaacctcccgcctttggctttgccctccccgcccgccttatacaacccccaagaggggttgggttaatttggaacccccctggggcttaaaaaaaagtttttcctggggggaaaaaaacgattttaactttcc

SEQ ID NO: 33193 - DNA, 713 bp, Zea mays
  misc_feature: Ceres CLONE 1410785-F
  misc_feature (363)..(363): n is a, c, t, g, unknown, or other
  misc_feature (378)..(378): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
caaagctggagctccccgcggtggcggccgctctagaactagtggatcccccgggctgcaggaattcgcacgagaccattacctagaacatcctaatcgaaaagacgagaaaaccccacagcctgcacctcggggacgccggcgcggagggatggagtgccacgccctacagtgatttctcccccgctccgatccccggcgcatgaccgggtcggctggcctatgcatcgcagcaggagttgtcgtcgattgcccctgcctgccccagttaatccccgcccggtcgcaatccagtattagaggcgccgatctcctgccccgtcctgccctgtggattatcgacagcggcgccggataccacgnaagagaaggaagacnaggaaggnnngcgaactaacttgctttgtgcggggcaaggacgagatcgagggcagccgagccggtacccgaactctaggcgagattgcaagtgcaattccccacataagaggataccccatgaatccggggggttctccaaaggaaagacttaaattctgtaacaaaggtggctttttccggaatcttccctggggttttaaagacaaaattttcttggtggtttggccaaaaaaaaaagttttaaaaaattttccttctgttcagggaaaagggggggacccacgggggtttcagagggggggaattgggtttcaaaaaaaaaattttttttt

SEQ ID NO: 33194 - DNA, 728 bp, Zea mays
  misc_feature: Ceres CLONE 1410786-F
  misc_feature: Encodes the peptide sequence at SEQ ID NO. 33195
  misc_feature (386)..(386): n is a, c, t, g, unknown, or other
  misc_feature (439)..(439): n is a, c, t, g, unknown, or other
  misc_feature (463)..(463): n is a, c, t, g, unknown, or other
caaagctggagctccccgcggtggcggccgctctagaactagtggatcccccgggctgcaggaattcgcacgagaccattacctagaacatcctaatcgaaaactccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggccccggccacatccaagccgccgcctccggccccggncacacccaagccgccgcctccggccccggccacacccaagccgccgccagcgnaggaaggaaagggcggtggcgcgntggtggaactcaccggcgtcccgcggagggttaacgtggagggcgcgcggctgcggacaaaacggggcacggagggtgtcgccaagcacgtgcgccagggggggccaaggttacggtggtttacttcccagggaaggcccccgaactcgggcaaaagtacaagatttttgttgagggttagggccaccctaaaggtaaacctagggggaaaacacaatctgggtatggggcaatcctgggggaacccggggacaaaaaccttttt

SEQ ID NO: 33195 - protein, 165 aa, Zea mays
  misc_feature: Ceres CLONE 1410786-F
  misc_feature (52)..(52): Xaa is any aa, unknown, or other
  misc_feature (70)..(70): Xaa is any aa, unknown, or other
  misc_feature (78)..(78): Xaa is any aa, unknown, or other
MGAVTSTVAARFAFFPPSPPSYGFEQPAPLPAPATPEPPAPATSKPPPPAPXTPKPPPPAPATPKPPPAXEGKGGGAXVELTGVPRRVNVEGARLRTKRGTEGVAKHVRQGGPRLRWFTSQGRPPNSGKSTRFLLRVRATLKVNLGGKHNLGMGQSWGNPGTKTF

SEQ ID NO: 33196 - DNA, 691 bp, Zea mays
  misc_feature: Ceres CLONE 1410791-F
  misc_feature: Encodes the peptide sequence at SEQ ID NO. 33197
  misc_feature (471)..(471): n is a, c, t, g, unknown, or other
  misc_feature (518)..(518): n is a, c, t, g, unknown, or other
  misc_feature (520)..(520): n is a, c, t, g, unknown, or other
cagagctggagctccccgcggtggcggccgctctagaactagtggatcccccgggctgcaggaattcgcacgagaccattacctagaacatcctaatcgaaaaaccaaaatgtaagaaaacgcacgccccggcgctggccgctagtcaccccaaagctccgcctccgcaccttctctcactcgcccagccgcggctatggcggccaccacatccacggcggcggcggcagtatccttctccctcccctcaccaccgcactgccgcggggcccggcgccgccgcgcgccttccctcctccgtgccgcctccaccgccgcgcccccctcccccgacctctccatccagctctcgccccgcgcgtccccgcccgcgtctaccaacggcgccgccaccgcgcttggaccccccgtgtccgcctcctttgcccgtgaccgcgccgaggacctgcaggccgaggcccgcgcgatggnccgcgccgctggcgccacagtctacagtcccgagctcctcggcgccngntacgggttcccgccccttcaagggggcgcctccggccaggggaggtgctgcccaaagttgcgtcgttccggggtgaaggtcctactggacaaacggaagaaggggaatcttcatccggaaaaggagggcgcccaaggggggggaaattgcgcaccattttaccaaggttcg

SEQ ID NO: 33197 - protein, 75 aa, Zea mays
  misc_feature: Ceres CLONE 1410791-F
  misc_feature (2)..(2): Xaa is any aa, unknown, or other
  misc_feature (18)..(18): Xaa is any aa, unknown, or other
MXRAAGATVYSPELLGAXYGFPPLQGGASGQGRCCPKLRRSGVKVLLDKRKKGNLHPEKEGAQGGGNCAPFYQGS

SEQ ID NO: 33198 - DNA, 709 bp, Zea mays
  misc_feature: Ceres CLONE 1410797-F
  misc_feature: Encodes the peptide sequence at SEQ ID NO. 33199
  misc_feature (657)..(657): n is a, c, t, g, unknown, or other
caaagctggagctccccgcggtggcggccgctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggccgggacagctgactagctgagaggcatggggatggacgccggcggcggcaagctgccgtacagctacgccggccagcaggacggcgggaagctggtgaagagcgtcagccgcgtggagccgcgcaggttcggcctgggcctcgtggcgggcttcctcgtcgtcacctgcgcctacttctccaccgccaagttcgacgccatccagatcgccatgaccagccgacccgtctccagcaatgcggctggcgtcggagtcggctcgctgggagtgggcgccgccgccgccgacacctccaacgcctccaggcagggattagatttgggcgcatgntccatggcccgagaggggagcgaggtcgaggcgctcgagaaagacggcggca

SEQ ID NO: 33199 - protein, 119 aa, Zea mays
  misc_feature: Ceres CLONE 1410797-F
  misc_feature (102)..(102): Xaa is any aa, unknown, or other
MGMDAGGGKLPYSYAGQQDGGKLVKSVSRVEPRRFGLGLVAGFLVVTCAYFSTAKFDAIQIAMTSRPVSSNAAGVGVGSLGVGAAAADTSNASRQGLDLGAXSMAREGSEVEALEKDGG

SEQ ID NO: 33200 - DNA, 704 bp, Zea mays
  misc_feature: Ceres CLONE 1410801-F
  misc_feature: Encodes the peptide sequence at SEQ ID NO. 33201
  misc_feature (647)..(647): n is a, c, t, g, unknown, or other
cagagctggagctccccgcggtggcggccgctctagaactagtggatcccccgggctgcaggaattcgcacgagaccattacctagaacatcctaatccaaaaagaggctggcgcacctgcgtcactcgctccgcgctgccgcgatctcctctgacgtcgaagtcgcccgggggatgacacagggggaaggggtggtgtgggaggggtgaacaggagctcggtgacttttgtgaggggcgcctgatggaggagcgccggctcgacacgccggcgatgaggagaatcactgagtggtatatacgttcctagcttctcctaccttccctcctgcggctccttgctctacttttcattaattggcatgtcgctgctgctgtttcgcatttgattcgacgagttcgtgtccgtaaccagggccgctgatagcttggtcagtccgattttgaactgaaaacaaacagctatcgtcattaagctagcaacacgcgacctgtgctttcagatcttcacgtcttttacccgctgaaccgctcgctctagccaaaccctgcaaatgaagttttgcggagtctgaggctggctcttgtgcttcgcttgattgttgcaggattctttcactagagttctcaagcgatattaccatccnagatgtggaggcgaccttcatcttgcacaagctcccgttgacatcgaggtgcggcta

SEQ ID NO: 33201 - protein, 58 aa, Zea mays
  misc_feature: Ceres CLONE 1410801-F
RAGAPRGGGRSRTSGSPGLQEFARDHYLEHPNPKRGWRTCVTRSALPRSPLTSKSPGG

SEQ ID NO: 33202 - DNA, 645 bp, Zea mays
  misc_feature: Ceres CLONE 1410805-F
tccccgcggtggcggccgctctagaactagtggatcccccgggctgcaggaattcgcacgagaccattacctagaacatcctaatcgaaaagtggtggtggagatggagtggacgcgttcatgcccgcgcctagctagctagcttacctgtccacgcctccgtgctgtgtcctcttggctttctctttcccgctctcctcctcgcttgccccccgccagctcgatctccagggagtggactagtgcagggagggagggaagaaaggagtggtgcagctgtgagtgaagccgcctctcgtttccttgattgattggagccgagccggaatgtgatgcgagagaggtgtgcagattaacaccgttcgcaggacacaactgagcaatcctctgaaggccaaacaccccctttcagttagccatctctgaaggaacatacaggctttttcataagatagtcatggcagagttcaagatcggtaggctggatgccccaccaccaagggtcagaaatgtgcccattgccgtcaccccgaaagggattctggtgctgcccatcacaggccgggctttcagaagacggcgaagaagcccaaacccagcagggcaggccttaaagggggaagcatccccctgcgcccttcaaag

SEQ ID NO: 33203 - DNA, 649 bp, Zea mays
  misc_feature: Ceres CLONE 1410818-F
  misc_feature: Translation starting site: 219
  misc_feature (235)..(235): n is a, c, t, g, unknown, or other
  misc_feature (238)..(238): n is a, c, t, g, unknown, or other
tccccgcggtggcggccgctctagaactagtggatcccccgggctgcaggaattcgcacgagaccattacctagaacatcctaatcaaaaaacggtttgcgtataaataagtagtcagtcgctcatcttgttccttgtgaacatcgcagtgctgtagcctccttcgtcttgagcgagcatggagatgtcagccatggaggaagccctcccagggcgggatgaagaggagaaaggnagncctcagaaccattccgttcatcatcttaaacgagatattcgagaaggtgcccacgttcggactgtcatccaacatgatcctgtacctcaccgagcgggatctcatgaccaacgtctttgccaccgtcgtcctctacttctggtgatgcttctacaacttcctgcccatcttaggcgccgtgctcgccgacgcccgcctcgggccggttccgggtcatcaccctcggctcctgcgttagcctccttcgggatgtgcctgttgtggctgacggcgatcctttccggagacaagaacaccccggaatgcgcgccggggcgggccggaagggttgccgcggtgcttgccaagaaagctgccgctcctctttacgaacgttggggtcatgtcccctcggggggggggggtatccgg

SEQ ID NO: 33204 - DNA, 669 bp, Zea mays
  misc_feature: Ceres CLONE 1410820-F
  misc_feature: Translation starting site: 186
  misc_feature: Pfam Name: PCI Pfam Description: PCI domain
  misc_feature (307)..(307): n is a, c, t, g, unknown, or other
  misc_feature (315)..(315): n is a, c, t, g, unknown, or other
  misc_feature (344)..(344): n is a, c, t, g, unknown, or other
  misc_feature (349)..(349): n is a, c, t, g, unknown, or other
  misc_feature (425)..(425): n is a, c, t, g, unknown, or other
  misc_feature (515)..(515): n is a, c, t, g, unknown, or other
  misc_feature (523)..(523): n is a, c, t, g, unknown, or other
aaagctggagctccccgcggtggcggccgctctagaactagtggatcccccgggctgcaggaattcgcacgagaccattacctagaacatcctaatcgaaaaagcgaaaggacgcacgaaccccaggaggcaccgtctccaaagtccaaaccctaaccctagcgcccccaactcgtcgccgggagatggccatggacgcggagcggcggcaagcggagctgatcgcgcagttctcctctcaggcggtggctctttcgtccgcgcagcagctcgccgctctggtgctcgaggccacctcccacccggncctcttcngcttctccgagctcctcgccctccggccntctcnatgctcgctggcactcagtactcgtcttcactggacttgctccggctcttcgcctatggcaccttgaaggactatnagaattaattggggatcccttccagcattgttggcctgatcagggtccgaaagctaaagcaaactcagtgtgctaacttcctggcagagntcactaangatactaccatatgatcagctcatgcaaaaagaatttggatgttttccaacgtagaaaaaacctcgaagattttctaaatcaatgagtggatggggatttccgggtatcgtcagaggcaaattggatccccccctgagaagaaatt

SEQ ID NO: 33205 - DNA, 636 bp, Zea mays
  misc_feature: Ceres CLONE 1410822-F
  misc_feature: Encodes the peptide sequence at SEQ ID NO. 33206
  misc_feature (226)..(226): n is a, c, t, g, unknown, or other
  misc_feature (251)..(251): n is a, c, t, g, unknown, or other
  misc_feature (254)..(254): n is a, c, t, g, unknown, or other
  misc_feature (257)..(257): n is a, c, t, g, unknown, or other
  misc_feature (260)..(260): n is a, c, t, g, unknown, or other
  misc_feature (284)..(284): n is a, c, t, g, unknown, or other
tccccgcggtggcggccgctctagaactagtggatcccccgggctgcaggaattcgcacgagaccattacctagaacatcctaatcaaaaaaccaggcaagcaagcgggagccgccaactcgtgcctctcggcagcggcgtctgaactctgaaccgaccgaccgaccgaccgttccgttccgttcacccaccatggaggcgccgccgggaccggggcccatggagntggacgccccacctcccgccgccgncgncgnggngattccctccgccggcagcacganccacaagggaacggggaaagggggagacgctgtgacgggccatatcatcctccacaccatccggggggaagaacggcggagcccaagggaaccattcagttacttgggaaaaacgtggtccgggggcccagggctcattttgggaatcggctttccagggtttagggggcttggaaaaaaggaaaaaacctttcccctctaaaaaagggggttgaaaaaatcggggtttacaaaaaaccggggagttggaaattttttggggggccagggaaacccccccaggtttttttggtgggagaaaattgtttttcttctccaaaagaggagggggggaaaattttgtttttaaaac

SEQ ID NO: 33206 - protein, 97 aa, Zea mays
  misc_feature: Ceres CLONE 1410822-F
  misc_feature (12)..(12): Xaa is any aa, unknown, or other
  misc_feature (20)..(20): Xaa is any aa, unknown, or other
  misc_feature (21)..(21): Xaa is any aa, unknown, or other
  misc_feature (22)..(22): Xaa is any aa, unknown, or other
  misc_feature (23)..(23): Xaa is any aa, unknown, or other
  misc_feature (31)..(31): Xaa is any aa, unknown, or other
MEAPPGPGPMEXDAPPPAAXXXXIPSAGSTXHKGTGKGGDAVTGHIILHTIRGEERRSPREPFSYLGKTWSGGPGLILGIGFPGFRGLGKKEKTFPL

SEQ ID NO: 33207 - DNA, 644 bp, Zea mays
  misc_feature: Ceres CLONE 1410823-F
tccccgcggtggcggccgctctagaactagtggatcccccgggctgcaggaattcgcacgagaccattacctagaacatcctaatcgaaaaatcctctcttcatactatctaccacaactagttgccagagttcgtcatggacttctacaaagagttcgtggagacttcgtccgatgacgattccgaagactgaggtcgacactcgacaccatgtacgtttagcaagcccttgagcaactaggtgttggaggttcgagcgggcgtcgtagacgctcttccttgccacgtctagtaatccatagggatcacagtgctagcgaaaaatctgataaagctccactacttcggtccaaatcctgtctatcccgcccacattttccaacgaaggtttcggatgcagcggccttttgtcctgcgtatccttagaggtgtgcagcaagtggacagatttttttactgttaggtgtgatgctacgggtttagcgggggctcggtcggttgcaaaaagctctgctggctttgcggcctccccatatgggttggctacggatgctggccatgataacattcaaatcggacaaactaccggctagggactggcctcatccggtttctgccatgcaaatcattctcatgctacggc

SEQ ID NO: 33208 - DNA, 628 bp, Zea mays
  misc_feature: Ceres CLONE 1410824-F
  misc_feature: Encodes the peptide sequence at SEQ ID NO. 33209
tccccgcggtggcggccgctctagaactagtggatcccccgggctgcaggaattcgcacgagaccattacctagaacatcctaatcgaaaactactgtaggccgctgctgctcctctcctcccatctcaccacacaccgcagccccagcaagatcgcgcggaggccatggcgaagcccaagccttcctccgccggcgccagccgaccgcgcctgcgccgccggttacagtgcactcggcggtggtcacctacacctccatgctcggggtcctgtccctctggcccgcccttcgtaatcctcctggggaaaaccatggtgaacccggaccgaaccttggggcgggactttaagagcacccccaggggaccccggggggcttcgaaggggtaaaggccatctgggccaagccccccccccgggggggggaaaaaactcttttggtttcggcccctcgaagggcccctaaaagttgggggcccctggaaaagcttttaaaggcccctttcccccgcgggaaaagggccgggtaaaagaggaaggggttaaaaagataagggggggccctgaaattacctggggggggggggggggccccaaaaataaccccccaaaaaaggaggacccccg

SEQ ID NO: 33209 - protein, 74 aa, Zea mays
  misc_feature: Ceres CLONE 1410824-F
MAKPKPSSAGASRPRLRRRLQCTRRWSPTPPCSGSCPSGPPFVILLGKTMVNPDRTLGRDFKSTPRGPRGASKG

SEQ ID NO: 33210 - DNA, 712 bp, Zea mays
  misc_feature: Ceres CLONE 1410826-F
  misc_feature: Encodes the peptide sequence at SEQ ID NO. 33211
gctggagctccccgcggtggcggccgctctagaactagtggatcccccgggctgcaggaattcgcacgagaccattacctagaacatcctaatcgaaaagagaagagggcgggcatcggccagtgggggctcggaggccgagggaggcgaggaaagcggcgggtgccgggccgcccgcgccggtgccgaggccctcaccagtcaccaccccctcccctcttccgtctgtcccccgcttgccgccaccgccgctgcctgctcgcgacccttcccccttttaacgctcccgcggccccgcgtcgtgctcccttttgtcgccgctgccttcgtgcccgtactcgcgggttctcctcgctcctcaatctccgcgcctgggcgcggcgttcgccgccggatctgggcgcgggacggtgcccggaacggccgatgggccgcgggtgggcgcttccggttgggcgcccggcgcgctcgcggttctcgtccctcgtgtcagtggctctgcttccacttgtcagttccgacgatggaccaaacactggcgagggtgttgtcaggggctgggcggattcctcacggggcgcgtgaaggacggggacaaactgagccctcaggatttgctcttcttccctcacattctaggactggaggccgcacctactttcactgcttcctaaaaagctgtatacaatgcgcaggaatgcccgcgttctat

SEQ ID NO: 33211 - protein, 52 aa, Zea mays
  misc_feature: Ceres CLONE 1410826-F
MGRGWALPVGRPARSRFSSLVSVALLPLVSSDDGPNTGEGVVRGWADSSRGA

SEQ ID NO: 33212 - DNA, 753 bp, Zea mays
  misc_feature: Ceres CLONE 1410827-F
  misc_feature: Translation starting site: 232
  misc_feature (261)..(261): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (362)..(362): n is a, c, t, g, unknown, or other
  misc_feature (365)..(365): n is a, c, t, g, unknown, or other
  misc_feature (368)..(368): n is a, c, t, g, unknown, or other
  misc_feature (414)..(414): n is a, c, t, g, unknown, or other
  misc_feature (415)..(415): n is a, c, t, g, unknown, or other
  misc_feature (418)..(418): n is a, c, t, g, unknown, or other
  misc_feature (432)..(432): n is a, c, t, g, unknown, or other
  misc_feature (433)..(433): n is a, c, t, g, unknown, or other
  misc_feature (435)..(435): n is a, c, t, g, unknown, or other
  misc_feature (436)..(436): n is a, c, t, g, unknown, or other
  misc_feature (438)..(438): n is a, c, t, g, unknown, or other
  misc_feature (439)..(439): n is a, c, t, g, unknown, or other
aaagctggagctccccgcggtggcggccgctctagaactagtggatcccccgggctgcaggaattcgcacgagaccattacctagaacatcctaatcgaaaaccgcacacctctgacctccctccgtccatctcatcatcatctttgtccctctcgcgcaattcgccgaacacaccgcgcgcgcctcgcctcccagcgacggccgcctcgacggccaatgctggcggcgggatgagcgtggaggaggaggtggagcgcggngaggaggacctgttctacgagtcgctcgaccgcatcctctcctcgtcgggctcctccaccctctgctcggacgacgatggnnngcgacgcccgcgccacgncgnagntgcgatgcgccaggcgcagcggccctcgacctgtggacctcccagnncgngccccgtcatgagnngnngnngcgggttgcttcatttcatgggggtcacccggcgatctttccctccccgaatttgaaattgcccgggcccccctccgaaaacccccggggaacgccccgggctcttcccggtttgggggccaaggtaagggggggccccctcgggctccccccggaaaccccccctttggggggggccctttggcttttcccttgttcaaagggccaaagccccccaaaaaaccccagggggtttttaaaaccccccccaccagaaaaaaattggggggggaaaaaatttcccttccgcgggggggggggggggctcttctttg

SEQ ID NO: 33213 - DNA, 703 bp, Zea mays
  misc_feature: Ceres CLONE 1410830-F
  misc_feature (655)..(655): n is a, c, t, g, unknown, or other
aaagctggagctccccgcggtggcggccgctctagaactagtggatcccccgggctgcaggaattcgcacgagaccattacctagaacatcctaatcgaaaaagggaacaaaatacaatctgctgaaaccacatgcccaacggatgactggaactcctgtcagtttgcactgagcaatggttcatccattctcaataaccacagtgctccacaggatagcctcacttatggagataatgatctaaactacattgattggcctggcattgacaattttgaggatgttgacacattattcaggagatctgatttcacatatgatccgcagcagctggagaatacagatgggttatcttggcttccttcttcagatgctgtttactcttctgatgttgctttgcagcaagggtttgactcgtcttattccgattatgatattctggatgatctctcagcattccaatgtgcaaaagataaatcactaccctcagttggtccttcatcggatttatgtgataatcaattcaatgatacctatctgttcagtgagcagaagaatgcaaatgcatatggtgaacagatataccaagaggatgtgatggagttgttgcccactgaccagatatgcagtggacatgaaaaaattgaatatggntgaaaaccagtattcatctgaacctacaattcaaggtattgaaaacaa

SEQ ID NO: 33214 - DNA, 675 bp, Zea mays
  misc_feature: Ceres CLONE 1410832-F
  misc_feature: Encodes the peptide sequence at SEQ ID NO. 33215
  misc_feature (367)..(367): n is a, c, t, g, unknown, or other
  misc_feature (374)..(374): n is a, c, t, g, unknown, or other
  misc_feature (428)..(428): n is a, c, t, g, unknown, or other
  misc_feature (432)..(432): n is a, c, t, g, unknown, or other
caaagctggagctccccgcggtggcggccgctctagaactagtggatcccccgggctgcaggaattcgcacgagaccattacctaaaacatcctaatcgaaaaagtgtgagaagctcgattcgttgccgtccactttgtctcacggcctgtcgccatctccttcctggttttttcatccgaccattccccggctcctccgcgccgtcggcgacgactccatcgagtcactcggccgcagcaaccggcgaccatgtaccgagtcgcctccgggctcggcgccctcaagaggcatggggcaaatgctcaaatgatgaatgctgcaattaggtgtgccagcacaagtgttgcacagaggtcttccggtgncttgtgnacctggttgactggtgcgcgttcaaatgaaaaatactctcagatttccactttncggnagtgactattccctcctccgctgctgaccatgtggaggcttgcaaaaacagaagtcacacacttccccatggggttaaataacctctgaaattctgcgggatcttcttggtctgttgaagttatgttggatggggggttctgaaattaaagcactgaaaaaaaaggggccatcaaatgtttaaaacaatggctttcaaaccctggcaaaggagagaattttttttttgcgaaaaattgaggaa

SEQ ID NO: 33215 - protein, 60 aa, Zea mays
  misc_feature: Ceres CLONE 1410832-F
  misc_feature (39)..(39): Xaa is any aa, unknown, or other
  misc_feature (41)..(41): Xaa is any aa, unknown, or other
  misc_feature (59)..(59): Xaa is any aa, unknown, or other
MYRVASGLGALKRHGANAQMMNAAIRCASTSVAQRSSGXLXTWLTGARSNEKYSQISTXR

SEQ ID NO: 33216 - DNA, 716 bp, Zea mays
  misc_feature: Ceres CLONE 1410834-F
  misc_feature: Encodes the peptide sequence at SEQ ID NO. 33217
  misc_feature (387)..(387): n is a, c, t, g, unknown, or other
  misc_feature (422)..(422): n is a, c, t, g, unknown, or other
caaagctggagctccccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgnacggccttcatgtacgtggtgcgcgacctccgggnagaagtacgggcccatcttcacccatgcggatggggcagccacccctcatcgtggtcacctcggcggagctcatccacgaggcgctgggtgaagcagggccccatgttcgcgagccggcccgaggacagccccacccgcctcctcttcagcgtcggcaagtgcaccgtcaactcggcgcctacggccccccctggggcgtgctctgcgccgcaacttcgtcgcccgagatcgtgtccccgcaccgcgtcaaggctttctctggaatcccgggagttgggccgtggacgcgcact

SEQ ID NO: 33217 - protein, 161 aa, Zea mays
  misc_feature: Ceres CLONE 1410834-F
  misc_feature (64)..(64): Xaa is any aa, unknown, or other
MDVNDVLLVVLAAALAAMWWRRCSKTGGVDGLPPGPPGWPVVGNLFQVILQRTAFMYVVRDLRXEVRAHLHPCGWGSHPSSWSPRRSSSTRRWVKQGPMFASRPEDSPTRLLFSVGKCTVNSAPTAPPGACSAPQLRRPRSCPRTASRLSLESRELGRGRA

SEQ ID NO: 33218 - DNA, 708 bp, Zea mays
  misc_feature: Ceres CLONE 1410835-F
  misc_feature: Encodes the peptide sequence at SEQ ID NO. 33219
  misc_feature (429)..(429): n is a, c, t, g, unknown, or other
  misc_feature (436)..(436): n is a, c, t, g, unknown, or other
  misc_feature (447)..(447): n is a, c, t, g, unknown, or other
aaagctggagctccccgcggtggcggccgctctagaactagtggatcccccgggctgcaggaattcgcacgagaccattacctagaacatcctaatcgaaaaatatctccctcgttttggtttgcgcccaagcaagcgcgtcacgcgagcaccgccgctgccgccgttcactatccccctgaacaccgcccgccgccgccgccgtctcctccgcatgcacgcacgctgcctctgcacgagcggcgagcggcaagcggtgatccggcgatcctcgtcgatccccgccctaacgtgctgcggtggtccgtgcagacaagatgaagttcggcgccacatatgaggagtatctccgggcagagcgggacaaattcctaggggcatgctcccatgtagaatacaaacgcctcaaaaaagtattgaagaaatgtnagagtgntcgctcactgncagcagatggcacaaatgtgatgagcagcaggaggggagagacgaatcttcaaccattgtgaatgcactcatgcacattgtgtgatgagatggtctttaccgaactcaacaaggagcatccgaatagccgggtgtttcaaatctaaagtacaacgttcctcccatttcatgttctttcagactacaacctttgaattggcgttttaggaagggttcctaaattgaccaccaaaaagggttccgaaaggaaaagtttttcaa

SEQ ID NO: 33219 - protein, 63 aa, Zea mays
  misc_feature: Ceres CLONE 1410835-F
  misc_feature (38)..(38): Xaa is any aa, unknown, or other
  misc_feature (40)..(40): Xaa is any aa, unknown, or other
  misc_feature (44)..(44): Xaa is any aa, unknown, or other
MKFGATYEEYLRAERDKFLGACSHVEYKRLKKVLKKCXSXRSLXADGTNVMSSRRGETNLQPL

SEQ ID NO: 33220 - DNA, 707 bp, Zea mays
  misc_feature: Ceres CLONE 1410836-F
  misc_feature (521)..(521): n is a, c, t, g, unknown, or other
  misc_feature (531)..(531): n is a, c, t, g, unknown, or other
  misc_feature (689)..(689): n is a, c, t, g, unknown, or other
aaagctggagctccccgcggtggcggccgctctagaactagtggatcccccgggctgcaggaattcgcacgagaccattacctagaacatcctaatcgaaaaaatcacgagaagggcgccgatctgggaaggcattgtcttgttgtactttcccttccggcagtggcctcgattcgcatccccttttcccgtccatgcgcgcgccggcgggcggtgccagtgccaccgcgctcgcggcggccatgaacattaagcagccgctgcacggcgcatcgacgctgttcgcgctgctctctctctcgctgctcctcctccgcctgctcctccgcctccgcctggccgccttccgcgacgcggcgctgtcgctccacctgctggcgcgcctccgcctccgccccgtcctcctctgcctcccggcagcctgccacgaccggcggcgccggcgccggcgccaccacgcttgcgcgtctggtgccccgccaccccatcctccaagccgccgctgctcctcctccacgggnttccggcggngacgccaagtgggacgtggggcgcgcaacctcccgcgcctgtcccgccacttccacgtgtacgcgccggaacctcgtggtctttcggcgcgcagtcccggtccgcgtcgccgctgcgcttccgtggcgttccaggccgctgccgcgccgaggcatggnccctcctcggcggccccg

SEQ ID NO: 33221 - DNA, 714 bp, Zea mays
  misc_feature: Ceres CLONE 1410837-F
  misc_feature: Encodes the peptide sequence at SEQ ID NO. 33222
aaagctggagctccccgcggtggcggccgctctagaactagtggatcccccgggctgcaggaattcgcacgagaccattacctagaacatcctaatcaaaagacccatctcccaacccctacactcccggcggcggcgcaggagcagcagcacccgaggatggtgaagttcctcaagcccggcaaggccgtgatcctcctgcagggccggttcgccggcaggaaggcggtgatcgtgcgcgtgttcgaggagggcacccgcgaccgcccctacggccactgcctcgtcgccggcctcgccaagtaccccaagaaggtggtccgcagggactcggccaagaagacggcgaagaagtcgcgcgtcaagtgcttcatcaagctcgtcaacttcacccacctcatgcccacccgctacaccctcgacgtcgacttcaaggacgtggccaccggcgggcccgacgcgctctccacccgcgacaagaaggtcgccgcctgcaaggccgccaaggcgcgcctcgaggagaggttcaagaccggcaagaacaggtggttctttaccaagctccgcttctagatggtcggcgtcccgaatggtgcccctcggttttctgtgtatgggacacactccaagctatgtctcttttcgtattgccatgaagacttctttcgtgttagtcctggggctctcaggtatattgtgcgtgtgtactccgaa

SEQ ID NO: 33222 - protein, 137 aa, Zea mays; identical to SEQ ID NO: 5586
  misc_feature: Ceres CLONE 1410837-F
  misc_feature (52)..(137): Pfam Name: Ribosomal_L27e Pfam Description: Ribosomal L27e protein family
  misc_feature (7)..(40): Pfam Name: KOW Pfam Description: KOW motif

SEQ ID NO: 33223 - DNA, 701 bp, Zea mays
  misc_feature: Ceres CLONE 1410838-F
  misc_feature: Encodes the peptide sequence at SEQ ID NO. 33224
  misc_feature (373)..(373): n is a, c, t, g, unknown, or other
  misc_feature (414)..(414): n is a, c, t, g, unknown, or other
tggagctccccgcggtggcggccgctctagaactagtggatcccccgggctgcaggaattcgcacgagaccattacctagaacatcctaatcgaaaagagccgagagagaaacaggaaaggagcaggaaaaaaaaagagagaagaagccgcaggggctggcctgacggtacggacagccgcctgcctccagcagtatccagccgcgaaagaattgagaagatccagaccgagctcgacgaggggaggcgcgacaaagaagtatcgccgccacggaaagatggaggatctgaagaagttttatccttctttctggaagcagtctagcagttcacgaagtagcttgcactcgatctgtgagcataagctgatggnatttgggtcgaggcgcaatcaaaccccagaaagttccaccnaattttcataaaacgcaacaggtctcccaatcttgtggactgacttcagatgttaggacttcagttgggagaaaatccgatgcttatcacggagtggattgactggaaaagccctcgatttctggggagggattgaagctattggttggtcgggtttgggaaccctggcaacaaaatgggaggctcaggaggggtcggggggatttcccaaaaacccctcttgggggggggcctcccggcgggaaaaggtgaacatttcggggggaagggggggtcaaggtggatag

SEQ ID NO: 33224 - protein, 48 aa, Zea mays
  misc_feature: Ceres CLONE 1410838-F
  misc_feature (32)..(32): Xaa is any aa, unknown, or other
  misc_feature (46)..(46): Xaa is any aa, unknown, or other
MEDLKKFYPSFWKQSSSSRSSLHSICEHKLMXFGSRRNQTPESSTXFS

SEQ ID NO: 33225 - DNA, 716 bp, Zea mays
  misc_feature: Ceres CLONE 1410839-F
  misc_feature (593)..(593): n is a, c, t, g, unknown, or other
  misc_feature (628)..(628): n is a, c, t, g, unknown, or other
  misc_feature (629)..(629): n is a, c, t, g, unknown, or other
caaagctggagctccccgcggtggcggccgctctagaactagtggatcccccgggctgcaggaattcgcacgagaccattacctagaacatcctaatcgaaaaatgtcccggcacgtaattacgagcacctcccagtccgacctgttcggatacggagcccacgaggccacgaacgaagccctaatcatccgctccaaactccccgcaccggcagagatcagccgtccacgagagcatcacggctagggtttccgatttcaactaggacccctggatctatattctatgaaccagaggcgagacgagtggccgcagcatcaggaccgtctccaactcgccagtactcagccgccgcaatcagggacagggagctcgagcgcgcgccccacctgcgccgacgcgatgcgggccaaggttcctcttccctcgcctccgctgcgttcttctttccatgatgatgcgatgaaaccgtgtcctaggtagctttgcggagctagtcattttctaggttttcgccgtggggctgtgggtggccagaggcgacatcccagcgaggtggggggggcggttgggcgccgcatccgcctttggncgtcttggctggcgccgctgcccctggcgccaggnngaaggacgaacagggaggagtccaggtacaaggcccccgactggcaggtccctggtttcaaagcccaaacgaaacaaaatactcaaa

SEQ ID NO: 33226 - DNA, 768 bp, Zea mays
  misc_feature: Ceres CLONE 1410841-F
  misc_feature: Encodes the peptide sequence at SEQ ID NO. 33227
  misc_feature (350)..(350): n is a, c, t, g, unknown, or other
  misc_feature (404)..(404): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (469)..(469): n is a, c, t, g, unknown, or other
  misc_feature (553)..(553): n is a, c, t, g, unknown, or other
acaagctggagctcaccgcggtggcggccgctctagaactagtggatcccccgggctgcaggaattcgcacgagaccattacctagaacatcctaatcgaaaagttaaaccctcgcctttccgccgcccgtcgcttcccccaaactatcgtgttcaccaccgacggcggcggcgaaacaccttgtcgccctctaccgaaatcccagcccaagcgtgagcgcccgctccccaccagtcaccatggcgccgcgctcccgcaagcgggcttcgcgccccaagccccgcccaggctcccgacgtggtggcggcggaggggacgacgacccctatcttcgagtccgcgccaagcngccgccgcggggaccgtgacgaggacatagagagcgaggacagcgacgacgacngcgtggctgcgcttggnnncgcggatttgatgaggatgggggaccgaggcggtaagggaggatgnagaccgaggaaacggttgggggaagaaaaagatgcggataagcgaaaggagtgggctggagaaaggtcactgaagtcgcttaanaggggggcgggaggatgacctatgaggttgaaaaacgtgtccggaaggggaaaacggttgggcggaaaatcctggcaaaaaaggcccctctagggaaaacggaaagaaaacggggggaaaatttcccccggagggatataccccccggccctccggggggtttttagggggtctttggaaaaccccgcaccttgtaatcgtgggtgtttttaaag

SEQ ID NO: 33227 - protein, 42 aa, Zea mays
  misc_feature: Ceres CLONE 1410841-F
  misc_feature (37)..(37): Xaa is any aa, unknown, or other
MAPRSRKRASRPKPRPGSRRGGGGGDDDPYLRVRAKXPPRGP

SEQ ID NO: 33228 - DNA, 711 bp, Zea mays
  misc_feature: Ceres CLONE 1410842-F
  misc_feature (572)..(572): n is a, c, t, g, unknown, or other
  misc_feature (616)..(616): n is a, c, t, g, unknown, or other
  misc_feature (636)..(636): n is a, c, t, g, unknown, or other
  misc_feature (658)..(658): n is a, c, t, g, unknown, or other
  misc_feature (662)..(662): n is a, c, t, g, unknown, or other
  misc_feature (663)..(663): n is a, c, t, g, unknown, or other
  misc_feature (676)..(676): n is a, c, t, g, unknown, or other
  misc_feature (697)..(697): n is a, c, t, g, unknown, or other
caaagctggagctccccgcggtggcggccgctctagaactagtggatcccccgggctgcaggaattcgcacgagaccattacctagaacatcctaatcgaaaactgcctttcttctcccgttccccgcggcctgcgcgcgcgttctctccctcacctccgcccctttctctctctctctcgctctcgctccgggcgacggctgggcgaccgccgctttatccgtgcggcccttccttttgttctcccgtccccccaaccccccttcgagctctatctgtctcttcctctcgaggcgacgcctgggctaccgcgccgctactgcggcctcccgcgacaggtgcctagtctccatcaggtgccatgtcttcttcgggctcttcaccggcgacgtgcactgccagctctgcatgtatacacccaagtcctttactgggtccgccgccgcccctatgtacttcgttaggtttagtatgttgttaagtttgtaattctagggtctggagggaagcatagatctcaagaggggtgaaaatttggtggtaatttcctgagaatttcaggagacaggggncgttggaggttggtttctgggagggatctgtgagcacagcaganaaaattttgaggttggtggntagcctggtgatccacgaatgntggnntaagggagctggntggtgcaaaaggaatggcccntgttgacattacgt

SEQ ID NO: 33229 - DNA, 713 bp, Zea mays
  misc_feature: Ceres CLONE 1410843-F
  misc_feature: Encodes the peptide sequence at SEQ ID NO. 33230
  misc_feature (379)..(379): n is a, c, t, g, unknown, or other
  misc_feature (406)..(406): n is a, c, t, g, unknown, or other
  misc_feature (407)..(407): n is a, c, t, g, unknown, or other
  misc_feature (451)..(451): n is a, c, t, g, unknown, or other
  misc_feature (480)..(480): n is a, c, t, g, unknown, or other
  misc_feature (481)..(481): n is a, c, t, g, unknown, or other
  misc_feature (488)..(488): n is a, c, t, g, unknown, or other
  misc_feature (508)..(508): n is a, c, t, g, unknown, or other
  misc_feature (527)..(527): n is a, c, t, g, unknown, or other
  misc_feature (564)..(564): n is a, c, t, g, unknown, or other
  misc_feature (598)..(598): n is a, c, t, g, unknown, or other
aaaagctggagctccccgcggtggcggccgctctagaactagtggatcccccgggctgcaggaattcgcacgagaccattacctagaacatcctaatcaaaaagcttgctttgcttccgagtttcgacacgcgtgcccaggaatcggtcggattccccaatcccgtcaccatggccgcgccgccttctccttcgtcccgctccccgtccagcgaggttgccgtccacagattcagcggcaccttggatgtatcatcatcgccctcaaggaccgagttgttgagcatggtgaagaagcactcacatttgattgggtggacgattattggtgccgaggatgatgcatcagatgtgggaatggatgataaattctggcatgnaatgctttgactattctttgtgcgtgnncagcaaatcaaaagaagtgaagaggatgaccttgtcttctttgntataacatgaaaatgcatgggttatgttnncatgatnacatggaagatccacttccntttttttgtacgagatggncttccacgcttgaaaagatcagaattaataccggggnaggtgaattgggagcggtcattctatttgatttnatccgtccaccgccgaaaactgtcactgttgaaaaatttggaaattgaaaatctttccaaacggggaggaaaaaaaaaagtttcgctcccgttttaaaggttacaaaagatgtta

SEQ ID NO: 33230 - protein, 72 aa, Zea mays
  misc_feature: Ceres CLONE 1410843-F
  misc_feature (70)..(70): Xaa is any aa, unknown, or other
MAAPPSPSSRSPSSEVAVHRFSGTLDVSSSPSRTELLSMVKKHSHLIGWTIIGAEDDASDVGMDDKFWHXML

SEQ ID NO: 33231 - DNA, 699 bp, Zea mays
  misc_feature: Ceres CLONE 1410845-F
  misc_feature: Encodes the peptide sequence at SEQ ID NO. 33232
  misc_feature (399)..(399): n is a, c, t, g, unknown, or other
  misc_feature (403)..(403): n is a, c, t, g, unknown, or other
  misc_feature (530)..(530): n is a, c, t, g, unknown, or other
aaagctggagctccccgcggtggcggccgctctagaactagtggatcccccgggctgcaggaattcgcacgagaccattacctagaacatcctaatcaaaaactgtctcgtcggctcgtcgctccgtagaccccgcgcctccgcctccccgccactcgccggaggctgccgccatcgttatgccatggccgtcatcctctcctccgcggcgccaacgatactgactcgtcccacgcgccctcggaggcagccgaggagcggcctccgcgggggcctcgcgcgcctctcagctgcgctcggcctcgcgcacgcgggcgccggcgccggcgccgcactcgccgcgccgctctcctacgaggagatgctgcgcctctcgtccgactccggcggtgatgttgncggnttcgcgctcccggagctcggcctcgacgggctcgttgacttcgtcaacgataaccctctcgtcgtcgcggcaggcgtcgcgggcatcgcagtgccgcttctccttgcgcagcttctccggggaggcngcagctccaagccctactccgtcctgtccgcaaggcgggctaccagcggctgctcgaggagcccgacgggcagctcgtcgacatcagggccgttaagggatggacgagaggccgggacgcctgatctcaaggaggttaagaagaagggtgctgccgtaccttacaaggg

SEQ ID NO: 33232 - protein, 171 aa, Zea mays
  misc_feature: Ceres CLONE 1410845-F
  misc_feature (72)..(72): Xaa is any aa, unknown, or other
  misc_feature (116)..(116): Xaa is any aa, unknown, or other
MAVILSSAAPTILTRPTRPRRQPRSGLRGGLARLSAALGLAHAGAGAGAALAAPLSYEEMLRLSSDSGGDVXGFALPELGLDGLVDFVNDNPLVVAAGVAGIAVPLLLAQLLRGGXSSKPYSVLSARRATSGCSRSPTGSSSTSGPLRDGREAGTPDLKEVKKKGAAVPYK

SEQ ID NO: 33233 - DNA, 625 bp, Zea mays
  misc_feature: Ceres CLONE 1410846-F
  misc_feature: Encodes the peptide sequence at SEQ ID NO. 33234
  misc_feature (327)..(327): n is a, c, t, g, unknown, or other
  misc_feature (352)..(352): n is a, c, t, g, unknown, or other
  misc_feature (447)..(447): n is a, c, t, g, unknown, or other
cagagctggagctccccgcggtggcggccgctctagaactagtggatcccccgggctgcaggaattcgcacgagaccattacctagaacatcctaatcgaaaaaccatccccgttccccaacccccaaagccgagagccatcccgcccgcagccgcaaccaggcaagcaagcgggagccgccaactcgtgcctctcggcagcggcgtctgaactctgaaccgaccgaccgaccgaccgttccgttccgttcaccccaccatggaggcgccgccgggaccggggcccatggagctggacgccccacctcccgccgccgccgccgcggngattcctcccgccggcagcgacagncacaagggacggggaaaggcggagacgctgtgacgggccatatcatctccaccaccatcggcgggaagaacggcgagcccaagcggaccatcagntacatgccagaacgtgtcgtgggcacaggctcattttgggatcctcttccaggcttaagtgtctggaaacaggaaaagacctttcgccatcaaagagggggctgcaaggatcggcggtaacaaaaaaccgggaagctgcaaactttatgggggggccaggggaaccccccccaacggc

SEQ ID NO: 33234 - protein, 38 aa, Zea mays
  misc_feature: Ceres CLONE 1410846-F
MPERVVGTGSFWDPLPGLSVWKQEKTFRHQRGGCKDRR

SEQ ID NO: 33235 - DNA, 698 bp, Zea mays
  misc_feature: Ceres CLONE 1410850-F
  misc_feature: Encodes the peptide sequence at SEQ ID NO. 33236
  misc_feature (470)..(470): n is a, c, t, g, unknown, or other
  misc_feature (477)..(477): n is a, c, t, g, unknown, or other
  misc_feature (478)..(478): n is a, c, t, g, unknown, or other
  misc_feature (608)..(608): n is a, c, t, g, unknown, or other
  misc_feature (652)..(652): n is a, c, t, g, unknown, or other
acaagctggagctccccgcggtggcggccgctctagaactagtggatcccccgggctgcaggaattcgcacgagaccattacctagaacatcctaatcgaaaaaactcacaattcacatcgaggtctcagcttcaggaaagggaaggaagcatgttcgggcaccaccaccaccacggccacggcgggcaccaccaggccccgccgccgcacgagcagacgctgttcaggatcttctgccgcgccgacgaggcgtactgcctcaccgtgcgccacgacgccgtcgtcctcgcgcccaccaacccccgcgacgagtaccagcactggtacaaggacatgaggcacagcacgaaggtgaaggacgcggagggccagccggcgttcgcgctcatcaacagggccaccggcctcgccatcaagcactcgctcggccagtcccatccccgtgaagctggtgccctacaacgcggantactggnnacgagtcggtgctgtggacggaaagccacgacgtgggcaagggcttccgctgcatccgcatggtcaacaacatccacctcaacttcgacgccttccacggcgacaggacccacggcggcgtgcacgacgnaacccacgtggtggtccttggaaggtgttgcagggccccaacanaaatctggaaggtgtgtccccttggggggggacgaggcctaccccc

SEQ ID NO: 33236 - protein, 182 aa, Zea mays
  misc_feature: Ceres CLONE 1410850-F
  misc_feature (107)..(107): Xaa is any aa, unknown, or other
  misc_feature (109)..(109): Xaa is any aa, unknown, or other
  misc_feature (153)..(153): Xaa is any aa, unknown, or other
  misc_feature (167)..(167): Xaa is any aa, unknown, or other
MFGHHHHHGHGGHHQAPPPHEQTLFRIFCRADEAYCLTVRHDAVVLAPTNPRDEYQHWYKDMRHSTKVKDAEGQPAFALINRATGLAIKHSLGQSHPREAGALQRGXLXTSRCCGRKATTWARASAASAWSTTSTSTSTPSTATGPTAACTTXPTWWSLEGVAGPQXKSGRCVPLGGDEAYP

SEQ ID NO: 33237 - DNA, 706 bp, Zea mays
  misc_feature: Ceres CLONE 1410852-F
  misc_feature: Translation starting site: 159
  misc_feature (379)..(379): n is a, c, t, g, unknown, or other
  misc_feature (384)..(384): n is a, c, t, g, unknown, or other
  misc_feature (530)..(530): n is a, c, t, g, unknown, or other
  misc_feature (589)..(589): n is a, c, t, g, unknown, or other
  misc_feature (590)..(590): n is a, c, t, g, unknown, or other
  misc_feature (633)..(633): n is a, c, t, g, unknown, or other
  misc_feature (660)..(660): n is a, c, t, g, unknown, or other
aaagctggagctccccgcggtggcggccgctctagaactagtggatcccccgggctgcaggaattcgcacgagaccattacctagaacatcctaatcaaaaacatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcantgttnccgcgggccgtggctcgcccgcgcggacttcctgctgacgtgcgacccggcggccgtccagcactgcctggcgtccaaccacgggggctacgacaggggccgagacttttgcggagatgttcgacctcctgggcgacgggctgctnggttgcggacgcccccggtcgtgggcgcgccagcggcacgtcgccgccaccgtctcggnnaccccgggcgttccggtccttcgtcctgtgcaccatggcgcgncagaacggcgccggctgctcgtggcgntcctggactgcgccgccggggatcaagaaagggacggtggcgtcct

SEQ ID NO: 33238 - DNA, 720 bp, Zea mays
  misc_feature: Ceres CLONE 1410853-F
  misc_feature: Encodes the peptide sequence at SEQ ID NO. 33239
  misc_feature (361)..(361): n is a, c, t, g, unknown, or other
  misc_feature (384)..(384): n is a, c, t, g, unknown, or other
  misc_feature (580)..(580): n is a, c, t, g, unknown, or other
aaaagctggagctccccgcggtggcggccgctctagaactagtggatcccccgggctgcaggaattcgcacgagaccattacctagaacatcctaatcgaaaaaccatcatcacactcgaaacccaacagcttccttcctggcgatccaattaacggcttctcttctgagctcagcacgaacaatggccaccatcctcaccgtcgcaagcttcttcgcacttgtgtgcatctctcaacaagcgcgggctgcgaactacacgttcatgaaggacgcggtgcacgcgccgcggacgggcttctacgactacatcatagtcggcggcggcacggcgggctgcccgctggcggccaccctgtcgngcccgcgcgcgggtgctgctgcntggagcgcgggggctctccgtacgaggacgcgcgcgtcctgaacatggcccaccttctcggacgtgctggcggacactgtcggcgtcgtcctcgtctgcagcggtcgtgtcggagggacggcgtgatcaactcccgcccgcgcgtggctgggcggcgacagctgcatcaacgccggcttcttcacgcggggccggngcgggctacgtcatggccgccgactggaccccatggaaagtgtcggcggggctacctggggcactgacagaagttgtttctgttcccgaacagcttgtgctcatggtgataggctaccttgaaagggtttgttctgcttt

SEQ ID NO: 33239 - protein, 80 aa, Zea mays
  misc_feature: Ceres CLONE 1410853-F
  misc_feature: SWISSPROT Homolog: EC 4.1.2.10 Mandelonitrile lyase
  misc_feature (60)..(60): Xaa is any aa, unknown, or other
MATILTVASFFALVCISQQARAANYTFMKDAVHAPRTGFYDYIIVGGGTAGCPLAATLSXPRAGAAAWSAGALRTRTRAS

SEQ ID NO: 33240 - DNA, 683 bp, Zea mays
  misc_feature: Ceres CLONE 1410855-F
  misc_feature: Encodes the peptide sequence at SEQ ID NO. 33241
  misc_feature (161)..(161): n is a, c, t, g, unknown, or other
  misc_feature (242)..(242): n is a, c, t, g, unknown, or other
  misc_feature (243)..(243): n is a, c, t, g, unknown, or other
  misc_feature (264)..(264): n is a, c, t, g, unknown, or other
  misc_feature (265)..(265): n is a, c, t, g, unknown, or other
cagagctggagctccgcggtggcggccgctctagaactagtggatcccccgggctgcaggaattcgcacgagaccattacctagaagatcctaatcgaaaaaaccgacttccagttccactctcgcttccttccctccctccctcccacgcaaatggtggncgctcgcctccgcctcgagctgctactctccgtctgcctctgctccgcgtgggcgcgcctacgcctcgagacgccatccgnnctgcgtcgcacgcgcgggggnnggcgacgaaaacgacgacgggccgtcgggaaccggtgggttgtggtcatccgaagcttcaggggttactaaaactaccgcaccaggggaaatttggcatggaaccaaatatgggaaaaagggggcccccgggggggaaaaaatattgtttcaggtacaaagaactccccaaaacccggaaaacccagggctggggggtaaccaaaacacacccccggggggggacccatattttggggggcgcaaagataaaacattgggggagggtgaaccccgcaaatttttttcttgggttttggttgtggaaaaaaaaattctcttaggggggggacacaaaagggggggggaaaagggcccccacaaaaaaatatttttttttttaaaaaaaacaaagggggcccccggggtttttaaaaaaa

SEQ ID NO: 33241 - protein, 60 aa, Zea mays
  misc_feature: Ceres CLONE 1410855-F
  misc_feature (3)..(3): Xaa is any aa, unknown, or other
  misc_feature (30)..(30): Xaa is any aa, unknown, or other
  misc_feature (38)..(38): Xaa is any aa, unknown, or other
MVXARLRLELLLSVCLCSAWARLRLETPSXLRRTRGGXRRKRRRAVGNRWVVVIRSFRGY

SEQ ID NO: 33242 - DNA, 739 bp, Zea mays
  misc_feature: Ceres CLONE 1410857-F
  misc_feature (358)..(358): n is a, c, t, g, unknown, or other
  misc_feature (370)..(370): n is a, c, t, g, unknown, or other
  misc_feature (378)..(378): n is a, c, t, g, unknown, or other
  misc_feature (379)..(379): n is a, c, t, g, unknown, or other
  misc_feature (387)..(387): n is a, c, t, g, unknown, or other
  misc_feature (388)..(388): n is a, c, t, g, unknown, or other
  misc_feature (429)..(429): n is a, c, t, g, unknown, or other
  misc_feature (452)..(452): n is a, c, t, g, unknown, or other
  misc_feature (491)..(491): n is a, c, t, g, unknown, or other
caaagctggagctccccgcggtggcggccgctctagaactagtggatcccccgggctgcaggaattcgcacgagaccattacctagaacatcctaatcaaaagtggactgtcctcaggacaatcgccaaaaccccccgagccaacacctactacgccgccgcgccgccgcgtcaaacaacggcgagaggacgcctatggcattcacttcccaatccctaatcttccgggcacccgcctcgccctcttgtgcccgcataaccccgtcatccggtcgcgtcaccctccgggaccgcagcgccgttttcccgctcgtcgcggcgggctccacctcgatggcgtcctcggagagcgaagatnagagggaaaccnagctgtgnngcggcggnntcggaggagggcgtcaccgacgccgtggagcgcttcacggnagtcatatcctacgactgggagntctacaaatacgacctaatgggcagcaaggcccacgctnctcatggtcgctgggccaggttttgataaccgttactggaaggaaattcatcctaagaggggcttgatccaatagaaaggtggtccaagaagggaatttttgtggggggaaggacccgggaggatggcaattgaactttgaacgggtctttaggaaagggttggggggcccccccaaaagttctacctggttggggcccaaggcccaaatgggggggtcttagggtattggggcgggagtgttttgga

SEQ ID NO: 33243 - DNA, 758 bp, Zea mays
  misc_feature: Ceres CLONE 1410858-F
  misc_feature: Encodes the peptide sequence at SEQ ID NO. 33244
  misc_feature (394)..(394): n is a, c, t, g, unknown, or other
  misc_feature (395)..(395): n is a, c, t, g, unknown, or other
  misc_feature (446)..(446): n is a, c, t, g, unknown, or other
caaagctggagctccccgcggtggcggccgctctagaactaagtggatcccccgggctgcaggaattcgcacgagaccattaacctaagaacatcctaatcgaaaaccgccacgccacctcccctcccctcccgccgtgcgccccgattcctcgccgccccacggcggcctcatctcgccgaggactggatcgccggggggacatcctgggtgtccttcacacacatgcggcgttaggtgatgacgagcttgcctgagaggggagaatcacctgcgccgccactcgattctctgcgccaggactctgccgtgaccgtcctaggggctgccgccgttgccctcttctacgctggctccgatcgcaaggaagacagcagcatcaggcagcccaggnnctcgatccttgtgcggcgtctactcgtcccctttttgcaatattccaaggncagcaccagggtccctctttccccggggggcgaaccccgggcaaaaaaggcggcctaagggtcctaagggtttacccgaaccccggaggaggttcctggggacaggggcccatggggtcaccttgggggggggccaagggtttttggccccccgggaggggggtgcccctgggaaaatgctaaaaggggggcccctaaaaaaaaaggggtttggggcctccgaaaccccacggggggggggtggttttttggggaaaaattttcttccgggagaggggccctccccggggggggttttgggttttttttttt

SEQ ID NO: 33244 - protein, 87 aa, Zea mays
  misc_feature: Ceres CLONE 1410858-F
  misc_feature (52)..(52): Xaa is any aa, unknown, or other
  misc_feature (69)..(69): Xaa is any aa, unknown, or other
MTSLPERGESPAPPLDSLRQDSAVTVLGAAAVALFYAGSDRKEDSSIRQPRXSILVRRLLVPFLQYSKXSTRVPLSPGGEPRAKKAA

SEQ ID NO: 33245 - DNA, 696 bp, Zea mays
  misc_feature: Ceres CLONE 1410859-F
  misc_feature (364)..(364): n is a, c, t, g, unknown, or other
  misc_feature (379)..(379): n is a, c, t, g, unknown, or other
  misc_feature (389)..(389): n is a, c, t, g, unknown, or other
  misc_feature (404)..(404): n is a, c, t, g, unknown, or other
  misc_feature (420)..(420): n is a, c, t, g, unknown, or other
  misc_feature (435)..(435): n is a, c, t, g, unknown, or other
  misc_feature (436)..(436): n is a, c, t, g, unknown, or other
  misc_feature (455)..(455): n is a, c, t, g, unknown, or other
  misc_feature (456)..(456): n is a, c, t, g, unknown, or other
  misc_feature (509)..(509): n is a, c, t, g, unknown, or other
  misc_feature (510)..(510): n is a, c, t, g, unknown, or other
  misc_feature (526)..(526): n is a, c, t, g, unknown, or other
  misc_feature (530)..(530): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
acaagctggagctcaccgcggtggcggccgctctagaactagtggatcccccgggctgcaggaattcgcacgagaccattacctaaaacatcctaatcgaaaaagaaaatacgcacctgctcctcactcttctttatatttttttctccatttggcaacttttgcttgtcgttcatgtatatgcatgaccctttcacacatatgatcagaagataagcacatgcaagacgatctcgcgtggatatgatgcatggatcagacctaacctctatatcatcaccaaacgctcgtagatgatgctatacaattccatgattaaattatatataagtaaaaaaaaaagaaccgtacgtgcatacataanattaagaattaatgnctgccaatgnacgacatatgcatgnacagggtaagcttggntgaatcccactgaanncggagcgccccacttccgnntcatgatcggatgatcgacgggaggacggagctgaagccgtttgcagcagggnngcccaaaagacggggnttgnaggggtggggnnntttcccccgccgccggatcgggggggattgaaaatacttggacgggaaaagggacaccgggggggtcccctttgttcaaaaaaaaaattgaaaagggggtttcccccctctccccttttccccggttttagaggaaaatattgccccccaaat

SEQ ID NO: 33246 - DNA, 705 bp, Zea mays
  misc_feature: Ceres CLONE 1410860-F
  misc_feature: Encodes the peptide sequence at SEQ ID NO. 33247
  misc_feature (424)..(424): n is a, c, t, g, unknown, or other
acaagctggagctccccgcggtggcggccgctctagaactagtggatcccccgggctgcaggaattcgcacgagaccattacctagaacatcctaatcgaaaaaccttgtctgcaagggtttttcgccgtcttatcccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgctcgccggctcgcgggcggcgccccgtcgtacaacagcgtgccaccgccccccgatgagatccagctcgcgaagcagcgcgcgcaggagatcgcggcgcggatctttaacgccgcagaggccaagcgtcctcgcgtcgacnacggcgacgatgacagcggcgggcttcggtgtaggcctgggcagcactgggtggcggtggccgcatcgggcggcggaggactcggcttctcgtcctctgccgggggtgggcacggggcttctatccaccattatcttctcggagcagcgcaactcagtactcctcttatgggggatatcagggtaccaggcaaaagattgaattttcaaatgaaagggttggtggtatcattgggaaagccggggaaactaattaaggttattccaatttcatcagggact

SEQ ID NO: 33247 - protein, 171 aa, Zea mays
  misc_feature: Ceres CLONE 1410860-F
  misc_feature (78)..(78): Xaa is any aa, unknown, or other
MADDHYSSKRKYDDPSPPPRRTGFSSGPPPARRLAGGAPSYNSVPPPPDEIQLAKQRAQEIAARIFNAAEAKRPRVDXGDDDSGGLRCRPGQHWVAVAASGGGGLGFSSSAGGGHGASIHHYLLGAAQLSTPLMGDIRVPGKRLNFQMKGLVVSLGKPGKLIKVIPISSGT

SEQ ID NO: 33248 - DNA, 714 bp, Zea mays
  misc_feature: Ceres CLONE 1410863-F
  misc_feature (687)..(687): n is a, c, t, g, unknown, or other
caaagctggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagcaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgccccgggagatggcagcggaggttgccgccgctgcggcgctcgggtgccgacgtggcggagctccaggtcggctgcctcgacagcttcgagccatgcagggacctgcccgtgcttctcgcccagccccgctcgctccccgtcatcgtcacctaccggcccgatttgggagggaggccagtacgcaggcgaagatgagccacggtttgaggcgcttctactggncatggagctgggagctgaatatgtcga

SEQ ID NO: 33249 - DNA, 725 bp, Zea mays
  misc_feature: Ceres CLONE 1410865-F
  misc_feature: SWISSPROT Homolog: EC 2.7.11.1 Non-specific serine/threonine protein kinase
caaagctggagctcaccgcggtggcggccgctctagaactagtggatctcccgggctgcaggaattcgcacgagaccattacctaaaacatcctaatcgaaaagaagcggtggtgcgctcgtcagccgatgaggcgacacacacacagacacagcagaggacacacggtccccggattctccccgttgctgctgtcgcgccggggtccagtctcgggggggctctaggtggggacgcgccggctcgcgctgtgacctgggagctctgaactctggaggcgctgcaggcggtcggtagcccgatggggtgcccttcctgctgcaagcgctctgacggtgctgaaacctgacaggaggaggaggaaaaagaaggacacggctgtgaaggatcttctcactcaaggagctccagtcagagactaacaattgtcattacgacaacaagctcgacgaggtaggattcggcagtgtgtactgctgccagttctgggacgtatcacagatcgccgtagagaggctcaagagctgtagcatcaaggccaaaacggagttcactgtcgaggtgaaggatctggcatgcgtgcggcacatgactcttctaagcctgcgacgttactgactcgatgccagtagcgcctgatagactacgattacatgccgaatctgagtatacactctcagctgcatgataagcaccagcagtgtgcatcttcatttggccaaagg

SEQ ID NO: 33250 - DNA, 712 bp, Zea mays
  misc_feature: Ceres CLONE 1410866-F
  misc_feature: Translation starting site: 273
  misc_feature (479)..(479): n is a, c, t, g, unknown, or other
  misc_feature (625)..(625): n is a, c, t, g, unknown, or other
caaagctggagctccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgccccgggagatggnaagcggaggttgccgccgctgcggcgtcggggtgccgacgtggcggagctccaggtcggctgcctcgacagcttcgagccatgcagggacctgcccgtgcttctcgcccagccccgctcgctccccgtcatcgcacccagggccgnaaatttgggagggaggccagtacgcaggcgaagatgagccacggtttgaggcgcttctactggcaatggagctgggagctaaatatg

SEQ ID NO: 33251 - DNA, 719 bp, Zea mays
  misc_feature: Ceres CLONE 1410868-F
  misc_feature: Encodes the peptide sequence at SEQ ID NO. 33252
  misc_feature (656)..(656): n is a, c, t, g, unknown, or other
  misc_feature (657)..(657): n is a, c, t, g, unknown, or other
  misc_feature (695)..(695): n is a, c, t, g, unknown, or other
aaagctggagctccccgcggtggcggccgctctagaactagtggatcccccgggctgcaggaattcgcacgagaccattacctagaacatcctaatcgaaaaagcctgcgctccccttctttcccgttcggctcacagcgaagaaggaagccggttagggtttccacctcctttcccctcctctccttcagcgacgaccgcgggccacaccctcgatatccttcccctcggacccggaggcgagcagcagcctccagcgcctgccacgcctgcccgtctcgttattgggaggattcgccatgtctgacatggagtccgtcacagctcttatgaactcgacaagctccaagatacagcagcttcaggaggcatttgctgagcttgagagccagagcacggtttccatgaacctcaagtggaagcagcttgaagaccactttcgtggtcttgaacagtccctcaagaaaaagtttgacgagctaaaagagcaggagaaggagttccaggagactgtcgcaaaatcagagcagattctggagcagcgggaggcagctgttgtggcaaaggaactgacctctttggagaagttgcaggagaagagggaagctgcattagctatgatctttagcaagtccaggctttcccttactgttccnntacatcaccccatgaaacaggcgctgaataatcttggntgtcagtgggcaaaccggcatctg

SEQ ID NO: 33252 - protein, 140 aa, Zea mays
  misc_feature: Ceres CLONE 1410868-F
  misc_feature (120)..(120): Xaa is any aa, unknown, or other
MSDMESVTALMNSTSSKIQQLQEAFAELESQSTVSMNLKWKQLEDHFRGLEQSLKKKFDELKEQEKEFQETVAKSEQILEQREAAVVAKELTSLEKLQEKREAALAMIFSKSRLSLTVPXHHPMKQALNNLGCQWANRHL

SEQ ID NO: 33253 - DNA, 707 bp, Zea mays
  misc_feature: Ceres CLONE 1410869-F
  misc_feature (391)..(391): n is a, c, t, g, unknown, or other
  misc_feature (406)..(406): n is a, c, t, g, unknown, or other
  misc_feature (407)..(407): n is a, c, t, g, unknown, or other
  misc_feature (540)..(540): n is a, c, t, g, unknown, or other
  misc_feature (554)..(554): n is a, c, t, g, unknown, or other
  misc_feature (575)..(575): n is a, c, t, g, unknown, or other
aaagctggagctccccgcggtggcggccgctctagaactagtggatcccccgggctgcaggaattcgcacgagaccattacctagaacatcctaacgaaaaattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaatcaatttcttcgtccgccttcgcccctgcttacgtccccgctactaaccctaggatcattctgtcttttctcngttcttatccgactnnctctcgttttatgcctatcagttatgaggttgaacgccttcagaagcttctctactagattagtgtaataggagacttggtcgagtttagcttgcctggaagaatagcctctggtccggcttatatctgctanccataatgcctgcnatgaaacgaaaaggtattggntgaatggggaaggacataaaaagttctcaagaaaaagggggaaagccccgctggaatggctggtggggaatttcggcccccctgaattgcctcaacaacgggaaagggattccggggaagggttcctttgga

SEQ ID NO: 33254 - DNA, 712 bp, Zea mays
  misc_feature: Ceres CLONE 1410870-F
  misc_feature: Translation starting site: 205
  misc_feature: SWISSPROT Homolog: EC 2.5.1.58 Protein farnesyltransferase
  misc_feature (1)..(1): n is a, c, t, g, unknown, or other
  misc_feature (493)..(493): n is a, c, t, g, unknown, or other
naaagctggagctccccgcggtggcggccgctctagaactagtggatcccccgggctgcaggaattcgcacgagaccattacctagaacatcctaatcgaaaaaacagcaagggcagcactgccgaaaccgcaggccgcagcactcgagagcgcagccaggcggcggcgctccgcctccgactccacaccaggccgctgcgtccatggacccctccccgcagtcgacgccgcccaccggagacgacccggcagcggcggcggatcccgacctaccgaggctcacggtgacgcaggtggagcagatgaaggtggaggccagggttggcgacatctaccgctccctcttcggggccgcgcccaacacgaaatccatcatgctagagctggtggcgtgatcagcatatcgagtatctgacgcctgggctgaggcatatgggacccagcctttcatggtctagatgccaatcgcccttggctatgctactggatggntcatccacttgctttgctggatgaagcacttgatgatgatcttgaagatgatatcatagactttcttagctcgatggcagggataagatggtggaatatagtgttggaactgggaacggtgcctcacctagctacgacttaagctgggtggaaaaacccttgggaacaaaggggaggaagagactttgccttcatcaaaagggggacccgggaaaattt

SEQ ID NO: 33255 - DNA, 712 bp, Zea mays
  misc_feature: Ceres CLONE 1410873-F
  misc_feature: Translation starting site: 206
  misc_feature: SWISSPROT Homolog: EC 3.6.1.1 Inorganic diphosphatase
  misc_feature (373)..(373): n is a, c, t, g, unknown, or other
  misc_feature (535)..(535): n is a, c, t, g, unknown, or other
caaagctggagctccccgcggtggcggccgctctagaactagtggatcccccgggctgcaggaattcgcacgagaccattacctaaaacatcctaatcgaaaaaagaagcgtgcagagcgagacgcgtcgcctcctccctttcccccaccccgccgccgccctcgcgtccgtccgtccgtccgttattagggttcggtcgccgccatggcgatcctctcggcgctcgccaccgaggtgctcatccccgtcgccgccgtcatcggcatcgccttcgccgtcgtgcagtgggtggtcgtgtcgcgcgtgaagctctccccggccgcggccggcggtggcggcggcaaggccggctacgccgactccctcatcganggaggaggaggggctcaacgaccacaacgtcgtcgtcaagtgcgccgagatccagaacgccatctccgaaggagcaacatcgtttcttttcaccgagtaccaatatgttggtatcttcatggttatcttcgctgttgtgatcttcctcttccttggttcggntgagggattcagcacgaagagccagccctgcacatatagcaaggacaagtactgcaaagcctgcgctgttcactgcactctttagcactgtgtccttcttgcttggagccatcacctctctggtctctggtttccttggcatgaagattgccacatatgcgaatgccagaactacca

SEQ ID NO: 33256 - DNA, 692 bp, Zea mays
  misc_feature: Ceres CLONE 1410874-F
  misc_feature (540)..(540): n is a, c, t, g, unknown, or other
  misc_feature (642)..(642): n is a, c, t, g, unknown, or other
aaagctggagctccccgcggtggcggccgctctagaactagtggatcccccgggctgcaggaattcgcacgagaccattacctagaacatcctaatcgaaaaaaggaaccaaacagcgcaacacacgaacacaccaggcggcaggctccaccccgtccttttcctgccttttccccccgtcgagttaatccatccagtcgccaaaagctttgctaaatttcacgtgtctcgcctcgagtcgtccctaatccgacgatgccttgttctactcctaaaaaaacccaaagatcctgactttctcttgctgctagcctcccttttcccttctcccttaatcgcactgtggaagctcttcgctgtcacccccacccacctccggcgctcttttttagcattttccttgggctctggactccaaaatcccagccttttgtttgcttctctgtctcctgctgattggtgtccccgggtccaggactcttgattgctccctcgcgggggggttcggtcccatggcggcagctgcgctggcaatggcangagcaggttgtgggcgagctcccgagtgaggtggaagacgccgccgtcgatgctgcgcggaggtggcccgtggagatggcccgcgagaatgggccgcggggnctggaaaaaggacgggcgggaagcagggtcaagatgctccctctcctacc

SEQ ID NO: 33257 - DNA, 694 bp, Zea mays
  misc_feature: Ceres CLONE 1410875-F
  misc_feature: Encodes the peptide sequence at SEQ ID NO. 33258
  misc_feature (513)..(513): n is a, c, t, g, unknown, or other
  misc_feature (524)..(524): n is a, c, t, g, unknown, or other
  misc_feature (575)..(575): n is a, c, t, g, unknown, or other
  misc_feature (637)..(637): n is a, c, t, g, unknown, or other
  misc_feature (638)..(638): n is a, c, t, g, unknown, or other
aaagctggagctccccgcggtggcggccgctctagaactagtggatcccccgggctgcaggaattcgcacgagaccattacctagaacatcctaatcgaaaaacggatcaaaatcgaatccaacgctactgcctagggtttcctctgcatttcccctaccacaccccgcgccgcccacccatggccgccgcagacgcgtccgccgagaccgccgccatcgcgcggcgcctggcctcctgcaacaccggcacccgggagcgcgcgctccgctacctcctctccgaatttctgccggcctccgcgccgcgcctctccgccaccgacctcctcaagctctggaagggcatcttcttctgcttctggcacgccgacaagccgctctaccagagctccgtcgcctcgcctccgccgtctccgtcccgccgtcccccgccgatggtgccgccttcctcgccgcctacctcaccacgctccgccgcgagtgggcccacatcgacgtccaccgcctcgacnagttctacctncctcaccgccggttcctccaccacgccttcctgcttctcatgctaactctncggccccgacgtacctcccagggtcgtgtccgtcctgtcagacaagccccctgctccggagnncgacacgtcgccgctgccacctcccggggggctcgggaaccacgtcgccgaggcgt

SEQ ID NO: 33258 - protein, 129 aa, Zea mays
  misc_feature: Ceres CLONE 1410875-F
  misc_feature (9)..(130): Pfam Name: Nop52 Pfam Description: Nucleolar protein,Nop52
  misc_feature (115)..(115): Xaa is any aa, unknown, or other
MAAADASAETAAIARRLASCNTGTRERALRYLLSEFLPASAPRLSATDLLKLWKGIFFCFWHADKPLYQSSVASPPPSPSRRPPPMVPPSSPPTSPRSAASGPTSTSTASTSSTXLTAGSSTTPSCFSC

SEQ ID NO: 33259 - DNA, 711 bp, Zea mays
  misc_feature: Ceres CLONE 1410876-F
  misc_feature (307)..(307): n is a, c, t, g, unknown, or other
  misc_feature (475)..(475): n is a, c, t, g, unknown, or other
  misc_feature (578)..(578): n is a, c, t, g, unknown, or other
  misc_feature (599)..(599): n is a, c, t, g, unknown, or other
  misc_feature (600)..(600): n is a, c, t, g, unknown, or other
aaagctggagctccccgcggtggcggccgctctagaactagtggatcccccgggctgcaggaattcgcacgagaccattacctagaacatctaatcgaaaagtttccctcctaatttggatgagtataacaagtggaaagcttcatttcagaagagaaaagattatttagatgctgtggcttcagatggttgtttgactcacagttcacaggggttggctgcaggggagatgatttacagtttgagagattacttgaaagattctgtcagcaatagcatctcagaccttaactggagtgcatctaanaggcggtctgggagacggtttagacaaggagacactgggacttcaactccaacctttagcggaagcccaggcaaagggggttttggccactctactgacacctcatagaagaaaggcactgaagaaactcacaggctttctttatcaagtccagtaaaaatcacgcanaggccactccgaaactgcagcatagactcaaagtcaaaagaatcagaaacaagggataccactttgcatccactgatttttcaggaggatgggcttgcagatnatacttttgtgactttacagnntaagaatggagagggctctaagcaggggtataaacgggaacatgcatcatctgtaactggtgcaatcaagagttttctcttcccacttttgagaactgctgcaatggggag

SEQ ID NO: 33260 - DNA, 713 bp, Zea mays
  misc_feature: Ceres CLONE 1410877-F
  misc_feature: Encodes the peptide sequence at SEQ ID NO. 33261
  misc_feature (561)..(561): n is a, c, t, g, unknown, or other
  misc_feature (664)..(664): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
aagagctggagctccccgcggtggcggccgctctagaactagtggatcccccgggctgcaggaattcgcacgagaccattacctagaacatcctaatcgaaaaacctcatggctcacgcgaataccacacccacaccacaccacacctcacggcgtccattcattcccgtctcgtcttccgctgcttgcctccaactccccccgcgtcgtctcgtgcttcccaatcaccatagagccggttgatccccaaaggcccatggttttctccgacgccgcgtcgcctctcgtagccaccgccgctgactctgcttcctcctgcgtcgcccacctcccctgctgctgtcgcgttagttgttgccgttgttgttgaagacgcgtagctcgagggttcgtgatttctcgccgatcggttcgggaactggtaagctatggatctctcgcggcccgcatcgtcagacctctcgctcgggctgcactctcatgcccacgcccacgctcgcgtgcatgcggcagccgcgccgctgcgcctgttcgacgacgcgaagccgaagcgcctcgtgnccggggaggccgacgcggagaaggacgaaacgggaacgtggcgaccagcacttctccctcctcggcactccctctgcgtcagcgcccgcgcgcgcgtcaacgnggggggnnngcggggnnnnnnnnaaaaaaaatcatcctgctcgtccccg

SEQ ID NO: 33261 - protein, 95 aa, Zea mays
  misc_feature: Ceres CLONE 1410877-F
  misc_feature (45)..(45): Xaa is any aa, unknown, or other
  misc_feature (79)..(79): Xaa is any aa, unknown, or other
  misc_feature (82)..(82): Xaa is any aa, unknown, or other
  misc_feature (85)..(85): Xaa is any aa, unknown, or other
  misc_feature (86)..(86): Xaa is any aa, unknown, or other
  misc_feature (87)..(87): Xaa is any aa, unknown, or other
MDLSRPASSDLSLGLHSHAHAHARVHAAAAPLRLFDDAKPKRLVXGEADAEKDETGTWRPALLPPRHSLCVSARARVNXGGXRGXXXKKSSCSSP

SEQ ID NO: 33262 - DNA, 663 bp, Zea mays
  misc_feature: Ceres CLONE 1410878-F
  misc_feature: Encodes the peptide sequence at SEQ ID NO. 33263
  misc_feature (342)..(342): n is a, c, t, g, unknown, or other
aaagctggagctccccgcggtggcggccgctctagaactagtggatcccccgggctgcaggaattcgcacgagaccattacctagaacatcctaatcgaaaaatccgaactccgaaaagccccccagcggcctcccctccgccccgcagccatggccgccaccggcgtggtcgccgagccgaagaccaagtacgatcgccagctcaggatatggggtgatcaggccaggtgcactggagaagctagcatatgcttgcttaactgtggtctaccggaccccgagcatgagaatctcgtgcttggagcataggaagtgtgactggttgtgatggctcccaagtngaatcatctgaccgtgggggaaaaacaattttttctggtgaatgaaggatgttgggggccacccaaagctaaatctatttgttctttccttacaaaacttaaatgacccttttaaagcccaagtttggttgaggggttccccggggcattagaaaaaaacaaaaccttctttttttttcccaatttaaggggggttttgggcccccccttttcaaaagaggtttttttcgggacgtaaatatatttggggagaaaaagaaaatccttttttggtgtggggggccttttgggggccccaccccgggtttggagggggaaaaa

SEQ ID NO: 33263 - protein, 52 aa, Zea mays
  misc_feature: Ceres CLONE 1410878-F
MAATGVVAEPKTKYDRQLRIWGDQARCTGEASICLLNCGLPDPEHENLVLGA

SEQ ID NO: 33264 - DNA, 722 bp, Zea mays
  misc_feature: Ceres CLONE 1410880-F
  misc_feature: Translation starting site: 584
  misc_feature (525)..(525): n is a, c, t, g, unknown, or other
  misc_feature (526)..(526): n is a, c, t, g, unknown, or other
  misc_feature (576)..(576): n is a, c, t, g, unknown, or other
  misc_feature (633)..(633): n is a, c, t, g, unknown, or other
aaagctggagctccccgcggtggcggccgctctagaactagtggatcccccgggctgcaggaattcgcacgagaccattacctagaacatcctaatccaaaagttggtgacaccataaccactcctgttcgtcgtgcacccacgcgggcgaacagtgaaaggcatcgtctcgacgtctcgtgaccgctggactcgccgccgccccaggctagctcgatgattgggtgcgccaagccgctcgcggcgccgctgcaggcatgggctcgcccgccgtctcccgccggtcgccgcctccccccctcgttctgcgcccctgacacctccccagctctcacccgcgccgtcgagagcccaggccagtctcagtctgacgacgccccgccaccacgctcgggtgacgccgcctcgtccctggcgccgcgcgcgagctcgcatctcgaccgatggtcccggtcgcggggcgctgcggtcgggccaccggccggcgctgaaccgcgcggctctctcctcggcctcggtctcggnngccgcccggtgatcaagtcgccgcggcccgaggaccttgcccgtggcggntggagggatggcgagggacgacgaccgtgtgcgaggcccgagagggacgccgccggnccgggaaggccatctacatagtgtcagaaggggaccgggtgggaccgcggagcactccggtgaacgccgccgttcggacaggttcgaga

SEQ ID NO: 33265 - DNA, 713 bp, Zea mays
  misc_feature: Ceres CLONE 1410881-F
  misc_feature: Encodes the peptide sequence at SEQ ID NO. 33266
  misc_feature (428)..(428): n is a, c, t, g, unknown, or other
  misc_feature (429)..(429): n is a, c, t, g, unknown, or other
  misc_feature (460)..(460): n is a, c, t, g, unknown, or other
aaagctggagctcaccgcggtggcggccgctctagaactagtggatcccccgggctgcaggaattcgcacgagaccattacctagaacatcctaatcgaaaaaacccggctgtgctgtctcgtcgccttcctcccctcctgccggctgctgccgccgccagccgctgcaggcacgcttgccctctgctccctgtccatccactcatcattccccgtcatccaccaattcacaacccaaaaccctaaacccatttacctcaacgccaccgccgccgccgcgatgcagtccatggcgcccacctctccctcactcccggtggcaggccccgttccccgccgccgcctccagcgcgtccgcgccgccgcggtctccgacgagcccaaactcaacaagtacagcgcgcgcatcacggagcccaagtcgcagnncgcctcgcaggcggctcttacggtgggcttnaaccacaagacgccgaactcggaaagccggaagggtcgcgtcctcttcggtggggtacgaagggaacacctgcaacatgcacctgctccgcctcgccgaggccgcccgcgacggcgtccgtgaagccggcatggtcggcttccgattcaccaccgtcggtgtcagcgacgccatctccatgggcacccggggcatgtgctacagccttcagtcccgcgacctcatcgccgacagcatccgagaccgtcatgga

SEQ ID NO: 33266 - protein, 59 aa, Zea mays
  misc_feature: Ceres CLONE 1410881-F
  misc_feature: SWISSPROT Homolog: EC 4.2.1.9 Dihydroxy-acid dehydratase
MHLLRLAEAARDGVREAGMVGFRFTTVGVSDAISMGTRGMCYSLQSRDLIADSIRDRHG

SEQ ID NO: 33267 - DNA, 702 bp, Zea mays
  misc_feature: Ceres CLONE 1410883-F
  misc_feature: Encodes the peptide sequence at SEQ ID NO. 33268
  misc_feature (333)..(333): n is a, c, t, g, unknown, or other
  misc_feature (348)..(348): n is a, c, t, g, unknown, or other
  misc_feature (351)..(351): n is a, c, t, g, unknown, or other
  misc_feature (367)..(367): n is a, c, t, g, unknown, or other
  misc_feature (368)..(368): n is a, c, t, g, unknown, or other
  misc_feature (426)..(426): n is a, c, t, g, unknown, or other
  misc_feature (444)..(444): n is a, c, t, g, unknown, or other
  misc_feature (466)..(466): n is a, c, t, g, unknown, or other
  misc_feature (468)..(468): n is a, c, t, g, unknown, or other
  misc_feature (469)..(469): n is a, c, t, g, unknown, or other
  misc_feature (669)..(669): n is a, c, t, g, unknown, or other
aaagctggagctccccgcggtggcggccgctctagaactagtggatcccccgggctgcaggaattcgcacgagaccattacctagaacatcctaatcgaaaaatatattcacctgagccaggtcgctgtttcatcatcgtgcttgactgcagtctgcagggggtgtggccgcgctgcagcctgcctgtcaatctcgatcgatcaaggggtggcgtgccgagatggcggaccggccgtcgcttcctgctctcattattgctatcgccgttcttgctggcagttactgccgcgtggcgagctcggcctcgccggcggtgaaaatgagctgcgcgntgaaggaagaaccgncgntccgacgacgatgcgnncgcgcgcggcgtcggtgatggtgcccatcaccatcctcaagtccgcttgtagcgacgnagctgtgtgcatggatgnaacgccacctgcttaccacttngnnatctgctcccggagcggcagcagaagctggattgtgaacttagagggaggtgcgtggtgcaacagcgccaagacatgccggctcacccagagctcccggccgtgctcgtcgaacacatgggcaaagagatccccttcacggcatcatgagcagcagccgtaccgtgaatcctgatttctacatctgaaccggggtcaggntcgctactgtgacggtggatcttttgcggcgag

SEQ ID NO: 33268 - protein, 93 aa, Zea mays
  misc_feature: Ceres CLONE 1410883-F
  misc_feature (3)..(3): Xaa is any aa, unknown, or other
  misc_feature (22)..(22): Xaa is any aa, unknown, or other
  misc_feature (28)..(28): Xaa is any aa, unknown, or other
  misc_feature (35)..(35): Xaa is any aa, unknown, or other
  misc_feature (36)..(36): Xaa is any aa, unknown, or other
MRXRAASVMVPITILKSACSDXAVCMDXTPPAYHXXICSRSGSRSWIVNLEGGAWCNSAKTCRLTQSSRPCSSNTWAKRSPSRHHEQQPYRES

SEQ ID NO: 33269 - DNA, 643 bp, Zea mays
  misc_feature: Ceres CLONE 1410886-F
  misc_feature: Encodes the peptide sequence at SEQ ID NO. 33270
  misc_feature (515)..(515): n is a, c, t, g, unknown, or other
  misc_feature (516)..(516): n is a, c, t, g, unknown, or other
  misc_feature (534)..(534): n is a, c, t, g, unknown, or other
ggagctccccgcggtggcggccgctctagaactagtggatcccccgggctgcaggaattcgcacgagaccattacctagaacactaatcgaaaaattgtgttagccgatgtcactctgcttttagccttttgccaagtgccaacaaccaggtcgaaaggacatctgaccggcagcaggcagacatccgtcgtccgccatggagtcctcatggctcctcctgctctcgtgccttccggccgtatgggtgcttgccgcggcggcggggcggagtcccggctgcgcgacgaggtgcggcgagatcgacgtcccgtacccgttcggctggaccgcagtcgcgatcacgccggcttttgctcactgcaccacgtggatggcgccaccagctgctcgacagaactcggaggtgaccagatctcccgtgagatggcaggcctggtttcagacttcatccccggaagtgctatcaccaatctcgggtgaactgttcgaaaccacgcgtgggtcgatatacggnnagccctaacgtttgtcgnaaaaggataatagatctccgcctccgggggaaaagttggcctacatgcaaagggcctttaataatcggttcatgtcaaatgggacaccccctgaaaaaaggtctggtcc

SEQ ID NO: 33270 - protein, 108 aa, Zea mays
  misc_feature: Ceres CLONE 1410886-F
  misc_feature (107)..(107): Xaa is any aa, unknown, or other
MESSWLLLLSCLPAVWVLAAAAGRSPGCATRCGEIDVPYPFGWTAVAITPAFAHCTTWMAPPAARQNSEVTRSPVRWQAWFQTSSPEVLSPISGELFETTRGSIYGXP

SEQ ID NO: 33271 - DNA, 697 bp, Zea mays
  misc_feature: Ceres CLONE 1410887-F
  misc_feature (477)..(477): n is a, c, t, g, unknown, or other
  misc_feature (657)..(657): n is a, c, t, g, unknown, or other
  misc_feature (679)..(679): n is a, c, t, g, unknown, or other
aagctggagctccccgcggtggcggccgctctagaactagtggatcccccgggctgcaggaattcgcacgagaccattacctagaacatcctaatcgaaaaatgcgtaatcgtctttcggaattgaatctctccatgtcatggcgctctgagcaagtacagctgcagtcagtgagagaaatgtaggcaccacaaatcagtccagcaaatccctgctcgtgctctaccaaaaaatccagtctttttccagcccaaatccgcctcttccgctgctgccataaagtccggactttacgaggctttcacgacgtgcgagatttctgttatcgatctccacgaacccgatagcctgccataaagtctgcacagacgcttcgcattgcttcaaccaaagatccatccaaactctgcaccccagagagctagtacgatctcggggggacatgaagcgcctgcagtgcttcaagcagagcagcgncggcggcaatgggtggcggcccgggaagcgccttgagcggcggctgtcgcttggcgagtacagaaagcagtgtcgtggtccagtacctcgtagcgccgcaggccgcagaatcccggagcgcgccaaagactgtgaaccgcccacctgtcaagcttgagatcggggcagttggcgtcaggncggaacaccgcgtctactcggnaggtacaccgccgggagt

SEQ ID NO: 33272 - DNA, 696 bp, Zea mays
  misc_feature: Ceres CLONE 1410888-F
  misc_feature: Encodes the peptide sequence at SEQ ID NO. 33273
  misc_feature (303)..(303): n is a, c, t, g, unknown, or other
  misc_feature (326)..(326): n is a, c, t, g, unknown, or other
  misc_feature (327)..(327): n is a, c, t, g, unknown, or other
  misc_feature (354)..(354): n is a, c, t, g, unknown, or other
  misc_feature (384)..(384): n is a, c, t, g, unknown, or other
  misc_feature (385)..(385): n is a, c, t, g, unknown, or other
  misc_feature (388)..(388): n is a, c, t, g, unknown, or other
  misc_feature (431)..(431): n is a, c, t, g, unknown, or other
  misc_feature (432)..(432): n is a, c, t, g, unknown, or other
  misc_feature (510)..(510): n is a, c, t, g, unknown, or other
  misc_feature (513)..(513): n is a, c, t, g, unknown, or other
  misc_feature (514)..(514): n is a, c, t, g, unknown, or other
  misc_feature (589)..(589): n is a, c, t, g, unknown, or other
aaagctggagctccccgcggtggcggccgctctagaactagtggatcccccgggctgcaggaattcgcacgagaccattagaacatcctaatcgaaaaaatcgatcactcgcgtgtctaggtttcctctctcaccatagcgcccgctctgtcgcccttcgttcaccttctccttcctctcgtccctgcctgccagggagaggggaagtcagaggcacggagtggcgcagagcagacgcccgtgaaccattgtagcttgtcctgtcgtcgtcgtcgtcaacgaacccacacaaggaaaggatgnagaagaagccgaccatcctcatnngacagtacgagcttcggcgcacgctcnggcagggcaccttcgcaaggtgtaccacgnncgnaacctcgcgtcgggcgagagcgtggccattcaggtcatcgacnnagagaaggtgatgcgcgtccgcatgatcgacccagatcagcgcgagatctccgtcatgggccttcgtcgcaccccaangtnntgcacttgccagagtgatggcagcaagagcaggaatacttcgcatggagtactttccgggggggaagattttcgnccgggtccccgggggcgggttaaaggagacgcccggaagaagtacttcacagtcttttggggccgttcattctgcaaagagcggggggtctaccacgcgacctcagc

SEQ ID NO: 33273 - protein, 84 aa, Zea mays
  misc_feature: Ceres CLONE 1410888-F
  misc_feature (23)..(23): Xaa is any aa, unknown, or other
  misc_feature (24)..(24): Xaa is any aa, unknown, or other
MRVRMIDPDQREISVMGLRRTPXXCTCQSDGSKSRNTSHGVLSGGEDFRPGPRGRVKGDARKKYFTVFWGRSFCKERGVYHATS

SEQ ID NO: 33274 - DNA, 697 bp, Zea mays
  misc_feature: Ceres CLONE 1410889-F
  misc_feature: Encodes the peptide sequence at SEQ ID NO. 33275
aagctggagctccccgcggtggcggccgctctagaactagtggatcccccgggctgcaggaattcgcacgagaccattacctagaacatcctaatcgaaaaaaaaccccacagaagcgtttccttcgctcgcttcacttcgctccgccgcgtcctcgaaagtcgaaacccccacccgtcatggagccacccgcgtggtcgccgccgcgtgaggaggaggaggagaccgagatcgacttcgacgaggaggaggacccggaggaggtggagccgtggttcacgtcctccggctcggagccggagctagaaccagagccagagccgaagcacccggcgccgaccccatcccccgcccccgcttgggctgagccggagcagcagccggctccggtcacggcggtggaggcgacgaaaaagggcgagggggaggatgcgaggccgcggtggcccgggtggcccggcgcgagcgtgttccgcctggtggtgcccgcggacaaggtcggcggaatcatcgggcggcgcggcgacaccatcaagcgcctctgcgacgagacccgcgcccgcgtccgcgtcctcgacgccccgcacggggacggggccttcagccggattgttttagtgtctgcaagagaagagttgaagcagagttgtcacctgcaatgaatgctgcaattagatcttcaagcatataacgagag

SEQ ID NO: 33275 - protein, 160 aa, Zea mays
  misc_feature: Ceres CLONE 1410889-F
  misc_feature (97)..(153): Pfam Name: KH_1 Pfam Description: KH domain
MEPPAWSPPREEEEETEIDFDEEEDPEEVEPWFTSSGSEPELEPEPEPKHPAPTPSPAPAWAEPEQQPAPVTAVEATKKGEGEDARPRWPGWPGASVFRLVVPADKVGGIIGRRGDTIKRLCDETRARVRVLDAPHGDGAFSRIVLVSAREELKQSCHLQ

SEQ ID NO: 33276 - DNA, 711 bp, Zea mays
  misc_feature: Ceres CLONE 1410890-F
  misc_feature: Encodes the peptide sequence at SEQ ID NO. 33277
aaagctggagctccccgcggtggcggccgctctagaactagtggatcccccgggctgcaggaattcgcacgagaccattacctagaacatcctaatcgaaaaaatccccttctccgtcctcccgcctgccgccatgtcttcgccttcgccctcgccgccggcgccgtaggaagagaagggccggacgccgaccaagaacgcgctgatcaccgtcgacgccgtcagcggcctcagcaaggacgacatcgccaggagcatcggagacgtcctcaaggcctgcggtttccgcgtcacttgcatcaagatcgatccatacttgaacacagatgctggtacaatgtccccctttgagcatggcgaggagtttgttcttgatgatgctggagagattgacttgctctcgcagaattatgagcgtttcatagatgttactctgacgaggtataacatcattaccactggaaagatatactaggctgtcattgagaaggatagaagaggtgattatcttggaaagactgtgcaggttattcctcatgccactgatgaaagtaaacagtgcatacagacagtgacttcggtttctgtgcatgttagactacgtcagctgcatgttgggtattggatagcacgcactgtacgtgatattgagcgatcccatcagtgaagcttgcgcgaataccttttcactggcaagtaaattctgcctca

SEQ ID NO: 33277 - protein, 45 aa, Zea mays
  misc_feature: Ceres CLONE 1410890-F
  misc_feature: SWISSPROT Homolog: EC 6.3.4.2 CTP synthase
MSPFEHGEEFVLDDAGEIDLLSQNYERFIDVTLTRYNIITTGKIY

SEQ ID NO: 33278 - DNA, 676 bp, Zea mays
  misc_feature: Ceres CLONE 1410892-F
  misc_feature: Encodes the peptide sequence at SEQ ID NO. 33279
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (293)..(293): n is a, c, t, g, unknown, or other
  misc_feature (349)..(349): n is a, c, t, g, unknown, or other
  misc_feature (388)..(388): n is a, c, t, g, unknown, or other
  misc_feature (468)..(468): n is a, c, t, g, unknown, or other
  misc_feature (584)..(584): n is a, c, t, g, unknown, or other
  misc_feature (631)..(631): n is a, c, t, g, unknown, or other
  misc_feature (632)..(632): n is a, c, t, g, unknown, or other
tggagctccccgcggtggcggccgctctagaactagtggatcccccgggctgcaggaattcgcacgagaccattacctagaacatcctaacaaaaagcgttctgtggccgccgcccttctgccgtccgaccggaccaggtcgccgacgtcgcccctatcccgcacgcgtcatcgcagcgcctccgagtctccgccaagatctgcctcggccacggcgcggcgccgctggagctgcagccgtccagccgactgccttccgnnncgacacgaccaccgaccactgggcgagccgncgcagctagctgcgctttgaagcatggggtcgttttgaccagttactcccagaggnccttgaacttatcagcatgatgagcagcgctccatacgnttacatgcatttttctgtctatcacacgttccctgcaggcacttttatttatctccttaaggactgctatggatattggnacgaaccaagccaactccaaggttaaggatctcctgcagcttgtaaaagtggcattggcataatggtccccagccaggcccgtcacactatgttggccagggggtgtgatattggnacctctgctgggggaaactatatttttggaagggtcagacctaaggnntgcatctccctcttaaagccattggatctctgtggatcagcaaa

SEQ ID NO: 33279 - protein, 42 aa, Zea mays
  misc_feature: Ceres CLONE 1410892-F
  misc_feature (8)..(8): Xaa is any aa, unknown, or other
  misc_feature (35)..(35): Xaa is any aa, unknown, or other
MMSSAPYXYMHFSVYHTFPAGTFIYLLKDCYGYWXEPSQLQG

SEQ ID NO: 33280 - DNA, 663 bp, Zea mays
  misc_feature: Ceres CLONE 1410893-F
  misc_feature: Encodes the peptide sequence at SEQ ID NO. 33281
  misc_feature (478)..(478): n is a, c, t, g, unknown, or other
  misc_feature (522)..(522): n is a, c, t, g, unknown, or other
  misc_feature (590)..(590): n is a, c, t, g, unknown, or other
  misc_feature (595)..(595): n is a, c, t, g, unknown, or other
  misc_feature (622)..(622): n is a, c, t, g, unknown, or other
cgctctgaactagtggatcccccgggctgcaggaattcgcacgagaccattacctagaacatcctaatcgaaaaagtgtgagagctcgattcgttgccgtccacttgtctcacggcctgtcgccatctccttcctggttttttcatccgaccatccccggctcctccgcgccgtcggcgacgactccatcgagtcactcggccgcagcaaccggcgaccatgtaccgagtcgcctccgggctcggcgccctcaagaggcatggggcaaatgctcaaatgatgaatgctgcaattaggtgtgccagcacaagtgttgcacagaggtcttccggtggcttgtggacctggttgactggtgcgcgttcaaatgaaatacctcctccagatttcacacttccgggagtgactattcctcctccgctgcctgaccatgtggaggctggcaaaacaagagtcacaacacttcccaatggtgttnaaatagcctctgagacatctgcgggatcatcttgttctgttggnagttatgttgattgtggttctgtatatgaagcacccctgaacacaggtgccagtcaactgttgaaganatggncttcacaccactgccacaggagtgagntgggtgtgcgtgaaatggagcaatagtgccagtgccaagca

SEQ ID NO: 33281 - protein, 142 aa, Zea mays
  misc_feature: Ceres CLONE 1410893-F
  misc_feature: SWISSPROT Homolog: EC 3.4.24.64 Mitochondrial processing peptidase
  misc_feature (87)..(87): Xaa is any aa, unknown, or other
  misc_feature (124)..(124): Xaa is any aa, unknown, or other
  misc_feature (126)..(126): Xaa is any aa, unknown, or other
  misc_feature (135)..(135): Xaa is any aa, unknown, or other
MYRVASGLGALKRHGANAQMMNAAIRCASTSVAQRSSGGLWTWLTGARSNEIPPPDFTLPGVTIPPPLPDHVEAGKTRVTTLPNGVXIASETSAGSSCSVGSYVDCGSVYEAPLNTGASQLLKXWXSHHCHRSEXGVREMEQ

SEQ ID NO: 33282 - DNA, 646 bp, Zea mays
  misc_feature: Ceres CLONE 1410896-F
  misc_feature: Encodes the peptide sequence at SEQ ID NO. 33283
  misc_feature (337)..(337): n is a, c, t, g, unknown, or other
  misc_feature (412)..(412): n is a, c, t, g, unknown, or other
  misc_feature (413)..(413): n is a, c, t, g, unknown, or other
  misc_feature (440)..(440): n is a, c, t, g, unknown, or other
  misc_feature (471)..(471): n is a, c, t, g, unknown, or other
  misc_feature (502)..(502): n is a, c, t, g, unknown, or other
tggagctccccgcggtggcggccgctctagaactagtggatcccccgggctgcaggaattcgcacgagaccattacctagaacatcctaatcgaaaactcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggtgtcgacggcctcccgccggggcctccgggttggnctggtggtggggaacctggttccaggtgatcctgcagcgactgccctttcatgtacgtggtgcgcgaccttccgnnagaagtacgggccatctcaccatgcgnatgggcagcgcacctcatcgtgtcacctcgncggactcatcacgaggcgctggtgagcaggncccatgttccgagcgggccggagaaagcccaccgcctcttcttagggtcggaagtggaccgtaactcggggctacggccccctgtggggggttttggcccaatttttttccccaaaattgtgtccccaccggggaagggtttct

SEQ ID NO: 33283 - protein, 47 aa, Zea mays
  misc_feature: Ceres CLONE 1410896-F
  misc_feature (39)..(39): Xaa is any aa, unknown, or other
MDVNDVLLVVLAAALAAMWWRRCSKTGVDGLPPGPPGWXGGGEPGSR

SEQ ID NO: 33284 - DNA, 691 bp, Zea mays
  misc_feature: Ceres CLONE 1410897-F
  misc_feature: Encodes the peptide sequence at SEQ ID NO. 33285
  misc_feature (609)..(609): n is a, c, t, g, unknown, or other
  misc_feature (613)..(613): n is a, c, t, g, unknown, or other
aagctggagctccccgcggtggcggccgctctagaactagtggatcccccgggctgcaggaattcgcacgagaccattacctagaacatcctaatcgaaaaaccccaaagctccgcctccgcaccttctctcactcgcccagccgcggctatggcggccaccacatccacggcggcggcggcagtatccttctccctcccctcaccaccgcactgccgcggggcccggcgccgccgcgcgccttccctcctccgtgccgcctccaccgccgcgcccccctcccccgacctctccatccagctctcgccccgcgcgtccccgcccgcgtctaccaacggcgccgccaccgcgcttggaccccccgtgtccgcctcctttgcccgtgaccgcgccgaggacctgcaggccgaggcccgcgcgatggcccgcgccgctggcgccacagtctacagtcccgagctcctcgccgcccgctacggctcccgccccttcaaggtggcgctccggggcaggggaggtgctgtccaagttggcgtcgttcgggggtggaagtcctactggacgagcgggagaagggagtcgtcattcggagaggagcgcgccaggggnccgntggagttgcgcaccatcttcactaggctcggcccaaccttcgtcaaaaattgggacagggcctggtcacgcgccccga

SEQ ID NO: 33285 - protein, 180 aa, Zea mays
  misc_feature: Ceres CLONE 1410897-F
  misc_feature (155)..(155): Xaa is any aa, unknown, or other
MAATTSTAAAAVSFSLPSPPHCRGARRRRAPSLLRAASTAAPPSPDLSIQLSPRASPPASTNGAATALGPPVSASFARDRAEDLQAEARAMARAAGATVYSPELLAARYGSRPFKVALRGRGGAVQVGVVRGWKSYWTSGRRESSFGEERARGPXELRTIFTRLGPTFVKNWDRAWSRAP

SEQ ID NO: 33286 - DNA, 699 bp, Zea mays
  misc_feature: Ceres CLONE 1410899-F
  misc_feature (286)..(286): n is a, c, t, g, unknown, or other
aaagctggagctccccgcggtggcggccgctctagaactagtggatcccccgggctgcaggaattcgcacgagaccattacctagaacatcctaatcgaaaaaacggtgtcctgcacttgcacccctatgccgtcgccgcggcggcagcggcattgatctcggcgtacatggtgtggttctgggcgctgacgcgacggctgtccgggccgcggatgtggcccctcgtcggcagcctgcccagcgtcgtcctgaatcgggcgcgggttcacgactggatcgtcgacnacctgcgctcaaggggggaaagcgtcacttaccaaacgtgcatcttggcgctggccgttcttggcccggcgcccgggggctggtgaaccgtcacggggcaacccgggggacctggagcaccatcccgggcgggggggtttcaacaatacccccaggggcccatgtggggaggggggggttccccaaattcccggggccaagggatcttcacctcccacgggggaaaatggggttgtcccacggcaaaaaggggggggctccaggttcccccccaaggacctttggccacaaggaaggggcccttgggccaacccgcacatccaggacggcccgggggggggaaccccccaaaaaacatttggaggccccccggaaaggggggaaacccccggaacgtgggtttgggggccacc

SEQ ID NO: 33287 - DNA, 673 bp, Zea mays
  misc_feature: Ceres CLONE 1410900-F
  misc_feature (441)..(441): n is a, c, t, g, unknown, or other
  misc_feature (452)..(452): n is a, c, t, g, unknown, or other
  misc_feature (489)..(489): n is a, c, t, g, unknown, or other
  misc_feature (494)..(494): n is a, c, t, g, unknown, or other
  misc_feature (673)..(673): n is a, c, t, g, unknown, or other
ggagctccccgcggtggcggccgctctagaactagtggatcccccgggctgcaggaattcgcacgagaccattacctagaacatcctaatcgaaaaaacaatgagtccgcgcccacggccgaggcagctgcaggcagcggcccgtccggcgtataagggcggaagggcaaggcgcccaaggccggccccgagaacggcaagttccggtaccgcggcgtgcggcagcggagctggggcaagtggctggagtagatccgcgagccgcgaaagcgctcccgcaagtgggtcgtcaccttcgccaccgccgaggacgccgcgcgcgcctacgaccgtgccgtgctcctcctctacggcccccgtgcgcacctcaacctcacctccccagcgaccgtctacgctcgccgcgccgcgctcgcacccgcactcctcctccgccacgtngtctgccccgncagcgctccgcccgctcctgacgcgcccgccactgcnacagntctacagcgatggtgctcctgcacaggatttcacttacacaacagtttcagcgtcgtctcttgcagagccgactgcgacactatactacgccaacacggccacggagtcacagtgaccaccattgtgcgacacgggtgctgtccccgcagagctgtcatcgcgcccgagtaggatcctn

SEQ ID NO: 33288 - DNA, 696 bp, Zea mays
  misc_feature: Ceres CLONE 1410901-F
  misc_feature (460)..(460): n is a, c, t, g, unknown, or other
  misc_feature (461)..(461): n is a, c, t, g, unknown, or other
tggagctccccgcggtggcggccgctctagaactagtggatcccccgggctgcaggaattcgcacgagaccattacctagaacatcctaatcgaaaaatacaacggtgtcagcggcctccctacgccaccgtcctcatccgccgccgtcgtccactacaccgccacggtcgtcctcggtcgcgaccgcgcccttcgttctcatccagcgccacggtctagggtttgagcactcctccatcgtctccttgcctcttctccatcatctccttgcctcttctctcctctgtgttctccctctggtcacggtcttgtttgctcttttgtttttcattcaaatcgtcgtgcatccagatctggcgtctatttttgcgccaatgcttatttcttgcagaaaccaggcatccagatctagcgtgttctgagcacaaaagtgtacaggcatgacctattgatcaggannagtgtagcagacacgttcgtcgtcgcgacatcgtcgagccgtgtggctactgcgctggccggtgagcatcgtcaagtcgggtggctgctgcccctgacagcacgatgcgtctctggtctccatgatgattagatgcacctgatcaccgctctctgaacactgatcacgggagctcttcatatttaggagggatgggacatcagggtttgcacagagtttatggtgtctacccatt

SEQ ID NO: 33289 - DNA, 704 bp, Zea mays
  misc_feature: Ceres CLONE 1410905-F
  misc_feature: Translation starting site: 286
  misc_feature: SWISSPROT Homolog: EC 6.3.5.5 Carbamoyl-phosphate synthase (glutamine-hydrolyzing)
aaagctggagctccccgcggtggcggccgctctagaactagtggatcccccgggctgcaggaattcgcacgagaccattacctagaacatcctaatctaaaaagtgtttcagcagcaatctctctgtgtctgtgaccaccacaaggtggcgttaccgccgtctcgccgccgacgccgccgacgtgatactacaggtgcgaggtcttcatcggtatcttaataggcgacgaacaccaaccaaccccctccctgccctgcgaagcctgccccagtctgcactctacgatggcggcggctccagccacggctgccgcggactcccggcggctctctgtcgccaagtcgtgccggcctgctgagcggatctccacctcgattggcgtctcggcgccttctactggcctccggcaaagtatgagccgcgtcctcatcgtccgtgccaaggttgccactggagtgcatagatccagcactgtgaatgatggagcgaataggacgtgaaagctcagagatgctcgtcttgtcctgtaacatggatcagtgtggaggaccaagtcttttggcgcttatgaacacaagtcggagaatctgatttcaagacatcactgactggctatcgggacattttgacagatgcaagctatgctggacaatttgtcatgatgaccaatccgcatattgataagactggcagtaatcctgac

SEQ ID NO: 33290 - DNA, 679 bp, Zea mays
  misc_feature: Ceres CLONE 1410910-F
  misc_feature: Encodes the peptide sequence at SEQ ID NO. 33291
  misc_feature (491)..(491): n is a, c, t, g, unknown, or other
  misc_feature (520)..(520): n is a, c, t, g, unknown, or other
  misc_feature (626)..(626): n is a, c, t, g, unknown, or other
ggagctccccgcggtggcggccgctctagaactagtggatcccccgggctgcaggaattcgcacgagaccattacctagaacatcctaatcgaaaaagaactgactccctcgatcccagcggcagcggcggaagcgaacggtgaccgcgacctcccctgaccctgaggctgcatatactcggatcgggtttcacatctccggttttggattggttggttgcccgcggtgatgggaggagagctgtggtggtatccataggggatcctcgtttgcgtccttgtgcgatggcttcgacctccgttcctgagttaaccgcggacaagaaatgcgacaaagccatcgcggatacggcggcaccacttacttctcagggacactccgaagaaccgactgggaaagtcagcacactagtgcctggctttgccggtgtaattgcagcaggcgatggggctgcatccagtggggtgatagaaaacagaaatggcatggnacattctgctgatgggtcttttgagcggnatgacagtgaaggtgctgagaagagctcgctgcggggaagcgtcaaggataagctcgtgtcgcctaaatgcagtgacagggcgagcagcctgttcaaagcagtggnagggcaagatcagcggtcacctgctgacatgatcaaaggggcaagagtatctt

SEQ ID NO: 33291 - protein, 131 aa, Zea mays
  misc_feature: Ceres CLONE 1410910-F
  misc_feature (69)..(69): Xaa is any aa, unknown, or other
  misc_feature (79)..(79): Xaa is any aa, unknown, or other
  misc_feature (114)..(114): Xaa is any aa, unknown, or other
MASTSVPELTADKKCDKAIADTAAPLTSQGHSEEPTGKVSTLVPGFAGVIAAGDGAASSGVIENRNGMXHSADGSFERXDSEGAEKSSLRGSVKDKLVSPKCSDRASSLFKAVXGQDQRSPADMIKGARVS

SEQ ID NO: 33292 - DNA, 706 bp, Zea mays
  misc_feature: Ceres CLONE 1410911-F
  misc_feature: Encodes the peptide sequence at SEQ ID NO. 33293
  misc_feature (217)..(217): n is a, c, t, g, unknown, or other
tggagctccccgcggtggcggccgctctagaactagtggatcccccgggctgcaggaattcgcacgagaccattacctagaacatcctaatcgaaaaatggcatctgcattgcagttgcagccacgccaacaactgggcagcggcgacatctgcatctcccacctcgtctccctcccgtatctgcaagccttgatcccgccgccagccatccatccnagggagccatgtctccatccggcgagctgctggcttccatctccctcgtcttcactgtcgccttcgtcctcctcgcctgcgtcgagctccgggacgccgccgccgccgccgtcggggtctaccgccctcatcagtagggactcgccggggctccgttcggtcccggggcgggggccttcaacaacaggggtgcggggtcccggtccccggcggggaaacctttcccggttcggcttggtggggcggttcctgaactccggtttcttttcctcaaaaggacctggggggaaaaaaaaatttgggggggttattccttttccgtcccgaaaaaaatgggaagggggggatgaaaaagggccaattctaagggggacttgttggggtttggaaaaattttttcttcggggaaaacaatttttaaacccgggggaacttttgttttggagagagacaactttggaaaaaccgttgggggaaaaatccaaaaaa

SEQ ID NO: 33293 - protein, 42 aa, Zea mays
  misc_feature: Ceres CLONE 1410911-F
MSPSGELLASISLVFTVAFVLLACVELRDAAAAAVGVYRPHQ

SEQ ID NO: 33294 - DNA, 672 bp, Zea mays
  misc_feature: Ceres CLONE 1410913-R
ccgattgggtaccgggccccccctcgaggtcgacggtatcgataagcttttttttttttttttttattttttttttttttttttttgaaaacgatggaaaagggagctattccaaataaacgtagttgctccgtttacaagacctgcgtagtttgacttttctgaaatcaatatacgctaattattgctggacaaggttgatgcccaatagaaaaactgtaaacgttattaagttttgttgcattcgacagccacctactagtaggtcaaaattaaactcccgcataacctaattgggctgagtttgctccagtttggttccgtggccccttcaaaggaggccccagatatgatggattcctcacttgttaataacctcaaccccccggggctctccgaccccctcctgtaacgggccctaagtcttttaagaagtcaaccacccccctcaccgaaggccccccagaaaggggcgggggccaaagaaaaccaacaaaaattatggggcttctaaccctttccactttgggggtgaaaacccccaaccggcggctggcgggaagttacatcttctccccgggaaaaataaaaacgggaaagggccccaaaaggggattctttcccccggaaatcccccccatgcttttttgtataaaagggcggttgggatgg

SEQ ID NO: 33295 - DNA, 737 bp, Zea mays
  misc_feature: Ceres CLONE 1410914-F
  misc_feature (433)..(433): n is a, c, t, g, unknown, or other
  misc_feature (492)..(492): n is a, c, t, g, unknown, or other
  misc_feature (496)..(496): n is a, c, t, g, unknown, or other
  misc_feature (606)..(606): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (677)..(677): n is a, c, t, g, unknown, or other
  misc_feature (722)..(722): n is a, c, t, g, unknown, or other
  misc_feature (723)..(723): n is a, c, t, g, unknown, or other
aagctggagctccccgcggtggcggccgctctagaactagtggatcccccgggctgcaggaattcgcacgagaccattacctagaacatcctaatcaaaaaaggccagcgtggaaactggaaaagctgcctccgccaaatccaaaccaaacgggacggtcgccggaggaagcatacccgaaactcccctcccctctccttacaataccgcgaggcggcggctgacgtcgcttagccgctttcccacaccttcgccgccgcctatactcctgcagaaatagcccgagggagggcggttgctgctgcatcgtgttcggtgttccttccctcgccgcacgcgggatccatttgacggacggaccgaccgagcgactcacccgtccaccgagagccatggggcagaggcagagccacagcaagcgggacgggagcangccacgggcggcggtcgcgctcctttcagcagcagccgtcggcgcagtggggcgccggnaggnaggagggtactaccagcaggacccaagcaccggctactagcggcgcgccggtgcaccaacagggggaaggagggtactaccaacaggacccaggcaccggctactacggncgcgcggtgcacagnnnaaggggagggaggggtacgccgcgccgtaccgggacaggcccgccccgcttgtncgcggttgctgctccccgggcgccgcaaggctgcgaagccgcggnncagcttggatcgcc

SEQ ID NO: 33296 - DNA, 744 bp, Zea mays
  misc_feature: Ceres CLONE 1410916-F
  misc_feature: Encodes the peptide sequence at SEQ ID NO. 33297
  misc_feature (205)..(205): n is a, c, t, g, unknown, or other
  misc_feature (289)..(289): n is a, c, t, g, unknown, or other
  misc_feature (330)..(330): n is a, c, t, g, unknown, or other
  misc_feature (331)..(331): n is a, c, t, g, unknown, or other
  misc_feature (408)..(408): n is a, c, t, g, unknown, or other
  misc_feature (418)..(418): n is a, c, t, g, unknown, or other
  misc_feature (479)..(479): n is a, c, t, g, unknown, or other
tggagctccccgcggtggcggccgctctagaactagtggatcccccgggctgcaggaattcgcacgagaccattacctagaacatcctaatcgaaaaagtttctatcttgctccccaaaccagcgcaaaccctgccctgacaccggcagcgacacgtccaccggcggcgccatggtgctcgaggcaacgatgatctgcatagacnattcggaatggatgcggaacggcgactacgctccgtcgcggttccaggcgcaggccgatgccgtcaacctcatctgcagcgccnagacccagtcaaacccggagaacacggtaggcgtgatgacnnatggccgggaagggtgttcgcgtgcttgtcacttcccaccagcgaccctcggaagattctcgcctgtatgcacgggnttagaagttngcgctgaagcaaacttggctgcggcaaatccagttgcccagcttgctcttaagcatcgccngaccaaaaggcgcaccaaaggaattaatctttcaatggaaggccctggaaaacaaaacaaaaaatttttggaaacctttggaaaaaaattaaaaaaaaaagtggtcctttgaaaattttgaacttttggggaaccccgtgaaaaaaactggaaaaaggggatttttttttgtggtttttaaacacgggataaccccctttttgtttttccccctgggaaaaggcccccctttgggtctcccaaaccttttttttggggggaaaga

SEQ ID NO: 33297 - protein, 139 aa, Zea mays
  misc_feature: Ceres CLONE 1410916-F
  misc_feature (12)..(12): Xaa is any aa, unknown, or other
  misc_feature (40)..(40): Xaa is any aa, unknown, or other
  misc_feature (54)..(54): Xaa is any aa, unknown, or other
  misc_feature (83)..(83): Xaa is any aa, unknown, or other
  misc_feature (103)..(103): Xaa is any aa, unknown, or other
MVLEATMICIDXSEWMRNGDYAPSRFQAQADAVNLICSAXTQSNPENTVGVMTXGREGCSRACHFPPATLGRFSPVCTGLEVXAEANLAAANPVAQLALKHRXTKRRTKGINLSMEGPGKQNKKFLETFGKKLKKKVVL

SEQ ID NO: 33298 - DNA, 688 bp, Zea mays
  misc_feature: Ceres CLONE 1410917-F
  misc_feature: Encodes the peptide sequence at SEQ ID NO. 33299
  misc_feature (237)..(237): n is a, c, t, g, unknown, or other
aaagctggagctccccgcggtggcggccgctctagaactagtggatcccccgggctgcaggaattcgcacgagaccattacctagaacatcctaattgaaaaaaacccacagaagtaacaggggcacactagctaagctaaacctcgccacggcacagcaatgacgccgctccccgcttccctcctgccctgcctctggatcttcctctgcctcctcgccgagccgtgccccacagngagtgctgagtcgttcgcgtgcatcgccacggatccgcgagcgtcacatgccaggctctcgactactagcgcagccctacgagactcacacgacgctgcagcacgccgagagcgcgtgctacctggtcccctctaaccgcgaacctgccgtaatcaacgatgctcgctctataaagcactcccatgggtccggtcgaccggcgccttcgagaaaaacgcgaccgctctttccacctttggttgccgaaagcacccaagaaacttccaacttccacccccgatgagaagccccccgattgccgggtcccatatgagccagggcccgccgggactcgaggggaaaaaaagttaaacccgggagggggctccaccccccccggacacaaaaaagaggataatgggcagggggaaaaaagtgcccaccccccccttttgggggggggacaaaaaa

SEQ ID NO: 33299 - protein, 70 aa, Zea mays
  misc_feature: Ceres CLONE 1410917-F
  misc_feature (26)..(26): Xaa is any aa, unknown, or other
MTPLPASLLPCLWIFLCLLAEPCPTXSAESFACIATDPRASHARLSTTSAALRDSHDAAARRERVLPGPL

SEQ ID NO: 33300 - DNA, 705 bp, Zea mays
  misc_feature: Ceres CLONE 1410918-F
  misc_feature: Translation starting site: 169
  misc_feature: Pfam Name: L15 Pfam Description: Ribosomal protein L15
  misc_feature (496)..(496): n is a, c, t, g, unknown, or other
  misc_feature (610)..(610): n is a, c, t, g, unknown, or other
  misc_feature (696)..(696): n is a, c, t, g, unknown, or other
aagctggagctccccgcggtggcggccgctctagaactagtggatcccccgggctgcaggaattcgcacgagaccattacctagaacatctaatcgaaaactccactccctcccccccgcctccactaccccactcccaggcgccgcacaggtacgtcgccggcggcgatgacgacgcgcttcaagaagaaccgcaagaagcgcggccacgtgtccgccgggcacggccgcatcggcaagcacaggaagcatcccggaggtcgcggtaacgccggtggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccgaaaaggcggcggaagccggcggcgacaaggccccgcagatcgacgtcacgcagttcggctacttcaaggtgctcngggaagggggtgctgccgcccaagcccatcgtcgtcaaggccaagctcatctccaaggtcgccgagaagaagatcaaggccgccggcggcgccgtcgtgctcacgaagcttggngaggcgagcaccccgaatccggcgaggtgccgcgagcgaggcagcgatgagaaggcgtgcgtcccatctccgcgcgctcctctcgngagtgtctt

SEQ ID NO: 33301 - DNA, 701 bp, Zea mays
  misc_feature: Ceres CLONE 1410922-F
  misc_feature: Encodes the peptide sequence at SEQ ID NO. 33302
  misc_feature (198)..(198): n is a, c, t, g, unknown, or other
  misc_feature (199)..(199): n is a, c, t, g, unknown, or other
  misc_feature (204)..(204): n is a, c, t, g, unknown, or other
ggagctccccgcggtggcggccgctctagaactagtggatcccccgggctgcaggaattcgcacgagaccattacctagaacatcctaatcgaaaacagtcccagtcccagtcccagtcccaggacagtcccgtcagcagccacttccccggcccctcccgctcctgctcgccggaggccgggccgggcggcgatggnncacgncgctagctgcggccgaccaagcgaggaagtagacttcttcggcgcggcgcagtccggggacatggcccgcctcgccgccgctcttcgctcccgccccaccttgctcagccgcaccacgctcttcgaccgcctctccgcgctccacatcgccgccgaacacggccacctccaggtggtctccctgacattggatctttgcgtgcaccccgacgtcgttaaccgccacaagcagacgtcgttgatgctctctgcgatgcacggaaagaccgactgcttccgccggctgctccacgccggcgcaatatcgtgatgttcaattcctcgcaggggcggacgtgcctgaattacgaaacgtaatacggggaacggggactgcctccgaaacatcctctcgggcgggggccaggtccggcggcgggctcagaaatcctggggggttcgcgcggttttggggaaggtggcggaaaaaaaccggaagccactcccgtttgcacctt

SEQ ID NO: 33302 - protein, 106 aa, Zea mays
  misc_feature: Ceres CLONE 1410922-F
  misc_feature: SWISSPROT Homolog: EC 2.7.11.1 Non-specific serine/threonine protein kinase
  misc_feature (2)..(2): Xaa is any aa, unknown, or other
  misc_feature (4)..(4): Xaa is any aa, unknown, or other
MXHXASCGRPSEEVDFFGAAQSGDMARLAAALRSRPTLLSRTTLFDRLSALHIAAEHGHLQVVSLTLDLCVHPDVVNRHKQTSLMLSAMHGKTDCFRRLLHAGAIS

SEQ ID NO: 33303 - DNA, 685 bp, Zea mays
  misc_feature: Ceres CLONE 1410923-R
  misc_feature (1)..(1): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (10)..(10): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (87)..(87): n is a, c, t, g, unknown, or other
ngggnnnccnttgnnnnnnngtggcacccccgcccggcatttttggcaacnnncnnnnccgaattgggtccgggccccccctcgagnctttcgtatcgagaagcttttttttttttttttccgacaacaaaatgcaagaacattacttatttccctggtggcaatacattaaaacaacattcgggcaagatgctataacactgagaatcccataacaaagaaattctccaaacacaaaataatctcccgtgccatggcttgcataagtccacggcaataacatctgccattggaacattccagtggaccaacactcgcagcacaagcggtaaacaacttgccagatagcagtgagcaaacgagcccgctgaaaaaacttggaaaggttgccttccttcagaagaagaattccagtaaccttcagatcactgaaagtactctatgcacaagatccaacggagacggggaaaaacgatgacgggtcacctgggggaacaacaaattccatggaaccaccgcgattcaactgatcgataacgagaatagaccattgcaacccagagtgtcttgagtcgaacttccactctccatcgatatgtctaacactcggagcctccccaaatgctggacaaagtatagatatgacaacgttgtgcagatcaaacatctcagaagattcatattc

SEQ ID NO: 33304 - DNA, 722 bp, Zea mays
  misc_feature: Ceres CLONE 1410923-F
  misc_feature (281)..(281): n is a, c, t, g, unknown, or other
  misc_feature (290)..(290): n is a, c, t, g, unknown, or other
ggagctccccgcggtggcggccgctctagaactagtggatcccccgggctgcaggaattcgcacgagaccattacctagaacatcctaatcgaaaatgaacgtgcattggaggcagagcgggtgtcaaacgtcgaattgaggaaaatattgcaaagtttagaggtcatttgtacaaagagcaggagggctgacttcggtatgttatagctgggtccagaattttacctaggacacctgactaaagggcacatttttgatatagaagggtatctcggtctgnatccattcnaactgagattgcacgtgattgtcgatgacgcatggaatatgcgtctagtggtttgaaaaatgctatttgatgtacatgtggtcgagggttgacattgaaagatgtcatcctcggaaaaaaaaagaatatggtatcctggggttaaaactgctgataattggaacatggaatggccttgggggggggctcccaaaaacaaaaagaaggaggtccccccccggcccctctttgtttgggaaaaaaattgccccactgccccttcagggggcccgaccccccccctgggggaaaatttttccttccaaagttttttgacaaaacccccattcccccttaaaaaaaaacaagaggtttcccccgggggctctctctttgggaaatttttccccccccccccctttttggggaagaagattaaaaacaacaagattt

SEQ ID NO: 33305 - DNA, 652 bp, Zea mays
  misc_feature: Ceres CLONE 1410925-F
  misc_feature: Encodes the peptide sequence at SEQ ID NO. 33306
  misc_feature (471)..(471): n is a, c, t, g, unknown, or other
aaagctggagctccccgcggtggcggccgctctagaactagtggatcccccgggctgcaggaattcgcacgagaccattacctagaacatcttaatcgaaaaaagaattcgcacgcacagagcacttttgctaaatcgctagttcgtttcctaaaccctagcaaagtaggaatggcgtcggcgagcatgctcgcgcgctcccttctccgcaccccagaccctacccaaacgagccacccgaaccgccggagcgccgctgtcgtctccttcccccgccgccaccgccgcctgtccgtgcgcgcctccgtctccacggcctccccttccccaccgccacagcccgcggcggcggctgccggcgtgccgaagcactgcttccggcgcggggccgatggctacctgtactgcgagggagtgcgggtggaggacgcgatgacggctgctgagcgcagccccttctacctctacagncagccacagatcctccgcaacctcgccgcttaccgcgatgctctccaggggctccgctccatcatcgggtatgccgtggaggccaacacaacctccccgtgctacgcgtcctgcgtgagcttggctggcgcgccgttctcgtcagggggaacgagctccgactcgcccttcagggcgggat

SEQ ID NO: 33306 - protein, 160 aa, Zea mays
  misc_feature: Ceres CLONE 1410925-F
  misc_feature: SWISSPROT Homolog: EC 4.1.1.20 Diaminopimelate decarboxylase
  misc_feature (100)..(100): Xaa is any aa, unknown, or other
MASASMLARSLLRTPDPTQTSHPNRRSAAVVSFPRRHRRLSVRASVSTASPSPPPQPAAAAAGVPKHCFRRGADGYLYCEGVRVEDAMTAAERSPFYLYXQPQILRNLAAYRDALQGLRSIIGYAVEANTTSPCYASCVSLAGAPFSSGGTSSDSPFRAG

SEQ ID NO: 33307 - DNA, 726 bp, Zea mays
  misc_feature: Ceres CLONE 1410926-F
  misc_feature: Encodes the peptide sequence at SEQ ID NO. 33308
  misc_feature (243)..(243): n is a, c, t, g, unknown, or other
  misc_feature (301)..(301): n is a, c, t, g, unknown, or other
  misc_feature (319)..(319): n is a, c, t, g, unknown, or other
  misc_feature (443)..(443): n is a, c, t, g, unknown, or other
aaagctggagctccccgcggtggcggccgctctagaactagtggatcccccgggctgcaggaattcgcacgagaccattacctagaacatcctaatcgaaaaagaaatcactacacacaccttgtctctaatcagatatcaaagaagtagccattaagttaacgatggcttccgccgacctcgcagaggccatcgagcccagcaggaagaagaagagcaacgtcaagtatgcctccatctgcngcatcctcgccctcatggcctccgtcatccttggctacgatatgggggtgatgagcgnagcggccatgtacatcangaaggaccctgagatcacggacgtgcagctggagatccctgatagggatcctccagctctactcgttcatgggttctttcggggcggccggaagtcccaacagattcggccgcccctgattggnttttttccccccggaatttttttcgggggggggttgttcaggggtttccccgaaaaatctccatgttagggggggccctttcggggccggattgggggggtttaaggggaaaaaacccccccgttaacagcaaaaatttcccgggggggccccgggtttttccactctttccgggagggttaaaaaaaggggaccctccgcccaacccagaaaaatttgtgttgggcccccccccccccccccggggggggggaattacaaaaaaaggggggggcccgcgcct

SEQ ID NO: 33308 - protein, 115 aa, Zea mays
  misc_feature: Ceres CLONE 1410926-F
  misc_feature (27)..(27): Xaa is any aa, unknown, or other
  misc_feature (46)..(46): Xaa is any aa, unknown, or other
  misc_feature (52)..(52): Xaa is any aa, unknown, or other
MASADLAEAIEPSRKKKSNVKYASICXILALMASVILGYDMGVMSXAAMYIXKDPEITDVQLEIPDRDPPALLVHGFFRGGRKSQQIRPPLIGFFPPGIFFGGGLFRGFPEKSPC

SEQ ID NO: 33309 - DNA, 709 bp, Zea mays
  misc_feature: Ceres CLONE 1410927-F
  misc_feature: Encodes the peptide sequence at SEQ ID NO. 33310
cagagctggagctccccgcggtggcggccgctctagaactagtggatcccccgggctgcaggaattcgcacgagaccattacctagaacatcctaatcgaaaagtatcgtctcctctccttcctgacattggcactggcagctgcactcaccggaagccatggaagacttgctctactactccctcaccatagccatctgcatcgcagtcatcgccctcctctccatccttcgatcgttcaccgctaccggacggccgccggcgctcccgcccggcccgtcgctgctgtcgctgatcaccccgctcctcttcctcggccgaacgaacttcggcatcgagcggatcctctccgccgcgcggtcccgctacggccccgtcttcacgctctacctgctcccgtcccgcccggccatcttcatcgccgaccacgccgtgccgcaccgcgtgctgctgcagggcggagccgccttcgccgacaggacgccggccagcctccccttccgcctcgtctccagtgagcagcgcaacatcacatccggcagctacggccgggtctggggagagctccgacacaacctcgcggacaacgtgttccacccgtcgcgcatggtccggttcgccgccgcctgccgaccggagatgaaggggctcctctccggagtcgggcgggaccccaggcaacggagcccaccgccgtcaaggggttcct

SEQ ID NO: 33310 - protein, 183 aa, Zea mays
  misc_feature: Ceres CLONE 1410927-F
  misc_feature: SWISSPROT Homolog: EC 1.14.14.1 Unspecific monooxygenase
MEDLLYYSLTIAICIAVIALLSILRSFTATGRPPALPPGPSLLSLITPLLFLGRTNFGIERILSAARSRYGPVFTLYLLPSRPAIFIADHAVPHRVLLQGGAAFADRTPASLPFRLVSSEQRNITSGSYGRVWGELRHNLADNVFHPSRMVRFAAACRPEMKGLLSGVGRDPRQRSPPPSRGS

SEQ ID NO: 33311 - DNA, 658 bp, Zea mays
  misc_feature: Ceres CLONE 1410928-F
  misc_feature (284)..(284): n is a, c, t, g, unknown, or other
  misc_feature (291)..(291): n is a, c, t, g, unknown, or other
  misc_feature (294)..(294): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (308)..(308): n is a, c, t, g, unknown, or other
  misc_feature (314)..(314): n is a, c, t, g, unknown, or other
  misc_feature (343)..(343): n is a, c, t, g, unknown, or other
  misc_feature (350)..(350): n is a, c, t, g, unknown, or other
  misc_feature (355)..(355): n is a, c, t, g, unknown, or other
aaagctggagctccccgcggtggcggccgctctagaactagtggatcccccgggctgcaggaattcgcacgagaccattacctagaacatcctaatcaaaaagaggcaaagccgttagccaatcctgctgttgcgtgttgcaccgatcaacgtcggttcccagcgcttgctcgtcaagcgtgtcctgctgctgttctctgctcctgcttgccgcgagagctcctctcgctcatctacccaaggtccgacagcaacgacttcgtcgagctgctatgggagaacgncagcggntgntgcacgnnnagagnaagcancatcccccaggccgctttccgcccttcancctgcgngcggncagcagcagtagagctcaagaaaccagcccggtactaccgacccggtctcgctgttcaagacgggagcctctttcgcgacttctcgtccggcctaaacgcgcccgtggaaacgtgaccttgacgaccccggccctggaacccattgcccatccaccaagaaaaaagggcccaaaccgaacctgccctcgcggggggtaccggccccaattttttttccggatctccatgaaggggttttaaaaagggggggggaaaaaaaaaaattttaaccctttttccaccaccggggaaaaaaaaaaaaa

SEQ ID NO: 33312 - DNA, 700 bp, Zea mays
  misc_feature: Ceres CLONE 1410929-F
  misc_feature: Encodes the peptide sequence at SEQ ID NO. 33313
  misc_feature (331)..(331): n is a, c, t, g, unknown, or other
  misc_feature (332)..(332): n is a, c, t, g, unknown, or other
  misc_feature (337)..(337): n is a, c, t, g, unknown, or other
tccccgcggtggcggccgctctagaactagtggatcccccgggctgcaggaattcgcacgagaccattacctagaacatccgaatcgaaaaatcgcagaaattctccgcaacttcacagcgtatcatcgttttccatcgctcctactcctatcatccagaaaatctgagcggtattgatggcgcccaaggcggagaagaagccggtgtcgaacaatgtggcggaggaggagccctcggagaaggcggctccggcggagaaggcctccgcgtcgaagaaggccaaggcggagaagctgctacctgcgagcaagtccgccggcaaggaggcgnncgacnagaaggggaggaagacggcgaacaagagcgtggagacctacaagatctacatcttcaaggtctccgttctccgctaattcgacttcacctcgccgcttcctcccttgactgcaccgttgacgtcatcttgcggagaggtagctcgccggaagacttcactggactttttcgacgcaccctcacacactcttttaccctccggatggccgcctgcttctagctcgtcgacgccccgatctcgggttgatcctcgacagccccgatcggcttctctcgatctcgatacggctcctctgcctgttcgcatggagaatcggatcacgtctctactcgggtaggggggggcagaaactccccgcgtcc

SEQ ID NO: 33313 - protein, 78 aa, Zea mays
  misc_feature: Ceres CLONE 1410929-F
  misc_feature (52)..(52): Xaa is any aa, unknown, or other
  misc_feature (54)..(54): Xaa is any aa, unknown, or other
MAPKAEKKPVSNNVAEEEPSEKAAPAEKASASKKAKAEKLLPASKSAGKEAXDXKGRKTANKSVETYKIYIFKVSVLR

SEQ ID NO: 33314 - DNA, 691 bp, Zea mays
  misc_feature: Ceres CLONE 1410933-F
  misc_feature (488)..(488): n is a, c, t, g, unknown, or other
  misc_feature (489)..(489): n is a, c, t, g, unknown, or other
  misc_feature (537)..(537): n is a, c, t, g, unknown, or other
aaagctggagctccccgcggtggcggccgctctagaactagtggatcccccgggctgcaggaattcgcacgagaccattacctagaacatcctaattaaaaaattaacctctctccttcctcgccccttcccctccacgactccactaccaccaccttcaccttgtctcccacaaccgccgcgcgcaagccctagcccgatctcgccggcgacagacaccagatctcgccgcccgttgcgcgccgatacgcgccccgccggattcaccgctcctcgcgctgcagcacgcccgggcctgggttactgcgtgacatgtagtattgtataattggaggttgtcaccatcaccacaaagcatatgttgtgatttgtcgatggcgaggagatgaaacaggtgtaggggcggagcagcaaggacatgacagccatgccgcatccgcgccacccgagcgctgctaagaagcccatgtggatcatagggctattgnnctttggtttgtgttgcacttatggggggcctatgtctacccaccacgncgctactccgcatgctacttctttgcttcgagtggctgtactccgttcaaggattggctacctgcttgtgctcgtgagcgactgatgaagaatagtttcatcgtgggtataaggatctccttcatggctatgccatgtcaagaacccaagattg

SEQ ID NO: 33315 - DNA, 702 bp, Zea mays
  misc_feature: Ceres CLONE 1410939-F
  misc_feature: Encodes the peptide sequence at SEQ ID NO. 33316
  misc_feature (359)..(359): n is a, c, t, g, unknown, or other
  misc_feature (414)..(414): n is a, c, t, g, unknown, or other
  misc_feature (424)..(424): n is a, c, t, g, unknown, or other
  misc_feature (435)..(435): n is a, c, t, g, unknown, or other
  misc_feature (442)..(442): n is a, c, t, g, unknown, or other
  misc_feature (450)..(450): n is a, c, t, g, unknown, or other
  misc_feature (451)..(451): n is a, c, t, g, unknown, or other
  misc_feature (458)..(458): n is a, c, t, g, unknown, or other
  misc_feature (459)..(459): n is a, c, t, g, unknown, or other
  misc_feature (461)..(461): n is a, c, t, g, unknown, or other
  misc_feature (462)..(462): n is a, c, t, g, unknown, or other
  misc_feature (465)..(465): n is a, c, t, g, unknown, or other
  misc_feature (473)..(473): n is a, c, t, g, unknown, or other
  misc_feature (488)..(488): n is a, c, t, g, unknown, or other
tccccgcggtggcggccgctctagaactagtggatcccccgggctgcaggaattcgcacgagaccattacctagaacatcctaatcaaaaacccgctccgcttcacccagtcccataccccagccgaccagcccggcgcgcggtggcactgtggcagcgctcacacggcaatgcggaaggacgctgccgccgccggcattgcgccgggttcggcgcccgcgtttctctgcttcgaccttaagcccttcctcgccgcgctcaccgtgctgacgctcctcgccgccgcctggcagctccggccttaccaatccctcctcgcttccccattctccgccgcgtgcccgcaacccaccgccggngtctcgctcccccgcgcgctcgccgtcccacgcaagaagggctcctccgccaccnaactcacagntttcgtctcgncgtcccngcgccggnncccgagnngnnggnagtccacngccctgggcagcgcngcggcgctgttcgtgcaaatgggcgcgtaccggggggggccctacaccttcccggtggtggggttggggtcaaagccccgcacgtttaaggaaaagcctgggttcccctgggaagggggaggccagaaacccctctttcccccccatgggggggggcaaaaaagaaacaaatggtctccggaggggggatacagcccctttaaccccggggggg

SEQ ID NO: 33316 - protein, 177 aa, Zea mays
  misc_feature: Ceres CLONE 1410939-F
  misc_feature (82)..(82): Xaa is any aa, unknown, or other
  misc_feature (85)..(85): Xaa is any aa, unknown, or other
  misc_feature (89)..(89): Xaa is any aa, unknown, or other
  misc_feature (91)..(91): Xaa is any aa, unknown, or other
  misc_feature (94)..(94): Xaa is any aa, unknown, or other
  misc_feature (96)..(96): Xaa is any aa, unknown, or other
  misc_feature (97)..(97): Xaa is any aa, unknown, or other
  misc_feature (98)..(98): Xaa is any aa, unknown, or other
  misc_feature (99)..(99): Xaa is any aa, unknown, or other
MRKDAAAAGIAPGSAPAFLCFDLKPFLAALTVLTLLAAAWQLRPYQSLLASPFSAACPQPTAGVSLPRALAVPRKKGSSATXLTXFVSXSXRRXPXXXXSTALGSAAALFVQMGAYRGGPYTFPVVGLGSKPRTFKEKPGFPWEGGGQKPLFPPHGGGQKRNKWSPEGGYSPFNPGG

SEQ ID NO: 33317 - DNA, 696 bp, Zea mays
  misc_feature: Ceres CLONE 1410940-F
  misc_feature: Encodes the peptide sequence at SEQ ID NO. 33318
  misc_feature (634)..(634): n is a, c, t, g, unknown, or other
  misc_feature (651)..(651): n is a, c, t, g, unknown, or other
  misc_feature (659)..(659): n is a, c, t, g, unknown, or other
gctctagaactagtggatcccccgggctgcaggaattcgcacgagaccattacctagaacatcctaatcgaaaaaagcgggataggaaaaaggagactaaagttaatcacgaaacaaggcctcgacctttccagaaatatacataccgaggatataaggctgtttcagatcgaagtgggcgagaccctacaggcggtttcaaaggccctgtaaagaaggaaccagagttgcaagctccactaaactcatcagccttggatgtcaagacaagtgacactacagaaatattttctgctactatcaatgttgcccagactgatgctaagaacaccacttctcagcctttatctaaagtgcagcatgggttggggtggtattccaggtcgcccttccatggctgaaatagtgaagatgggcaggcctcaagctaaagttgggagcagatctgttgcaagtagcactgcgttgccaaccgtttggtgattcagtcatttccaatacaccaaatcttgtgcccgaggaatatacagaactgtttttgcatcagaagcaggccatgtcgcagcagataaattgccaaacgggtgctgttgaggtgcactctctacctaaagatgcttcccgcattgatatngtaccttcagctgaggnaacagatngtgaagccccttcatgagtgctagtgcacaaggtcat

SEQ ID NO: 33318 - protein, 132 aa, Zea mays
  misc_feature: Ceres CLONE 1410940-F
SRTSGSPGLQEFARDHYLEHPNRKKRDRKKETKVNHETRPRPFQKYTYRGYKAVSDRSGRDPTGGFKGPVKKEPELQAPLNSSALDVKTSDTTEIFSATINVAQTDAKNTTSQPLSKVQHGLGWYSRSPFHG

SEQ ID NO: 33319 - DNA, 698 bp, Zea mays
  misc_feature: Ceres CLONE 1410941-F
  misc_feature (498)..(498): n is a, c, t, g, unknown, or other
  misc_feature (511)..(511): n is a, c, t, g, unknown, or other
  misc_feature (514)..(514): n is a, c, t, g, unknown, or other
  misc_feature (617)..(617): n is a, c, t, g, unknown, or other
gagctccccgcggtggcggccgctctagaactagtggatcccccgggctgcaggaattcgcacgagaccattacctagaacatcctaatcgaaaagttcttagacgtttctccagagcctgaagccaaatctagggggcttgcttcatctgctgtccgagcgtggtttggtttctcggggctggcgcggtcaagagctcacctgagttccaccgaaatctgccacggtagttcttgcctaggtgtgtcgttgcgttgtgacccttgcggattttcttgtttcttttgagttgcgatctttgcaggttagtctccccccccatccgtaatcatccggcgtctaggaaattgcagtccagtttgcttatttgttcgtctagtgccttctccccatcctgggtagaaagatatcggaaggggggatttttttttttttgccctgtcgaaaggaagcagggagacataattgttgcatctgataaagctcggggcgaatacnagcaaatccttgnaantttgcatcccctttgctgctctttttctgatcagagacccaatgggggatgggtccttgatggacccggttaagccgagccaacttccggtggcatggccaangaaaacccgagttctgaacacgatgtccgcccgggtggacggacgaaagaaccatgctgtataatagctccatggaggctt

SEQ ID NO: 33320 - DNA, 687 bp, Zea mays
  misc_feature: Ceres CLONE 1410942-F
  misc_feature: Encodes the peptide sequence at SEQ ID NO. 33321
  misc_feature (289)..(289): n is a, c, t, g, unknown, or other
  misc_feature (459)..(459): n is a, c, t, g, unknown, or other
  misc_feature (475)..(475): n is a, c, t, g, unknown, or other
  misc_feature (486)..(486): n is a, c, t, g, unknown, or other
  misc_feature (548)..(548): n is a, c, t, g, unknown, or other
  misc_feature (560)..(560): n is a, c, t, g, unknown, or other
  misc_feature (562)..(562): n is a, c, t, g, unknown, or other
  misc_feature (637)..(637): n is a, c, t, g, unknown, or other
  misc_feature (638)..(638): n is a, c, t, g, unknown, or other
gctctagaactagtggatcccccgggctgcaggaattcgcacgagaccattacctagaacatcctaatcgaaaatatagccagttctaatctcaggttgggggaaataggcctcgcgggtcgcaaaccgctctctgctgatttgggatttgggaggcgctcgagttttcaggtaaactatagtttagtgacccatggctcgtactaagcaaactgctcgcaagtccactggagggaaggctcctaggaaacaacttgccaccaaggctgcccgtaagtctgcacctacnactgggggagtaaagaagcctcaccgttaccgccctggaactgttgctcttcgtgaaatccgcaagtatcagaagagcactgacctgctcataaggaagcttccgttccaaaggcttgtcagggagattgcccaggatttcaagactgatcttcgtttcccagagcatgncgtgcttgcgctgcangaggctgcggnagcgtacctggtgggtctattcgaggacactaatctgtgcgccatccatggccagcgcgtgnacatcatgcccnangacattcagctggctaggaagatccggtggtgaaaggcctagatcctctatttatgctactgggagtggctccgnnagtatggtttgcatctgtcatgctgcttttttggggaagttaccgtttg

SEQ ID NO: 33321 - protein, 133 aa, Zea mays
  misc_feature: Ceres CLONE 1410942-F
  misc_feature (58)..(132): Pfam Name: Histone Pfam Description: Core histone H2A/H2B/H3/H4
  misc_feature (89)..(89): Xaa is any aa, unknown, or other
  misc_feature (94)..(94): Xaa is any aa, unknown, or other
  misc_feature (98)..(98): Xaa is any aa, unknown, or other
  misc_feature (119)..(119): Xaa is any aa, unknown, or other
  misc_feature (123)..(123): Xaa is any aa, unknown, or other
MARTKQTARKSTGGKAPRKQLATKAARKSAPTTGGVKKPHRYRPGTVALREIRKYQKSTDLLIRKLPFQRLVREIAQDFKTDLRFPEHXVLALXEAAXAYLVGLFEDTNLCAIHGQRVXIMPXDIQLARKIRW

SEQ ID NO: 33322 - DNA, 661 bp, Zea mays
  misc_feature: Ceres CLONE 1410944-F
  misc_feature: Translation starting site: 179
  misc_feature: Pfam Name: Acyltransferase Pfam Description: Acyltransferase
  misc_feature (559)..(559): n is a, c, t, g, unknown, or other
cgctctagaactagtggatcccccgggctgcaggaattcgcacgagaccattacctagaacatcctaatcaaaaagaagctctaaaataatctcttcccgacgtctctggaaggtcagcatctgaacccaggtagcctccagcgctggagacgtgccgtactcaaaccctagccaccaatggcagccggcggcggggctccgtgggcggagcgcgcgcgggtggtggggacgcaaatccgcaacaggttccgcgtggcgcccgtggaccaccggtcgctgtggctgcgggcggacggtcgtgtcgccactgaggcggtccggcggtggtcggatcgcgttcgggccctgctgcagaggggccggagcgcggatcggaactccacatcgacggagacatcacctgaggcggtggcaaagccttcgtccagcgttttgagattctacagaaagagagtgggcaaagaagttaatgggattgaagactctgttattttcccgtcgcttcaagcattggctggtcctcttattggcatgcatgctatgtttttatgcatgggnctaactcagttcaggtttatggtggagaggagcttcatcaggcattacatgggagacctaaaggcaagcttcttctaacggtcagcaatcatgtggcagcga

SEQ ID NO: 33323 - DNA, 725 bp, Zea mays
  misc_feature: Ceres CLONE 1410948-F
  misc_feature: Encodes the peptide sequence at SEQ ID NO. 33324
  misc_feature (275)..(275): n is a, c, t, g, unknown, or other
  misc_feature (276)..(276): n is a, c, t, g, unknown, or other
  misc_feature (302)..(302): n is a, c, t, g, unknown, or other
  misc_feature (522)..(522): n is a, c, t, g, unknown, or other
  misc_feature (523)..(523): n is a, c, t, g, unknown, or other
  misc_feature (627)..(627): n is a, c, t, g, unknown, or other
  misc_feature (634)..(634): n is a, c, t, g, unknown, or other
  misc_feature (690)..(690): n is a, c, t, g, unknown, or other
  misc_feature (691)..(691): n is a, c, t, g, unknown, or other
  misc_feature (695)..(695): n is a, c, t, g, unknown, or other
  misc_feature (696)..(696): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (712)..(712): n is a, c, t, g, unknown, or other
  misc_feature (713)..(713): n is a, c, t, g, unknown, or other
  misc_feature (716)..(716): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
aagctggagctccccgcggtggcggccgctctagaactagtggatcccccgggctgcaggaattcgcacgagaccattacctaaaacatcctaatcgaaaaatccaattcacaggctcaccacaccaaccaacaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgnntccggaggctggcgcggcccgggcgncgtgaagcgcatctcggggctcatctacgaggagacccgcggcgtgctcaagatcttcctggagaacgtcatccgcgacgccgccccaccacgcccgatggccgccgtaaggtcgctgctccgctcgtcggcctcccttcttcgcgccgcccccgccctcgcgagatcctcggctaccacgcgtccgtctcttcggcgcgcattggctgctcctcctcgnnctctcaggtcgcccgtcgagtcgagcttctgcgtggagtcgcttctgcctctgcacaccgccaccgccggtgcacgcatgacgtccatgctcgccgctcctggncaagggnctcggctggctcacccagctgaaactgacggagatacgccccctgtgggtgtaacnncccnncnnnnnnnnnnntttnnttngnnnnnnnn

SEQ ID NO: 33324 - protein, 104 aa, Zea mays
  misc_feature: Ceres CLONE 1410948-F
  misc_feature (42)..(42): Xaa is any aa, unknown, or other
  misc_feature (79)..(79): Xaa is any aa, unknown, or other
  misc_feature (98)..(98): Xaa is any aa, unknown, or other
  misc_feature (99)..(99): Xaa is any aa, unknown, or other
  misc_feature (100)..(100): Xaa is any aa, unknown, or other
  misc_feature (101)..(101): Xaa is any aa, unknown, or other
  misc_feature (102)..(102): Xaa is any aa, unknown, or other
  misc_feature (103)..(103): Xaa is any aa, unknown, or other
MAAVRSLLRSSASLLRAAPALARSSATTRPSLRRALAAPPRXLRSPVESSFCVESLLPLHTATAGARMTSMLAAPGQGXRLAHPAETDGDTPPVGVTXXXXXXF

SEQ ID NO: 33325 - DNA, 674 bp, Zea mays
  misc_feature: Ceres CLONE 1410949-F
  misc_feature: Translation starting site: 358
  misc_feature: Pfam Name: TFIID_90kDa Pfam Description: WD40 associated region in TFIID subunit
  misc_feature (352)..(352): n is a, c, t, g, unknown, or other
  misc_feature (357)..(357): n is a, c, t, g, unknown, or other
  misc_feature (376)..(376): n is a, c, t, g, unknown, or other
  misc_feature (389)..(389): n is a, c, t, g, unknown, or other
  misc_feature (446)..(446): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (476)..(476): n is a, c, t, g, unknown, or other
  misc_feature (491)..(491): n is a, c, t, g, unknown, or other
gctcagaactagtggatcccccgggctgcaggaattcgcacgagaccattacctagaacatcctaatcgaaaattacggctgaagggagtcgctcgccgccgcgttcgaggcgttccctcgtcgcgctcgcgccgtcgaccttcaccgctcgctgtcaggtctgcccgccacgacctcgccggccacactcgcagctcgccctcgctcctacgcctcgccggcgaggccttctgccttttcgcgccctctatctgctgcgatctttggagcatcgttctcttctctcacttgagatccagacccctaaaccctagagctcgccgcttccgctcgctcgctccgcgctggcgncgacnatggaggacgaggagatgnagaagaagtgcancagtacttgcagcgcaagggttcccgcctcactgagcttgcgctccaggaggagtgnaacgcnnntctcactcccgcatctccgaangtgcgcttgcacggntctgacatgatccagcgagatactacgatggatatagcagattaagagcatgggcatacagttctcttggatcatataagcacgaattacttcgcgtcttttatccagtttcatccatagcttcatggatctaaggggcagaggacatatgccaggaagctcggtcatttttccatacatttc

SEQ ID NO: 33326 - DNA, 666 bp, Zea mays
  misc_feature: Ceres CLONE 1410951-F
  misc_feature: Encodes the peptide sequence at SEQ ID NO. 33327
  misc_feature (444)..(444): n is a, c, t, g, unknown, or other
  misc_feature (562)..(562): n is a, c, t, g, unknown, or other
  misc_feature (625)..(625): n is a, c, t, g, unknown, or other
  misc_feature (633)..(633): n is a, c, t, g, unknown, or other
  misc_feature (639)..(639): n is a, c, t, g, unknown, or other
  misc_feature (644)..(644): n is a, c, t, g, unknown, or other
  misc_feature (659)..(659): n is a, c, t, g, unknown, or other
tcaccgcggtggcggccgctctagaactagtggatcccccgggctgcaggaattcgcacgagaccattacctagaacatcctaatcgaaaaattttttcatttcttccccccttctcgtcacgtccaaaggggggaaaacttctttctctctcttttttttccctcccccgcccgaatctgatgcttaaaccctcgccgggaggaggattccaatcccgacgcaccagcccgcgcccgccacctacagccgcgcccggatctccgccatggccgccgcgccgcaccaggcccagggccccgcagatagtgtgattccgctgcagtctgaacccgcacttgataataacccctccaagagtgcaaacgccagggaccagattctttctggtacggagaatgtgactacaggcaatgcacgcggcggcagctccttgaaatcgcanaaaggcccgccagagaaggctagctctgttggaaaactggagaacaaccttttcctaccagcaaaatgtgtatgcaccacagccacaaccactctatcctggaggctacatgaacccnttcagacagtgggagaatatccccattatgtgagtatggaggggctccattccgtatctcccnggatctancatgancaccnatccctcatgctatnctctgga

SEQ ID NO: 33327 - protein, 133 aa, Zea mays
  misc_feature: Ceres CLONE 1410951-F
  misc_feature (59)..(59): Xaa is any aa, unknown, or other
  misc_feature (99)..(99): Xaa is any aa, unknown, or other
  misc_feature (120)..(120): Xaa is any aa, unknown, or other
  misc_feature (122)..(122): Xaa is any aa, unknown, or other
  misc_feature (124)..(124): Xaa is any aa, unknown, or other
  misc_feature (126)..(126): Xaa is any aa, unknown, or other
  misc_feature (131)..(131): Xaa is any aa, unknown, or other
MAAAPHQAQGPADSVIPLQSEPALDNNPSKSANARDQILSGTENVTTGNARGGSSLKSXKGPPEKASSVGKLENNLFLPAKCVCTTATTTLSWRLHEPXQTVGEYPHYVSMEGLHSVSPXIXHXHXSLMLXSG

SEQ ID NO: 33328 - DNA, 713 bp, Zea mays
  misc_feature: Ceres CLONE 1410952-F
  misc_feature: Encodes the peptide sequence at SEQ ID NO. 33329
  misc_feature (458)..(458): n is a, c, t, g, unknown, or other
  misc_feature (710)..(710): n is a, c, t, g, unknown, or other
  misc_feature (711)..(711): n is a, c, t, g, unknown, or other
  misc_feature (713)..(713): n is a, c, t, g, unknown, or other
tggagctccccgcggtggcggccgctctagaactagtggatcccccgggctgcaggaattcgcacgagaccattacctaaaacatcctaatcgaaaaatccaattcacaggctcaccacaccaaccaacaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccgcgacgccgccccaccacgcccgatggccgccgtaaggtcgctgctccgctcgtcggcctcccttcttcgcgccgcccccgccctcgngagatcctcggctaccacgcgtccgtctcttcggcgcgcattggctgctcctcctcgcctcctcaggccgcccgtcgagtcaagctcctgcgggaagtcgtttctgcctctgcacaccgccaccggcgtgcacgcatgaccgtcatgctccgcgctcctgcccagggctcgggtggctcaccaagctgaactgaacgatatacgccccctgtggtgcttagaccagaacttaatttggggtttcaagccctnnan

SEQ ID NO: 33329 - protein, 142 aa, Zea mays
  misc_feature: Ceres CLONE 1410952-F
  misc_feature (97)..(97): Xaa is any aa, unknown, or other
MSGRGKGGKGLGKGGAKRHRKVLRDNIQGITKPAIRRLARRGGVKRISGLIYEETRGVLKIFLENVIRDAAPPRPMAAVRSLLRSSASLLRAAPALXRSSATTRPSLRRALAAPPRLLRPPVESSSCGKSFLPLHTATGVHA

SEQ ID NO: 33330 - DNA, 794 bp, Zea mays
  misc_feature: Ceres CLONE 1410952-R
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (24)..(24): n is a, c, t, g, unknown, or other
  misc_feature (46)..(46): n is a, c, t, g, unknown, or other
  misc_feature (754)..(754): n is a, c, t, g, unknown, or other
aaaaaaannnnaaaagggnnnaanaaaacgccagcgaccaaaaaancgaccgaaaataataacaataggggtccgggccccccctcgaggtcgacggtatcgataagcttttttttttttttttttggggtgaaatccgaaaaaagctaccctgtagtattccttaatacagcactatccgcaaaattaatccgcctgtgaatcatagatcaaataagggtgccttcgacacgctgcagtttctgtcaagaagttcaatcagccaggtctacgacagctggtccatttgctaacccccccacggttctaacaagggcctgggggtttctacggagtaattactacttctggtggacctttggcaactagagaaagaaaaacaaaatagtgactaacacagcaagctgatctgagcttgatggctaaaggcaccccggagagaagaatctgttagcccgtcaaaccagtgtgagaaatccctaggagatgaactcgtaccccctcgcgaccgaaaatcggagataccgcaacaatcaacccgcctgcgacagttcgttcttaatccacttatacatggtttcccagccaatatttagtatctcgcccgcggcccgaatagttagcgggagaggagatttcagaccccgcataccaaatatgctgccactttccagattttcacccatctcatctaagccggtttcttgatcctgattacccccgccctgagaattttataaaaactgcccagacnccgaattagtttcttcctcacaaagtagccatatcagacg

SEQ ID NO: 33331 - DNA, 834 bp, Zea mays
  misc_feature: Ceres CLONE 1410954-R
  misc_feature (39)..(39): n is a, c, t, g, unknown, or other
  misc_feature (40)..(40): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (432)..(432): n is a, c, t, g, unknown, or other
aggggaaaaagaaattgattttttcaatataactaaatnncccttttgggttnnnaacgaatgggtaccgggccccccctcgaggtcgactgtatcgataagcttttttttttttttttttgggcatcaatcggcaattagccaattaggcatggacttggcacatgagatgcaagggtccttcttcggcacaacgataaataaacaaataataagagtaggtactataacatgctctctcgtactgtaccctatctccccctctacatgtacagatacttgccgtgaattgtctgcgtgataaaaggaacaaaagattccctggcgcgcgccggccctagccgaggcttatgaaaggacgtgacatggccccatgcttctgggctgggccgtaaagttggggtgtctgcaaggggaaagaaatccaagaanaataaaaaaaacaaaacaaagaaacccaccgtcctccccaaccccagaggctccatgggggatttttaatttaacgttaattcagggctccggtggaatcggctaataaggacgatttacaatgacaagtgcctactacaaactaagaagaattaagggtttctggcagcaatgcgtcgggagatgccgtggcgaaaaaaatttggggcccttttactaaatttacccggcaactcctcggtggggtggaaagagtccgttccctggtaccccccaagagacctactcacggccacaactgggccctgggcgctgctcttccggagagagcttccgcgacttgacccagctaaggacataagcatgtcctattaccaacagcgaggcaaacttatagtacaa

SEQ ID NO: 33332 - DNA, 703 bp, Zea mays
  misc_feature: Ceres CLONE 1410957-F
  misc_feature (128)..(128): n is a, c, t, g, unknown, or other
  misc_feature (247)..(247): n is a, c, t, g, unknown, or other
  misc_feature (327)..(327): n is a, c, t, g, unknown, or other
tccccgcggtggcggccgctctagaactagtggatcccccgggctgcaggaattcgcacgagaccattacctagaacatcctaatcgaaaaacggttaaagttgtggcaggaggagtgggggcgcggnagagatgataaggatggcggcagcgtctcagccgccatcgtcagccttgcggatgcacgggtgcggcggcgcggcttctgcgtcgtccgcgcccgtgcgcctcttcacggagtcgcggngtagagtcgtggcgtcgattgggaggggcaggaggcggaggcgcgccatctcgtgctgctcgtctccagacgcagatggncctcgccccgccgcgccaccgacctccgcaccgccttcggggggggggagacagctctattcccagatcgagagggtaatcacgggggcggcaaagcagtcccgggaaggctggggttcgactgaaaattggaccgaatcgagggatcatgggtgttgagaccgaagccttggagccatcatttggtgccccctttggtgggagggatttttgtgggaccccctccccaaatcacatacggttccttcctcgaggggctcgggaacggggcgagtttgggtggtggcaccccctaagggagggggctttggccatttctctcttggcgagggggttacttaaagtcgccccgggggtgaaaaccttggatcacccg

SEQ ID NO: 33333 - DNA, 695 bp, Zea mays
  misc_feature: Ceres CLONE 1410958-F
  misc_feature: Encodes the peptide sequence at SEQ ID NO. 33334
  misc_feature (506)..(506): n is a, c, t, g, unknown, or other
  misc_feature (510)..(510): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
aagctggagctccccgcggtggcggccgctctagaactagtggatcccccgggctgcaggaattcgcacgagaccattacctagaacatcctaatcaaaaaactactaccagctgctccctccctccttcccttccctcctacctctctctctctcttcctccgttcgtctcttgactcttctcttctccccatcagccagcagtctctctctctctcacacacacaagcagcgacttgctcacagtagtgctccccggacagaatgaccaaagacgaggagttcaagctggtcaagatccagaaccatgcgctgaaggtgaacatacactgcgacgggtgcaagcacaaggtcaagaagcttcttcagaagatcgaaggcgtgtactcggtggccattgatgtggacaaccacaaggtctcggtgacgggcgatgtggactcggagacccttatcaggaagctcaccaggggcggcaagcacgcggagctgtggtcgcagcccangggncgcggcaacaggggccacagggcaataatggccagcagcagaaacagcagcagccgcagaaccagaaccagaacccacagcagaagcagaaggcagggtgcaatctcagcaaggatgggcacaacagaaacagcacgcgccagagacccnnngggaaaaaacaggggaggggagagagggcttgt

SEQ ID NO: 33334 - protein, 143 aa, Zea mays
  misc_feature: Ceres CLONE 1410958-F
  misc_feature (16)..(76): Pfam Name: HMA Pfam Description: Heavy-metal-associated domain
  misc_feature (81)..(81): Xaa is any aa, unknown, or other
  misc_feature (133)..(133): Xaa is any aa, unknown, or other
MTKDEEFKLVKIQNHALKVNIHCDGCKHKVKKLLQKIEGVYSVAIDVDNHKVSVTGDVDSETLIRKLTRGGKHAELWSQPXGRGNRGHRAIMASSRNSSSRRTRTRTHSRSRRQGAISARMGTTETARARDPXGKNRGGERGL

SEQ ID NO: 33335 - DNA, 711 bp, Zea mays
  misc_feature: Ceres CLONE 1410960-F
  misc_feature: Encodes the peptide sequence at SEQ ID NO. 33336
  misc_feature (534)..(534): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (597)..(597): n is a, c, t, g, unknown, or other
  misc_feature (636)..(636): n is a, c, t, g, unknown, or other
  misc_feature (639)..(639): n is a, c, t, g, unknown, or other
  misc_feature (640)..(640): n is a, c, t, g, unknown, or other
  misc_feature (670)..(670): n is a, c, t, g, unknown, or other
  misc_feature (674)..(674): n is a, c, t, g, unknown, or other
  misc_feature (703)..(703): n is a, c, t, g, unknown, or other
ggagctccccgcggtggcggccgctctagaactagtggatcccccgggctgcaggaattcgcacgagaccattacctagaacatcctaatcaaaaaaaaatcccaccacccttttccccttccaaccctcgggatctctccggcccgccatggaagtgttctactacctcgtgttcggcgcgctcgccgccatcgtggcggcgctggagctcgccaagtccggcaaggaccgcgtcgccacctccccggccttcaactcatttaagaacaactacatcctcgtttactccctcatgatgtctggggactggctgcaggggccctacgtgtactacctctacagccagtacggcttcgacaagggcgacattggccgcctcttcatcgccggcttcggttcctccatgctcttcggcaccatcgtcggatccctcgcggataagcaggggcggaagagggcgtgtgtcacgtactgcatcacctacacatctcagctgcatcaccaagcactctcccccagtacaaagttcttantggatggggcgtgccctttggtggcatttgccacttcgctgctcctnnnntttccccacgttnttagagtacgtggttctgcaagacaacagaaaagattgnatnnccccccaatggggtgtcgatacattctccnaggnctatattttcttgccccatggtctaaggnggcccttt

SEQ ID NO: 33336 - protein, 187 aa, Zea mays
  misc_feature: Ceres CLONE 1410960-F
  misc_feature (4)..(176): Pfam Name: DUF791 Pfam Description: Protein of unknown function (DUF791)
  misc_feature (129)..(129): Xaa is any aa, unknown, or other
  misc_feature (145)..(145): Xaa is any aa, unknown, or other
  misc_feature (150)..(150): Xaa is any aa, unknown, or other
  misc_feature (163)..(163): Xaa is any aa, unknown, or other
  misc_feature (164)..(164): Xaa is any aa, unknown, or other
  misc_feature (174)..(174): Xaa is any aa, unknown, or other
  misc_feature (185)..(185): Xaa is any aa, unknown, or other
MEVFYYLVFGALAAIVAALELAKSGKDRVATSPAFNSFKNNYILVYSLMMSGDWLQGPYVYYLYSQYGFDKGDIGRLFIAGFGSSMLFGTIVGSLADKQGRKRACVTYCITYTSQLHHQALSPSTKFLXDGACPLVAFATSLLLXFPHVXRVRGSARQQKRLXXPPMGCRYILXGLYFLAPWSKXAL

SEQ ID NO: 33337 - DNA, 698 bp, Zea mays
  misc_feature: Ceres CLONE 1410961-F
  misc_feature: Encodes the peptide sequence at SEQ ID NO. 33338
  misc_feature (383)..(383): n is a, c, t, g, unknown, or other
  misc_feature (483)..(483): n is a, c, t, g, unknown, or other
  misc_feature (484)..(484): n is a, c, t, g, unknown, or other
  misc_feature (498)..(498): n is a, c, t, g, unknown, or other
  misc_feature (499)..(499): n is a, c, t, g, unknown, or other
  misc_feature (516)..(516): n is a, c, t, g, unknown, or other
ggagctccccgcggtggcggccgctctagaactagtggatcccccgggctgcaggaattcgcacgagaccattacctagaacatcctaatcgaaatctagaaatccacttcgattcgccctggacgctcctgcctcctgctagtcgacgcgcaatccttggcaatctggcagacaggtgaggcgctgagcctgctactactaactaggagccgcggcgggaaatgagggatgcggaggcggcgtcgcgccggcggtggacgctggtgctggtgaacatggcgtcggtgctggagaaggcagacgaggtgttgctgcccgccgtgtacaaggaggtgggcacggcgctgggcgcttctccgaccgcgctgggctccctcacccntctgcgcgcgctcgtccaggccgcctgctacccgctcgccgcctacgcctccgcgcgccacgatcggggccgtgtcgtcgccgtgggagccttcctctgnngccgcgccaccttnnctcgtcgcgtctccggnagcttcctccagatggcgatctcgcggggcctcaacggcatcggtctcgcgctggtcctcccggcgatcagctcgctcgtcgccgactacacgatgaccacacccgggcgcgggcctttcgggtggctgcagatgacctgcaacctcgctcccatctggggggctcctttcgggggctgctc

SEQ ID NO: 33338 - protein, 158 aa, Zea mays
  misc_feature: Ceres CLONE 1410961-F
  misc_feature (54)..(54): Xaa is any aa, unknown, or other
  misc_feature (87)..(87): Xaa is any aa, unknown, or other
  misc_feature (88)..(88): Xaa is any aa, unknown, or other
  misc_feature (92)..(92): Xaa is any aa, unknown, or other
  misc_feature (93)..(93): Xaa is any aa, unknown, or other
MRDAEAASRRRWTLVLVNMASVLEKADEVLLPAVYKEVGTALGASPTALGSLTXLRALVQAACYPLAAYASARHDRGRVVAVGAFLXXRATXXRRVSGSFLQMAISRGLNGIGLALVLPAISSLVADYTMTTPGRGPFGWLQMTCNLAPIWGAPFGGC

SEQ ID NO: 33339 - DNA, 683 bp, Zea mays
  misc_feature: Ceres CLONE 1410963-F
  misc_feature: Translation starting site: 193
  misc_feature: SWISSPROT Homolog: EC 3.1.2.15 Ubiquitin thiolesterase
  misc_feature (300)..(300): n is a, c, t, g, unknown, or other
  misc_feature (357)..(357): n is a, c, t, g, unknown, or other
gctctagaactagtggatcccccgggctgcaggaattcgcacgagaccattacctagaacatcctaatcgaaaaatcaaagatcggctgcctgtccgctgttggctctttaattgcctgtgcctgtgctgcccccattcctttctcctccagcaagtaaaccccgtttccacaacgtcaccgcaccgccgtcatgccgaccgtaagcgtgaaatggcagaaggagctctttccaggcatagagattgacactagccagcctccgattgttttcaagactcagttgtacacactaactggntgtgcacctgaacgccaaaaaatatggtgaagggaggaatattgaaggacgatgcanattggtctactttgggagtgaaagatggcccaaagttgatgatgataggcaccgctgatgagattgtaaagcctcggagaaagtccagggtttgttgaggatctacaaaaaaaagagcaggggatgccctgggtcccagggctggccttataaccttgggaaacctggtaaaatgattccaaattggaagggctggattttgtccaaaaggggaagccggggggcaaacttttcaaaacggggaaggggtagggctttccccacctccccaaaattggggggggccacccaaaaccctttggagatttaaaaaaagggttccccct

SEQ ID NO: 33340 - DNA, 681 bp, Zea mays
  misc_feature: Ceres CLONE 1410965-F
aagctggagctccccgcggtggcggccgctctagtatagtggatcccccgggctgcaggaattctcacgagaccattacctagaacattctaatcgaaaagaagggaaaagcattccaacgctgcatctgcactgcacggtacttcctcctcctcatcctcctctatctctaagaatttaaaagagaagaagggggaagtcctcgactgctcgttccataaaccctaacctcgttggattcgcggcaaaaatcctcccaattcggaaccctccgatgttccagctacctgcgggagctgagccgtgctcggtttggcgaaattttgcacccctcttgtgctaggaccacccggttcaagctgttcctcggaaggatcaggtcttcaccggtgctctccggcgccggatccaggtttgttccggcgagaggtcgggctcttggtggggggcagcccagcttcgagctcaatttgccggcctgagatggaatcgcgactgcggtgccggtgccggtggctcagctagtcgcgtcaagtcaacgcgcgattccttgcatttgggggggccagctttcctggcatctcggggggggttccccctcctgcgtggcagaaaggtgggacgtgtgatgcatcccaaggctcaatcccccgccgacccggtgggggagggccgaccctt

SEQ ID NO: 33341 - DNA, 697 bp, Zea mays
  misc_feature: Ceres CLONE 1410967-F
  misc_feature: Encodes the peptide sequence at SEQ ID NO. 33342
  misc_feature (550)..(550): n is a, c, t, g, unknown, or other
  misc_feature (551)..(551): n is a, c, t, g, unknown, or other
  misc_feature (577)..(577): n is a, c, t, g, unknown, or other
  misc_feature (579)..(579): n is a, c, t, g, unknown, or other
tggagctccccgcggtggcggccgctctagaactagtggatcccccgggctgcaggaattcgcacgagaccattacctagaacatccttcgaaaagaacgacaaacacgagcgcgggcgcgcacaagttcgccaacccccaccccccgcgtgctgcgcgtcgttggaaccaaggcttggattagtctcgccgaggaggaggtggtggtcggcgaggggctcgcggggatggggatctcgaggccccttgtggtggcgatggcggtggcgctgctgatcgccgtcgccggtgcgaccgccgaggagcaggagcccctgctggcggcggacgcggtggccggcgcggtggaggcggcgctcagggccgagctggggcaactccgggcgaagatctcggcgctagagtcagacatagaagagcgatctcaagaactgaagaataaggatgatgccatcatgaacctggagaaagtcattgaagagagtcaaaggctattacctctatgctggacgagattgcttcccctcaggcaaagggtctgtagctgccnngagagcagctaaacaagccaatggcnangtttgttgagctggaaaagcaggttgacaagatcaaaaaggatattggagcacaaagcagccaaaagcagcactagaggttggggccaaccatccaaaaaaaaaggggaaaacttaat

SEQ ID NO: 33342 - protein, 111 aa, Zea mays
  misc_feature: Ceres CLONE 1410967-F
  misc_feature (108)..(108): Xaa is any aa, unknown, or other
MGISRPLVVAMAVALLIAVAGATAEEQEPLLAADAVAGAVEAALRAELGQLRAKISALESDIEERSQELKNKDDAIMNLEKVIEESQRLLPLCWTRLLPLRQRVCSCXESS

SEQ ID NO: 33343 - DNA, 635 bp, Zea mays
  misc_feature: Ceres CLONE 1410968-F
  misc_feature: Encodes the peptide sequence at SEQ ID NO. 33344
gcgggttttcgcacgagaccattacctagaacatcctaatcgaaaaactccaccagtccggttcatctgctggacctcgattggtttcttcttacctaggaacatccggggatgtcgactcctgcgaggaagagggtgatgaggtatttcaagcggctgatgcaggaccctccggccggtataagtggcgccccgcaggataacaacataatgctgtggaatgctgtcatatttggacctgatgataccccgtgggatggaggtacgtttaagctgactctccagtttaatgaagaatatccaaacaaaccaccaactgtgcgatttgtttctaggatgctccatcctaacatttatgctgatggaagcatatgcttagatatcctgcagaatcagtggagtccgatatatgatgtagctgcgatactcacgtaaatccagtcattgttgtgagatccaaacccgaattcggccgctaactctgaagccgcccgcatgttcagcgagaacaagtgagagtacaaccgcacagttcgggaggtcgtggagcagagctggacggcggactgatgatgccctgtgatgcgtcgcgatgtgctgcgcagatgctcactgcagcccgaaacataggtgag

SEQ ID NO: 33344 - protein, 107 aa, Zea mays
  misc_feature: Ceres CLONE 1410968-F
  misc_feature (8)..(108): Pfam Name: UQ_con Pfam Description: Ubiquitin-conjugating enzyme
  misc_feature: SWISSPROT Homolog: EC 6.3.2.19 Ubiquitin--protein ligase
MSTPARKRVMRYFKRLMQDPPAGISGAPQDNNIMLWNAVIFGPDDTPWDGGTFKLTLQFNEEYPNKPPTVRFVSRMLHPNIYADGSICLDILQNQWSPIYDVAAILT

SEQ ID NO: 33345 - DNA, 698 bp, Zea mays
  misc_feature: Ceres CLONE 1410970-F
  misc_feature: Encodes the peptide sequence at SEQ ID NO. 33346
  misc_feature (346)..(346): n is a, c, t, g, unknown, or other
  misc_feature (570)..(570): n is a, c, t, g, unknown, or other
tggagctccccgcggtggcggccgctctagaactagtggatcccccgggctgcaggaattcgcacgagaccattacctagaacatcctaatcaaaaagcttgctttgcttccgagtttcgacacgcgtgcccaggaatcggtcggattccccaatcccgtcaccatggccgcgccgccttctccttcgtcccgctccccgtccagcgaggttgccgtccacagattcagcggcaccttggatgtatcatcatcgccctcaaggaccgagttgttgagcatggtgaagaagcactcacatttgattgggtggacgattattggtgccgaggatgatgcatcagatgntggaatggatgataaattctggcatgaaatgcttgacctattctttgtgcgtggcaggcaatcaaaaagaagtgaagaggatgaccttgtcttctttgttaataacatgaaatggcatggttatggtttcaatgataacatggaagaatcacctcccttttttgtacggagatgggcttccacgcttgaaaagatcagtattaatacggtggagggtgattggnaggcgtcattctatttgaatttaatcgctcacacgtcgtacactgtcactgttgcaatatttgaaattaaaatcttccgcaccgtgcagagaaaaacaacaggtgcctccagtttataggttacaaaa

SEQ ID NO: 33346 - protein, 174 aa, Zea mays
  misc_feature: Ceres CLONE 1410970-F
  misc_feature (61)..(61): Xaa is any aa, unknown, or other
  misc_feature (136)..(136): Xaa is any aa, unknown, or other
MAAPPSPSSRSPSSEVAVHRFSGTLDVSSSPSRTELLSMVKKHSHLIGWTIIGAEDDASDXGMDDKFWHEMLDLFFVRGRQSKRSEEDDLVFFVNNMKWHGYGFNDNMEESPPFFVRRWASTLEKISINTVEGDWXASFYLNLIAHTSYTVTVAIFEIKIFRTVQRKTTGASSL

SEQ ID NO: 33347 - DNA, 687 bp, Zea mays
  misc_feature: Ceres CLONE 1410973-F
  misc_feature: Encodes the peptide sequence at SEQ ID NO. 33348
  misc_feature (404)..(404): n is a, c, t, g, unknown, or other
  misc_feature (428)..(428): n is a, c, t, g, unknown, or other
  misc_feature (482)..(482): n is a, c, t, g, unknown, or other
  misc_feature (504)..(504): n is a, c, t, g, unknown, or other
  misc_feature (509)..(509): n is a, c, t, g, unknown, or other
  misc_feature (657)..(657): n is a, c, t, g, unknown, or other
aagctggagctccccgcggtggcggccgctctagaactagtggatcccccgggctgcaggaattcgcacgagaccattacctagaacatcctaatcgaaaaaaatcgaattcgccatgggcatggctgctccgcgcgcgccgctgcctctcccccaactgctgctcctcctcgttgccgcgctcctcgccgccgctcccctccctagggcggccagggcggacgagttcgacgtccgccgccacctctccaccgtcaccaggtatgatgtggccagggagtccagtagtgtcatctccatgccgtcaatcccagacgggtgccgtgtcattcacctcaatttagtggcaagacatgggactcgcgctcctaccaagaagcgcatcagggagctggatagattgncagttcgactggaagcccttctgnacagagcaaatcaggtccttgatagtgattctctgaagaaaattccatcctggnataaagctgagcatcacgctgnaaggntaggactaaaggtgtgagctgaattagtgaagggggagaggagctttaccattcagctaccagagggagggagaggtttcaagatctatttgatgacgatatcaccctgattgatattcataagaggacccaggttctcgagcatcanctaaggcagggcaatttgggttggactact

SEQ ID NO: 33348 - protein, 136 aa, Zea mays
  misc_feature: Ceres CLONE 1410973-F
  misc_feature (97)..(97): Xaa is any aa, unknown, or other
  misc_feature (105)..(105): Xaa is any aa, unknown, or other
  misc_feature (123)..(123): Xaa is any aa, unknown, or other
  misc_feature (130)..(130): Xaa is any aa, unknown, or other
  misc_feature (132)..(132): Xaa is any aa, unknown, or other
MGMAAPRAPLPLPQLLLLLVAALLAAAPLPRAARADEFDVRRHLSTVTRYDVARESSSVISMPSIPDGCRVIHLNLVARHGTRAPTKKRIRELDRLXVRLEALLXRANQVLDSDSLKKIPSWXKAEHHAXRXGLKV

SEQ ID NO: 33349 - DNA, 642 bp, Zea mays
  misc_feature: Ceres CLONE 1410974-F
  misc_feature (642)..(642): n is a, c, t, g, unknown, or other
ggcgtgggttactgtgcgtcccgcgggctgcatgtattcgcacgagaccattacctagaacatcctaatcgaaaagtccctccactcctcccgtcgagcacttggcactgccaatggcggcagccgcccacaccccttcgatgggcgcaaggcgcctcctttcctcctgagatcgacgcacctcctcctctcgtactccattcccgctccaagtttgtttcttcggcaccgagccatcgcacggccgcccccgcatctcgtcctgctctcaggaccttggcctccgccgttcttccacaggggcgcgacccggtgcccactccgcgaaatccgagtccctcgtgcagcggggagggtggaaaagatccatcacgcgctgagcggcaggacgcgcccctacaactgagggggcgggcaatggcggccgtggcaggcccactctgcacgtggctcgttgccgcgtggtttgcccgcggcttgcgaccccgaagaatacaagcataagcattgctgccccggcgggaacggggctggggggcggcctcatgggtcggccagcggcggcggcctcgggctcgggggtcggggcttgggccgctcccggaaagggtatgggttgggggccttacaaggccgaaaaan

SEQ ID NO: 33350 - DNA, 772 bp, Zea mays
  misc_feature: Ceres CLONE 1410976-F
  misc_feature: Encodes the peptide sequence at SEQ ID NO. 33351
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (51)..(51): n is a, c, t, g, unknown, or other
ggggcccccccnnnnnatttnnnnnttggggcgggcacgcggtgggggggnccaaagctggactccccgcggtggcggccgctctattaactagtggatcccccgggctgcaggaattcgcacgagaccattacctagaacatcctaatcaaaaaaaacgaaaaactaccagaaaaattagaaatccccaaatccgcgagatctatcagtatcgagcgatttaccgatccgattgctagggtttagcttcgaaaaagaaactctgaaaaaaaattctggtcgagggaaggagacgatggcagcgcaagtggcggcgggggtggcgccgaatggaagcccgggcgctgtccccgcggtggtgccgccgggagcgggcggcgtcggactcgggggggcggagccgctcccgaccacgtgggtcaacggcggcgagcggggggggtccgtctcggactggaaggtgtacgagctcttcagccaggaggagtagggggggtccggagagcgtctgcaggggagcccacctcgcgccggtcggctggggtacggccacgggggacttcaacaaaccccttggatggttgcaaggggcattgggaagaggcggaactttggggcccgcgtggggaaccaaagcaatccggggagtacggatgtcaaaagcggggagaccgggcaagcccgcagggaagcggagccggcctaccaatgtttcaccaaaaaaatcgtgggcgaaggaaggagggggcgaagaaggggccccatgcctgga

SEQ ID NO: 33351 - protein, 64 aa, Zea mays
  misc_feature: Ceres CLONE 1410976-F
MAAQVAAGVAPNGSPGAVPAVVPPGAGGVGLGGAEPLPTTWVNGGERGGSVSDWKVYELFSQEE

SEQ ID NO: 33352 - DNA, 661 bp, Zea mays
  misc_feature: Ceres CLONE 1410978-F
  misc_feature: Encodes the peptide sequence at SEQ ID NO. 33353
  misc_feature (273)..(273): n is a, c, t, g, unknown, or other
  misc_feature (522)..(522): n is a, c, t, g, unknown, or other
  misc_feature (523)..(523): n is a, c, t, g, unknown, or other
  misc_feature (606)..(606): n is a, c, t, g, unknown, or other
  misc_feature (607)..(607): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
agagctggagctccccgcggtggcggccgctctagaactagtggatcccccgggctgcaggaattcgcacgagaccattacctagaacatcctaatgaaaagaatcgggtcagatcgggccatcggggaagcgagggagctcacgcggcgccatggacgaggaggagcacgaggtttacggccaggaaatcccggaggacggcgacatggacggcgctgacgttgatatggctgcctccggggatgacgcggcgaagctgcaggagctcgacngagatgaagccgcaaggctttggaaggggaaatgggggggggggaaaaaccccccccccccccccccccgatatttattaggggccccaggggggccccccccaggaaggaaaaaggggggggggggggccccccccctaaagcggggggggggggggggttttcctcccccccccccaaaaagaggggggggcgccttttttgttcccttgggggaaaaggggggggggggaagttgggggggggggnngaaaaattggtggtaaaataaacacccgggcgccccccccgcggggggggggggttttttttttttttataagaaaaaaaaanntcgggcccgcgccccgcnnntggggggggggccggtccaccccgcccccccccc

SEQ ID NO: 33353 - protein, 128 aa, Zea mays
  misc_feature: Ceres CLONE 1410978-F
  misc_feature (41)..(41): Xaa is any aa, unknown, or other
  misc_feature (124)..(124): Xaa is any aa, unknown, or other
MDEEEHEVYGQEIPEDGDMDGADVDMAASGDDAAKLQELDXDEAARLWKGKWGGGKNPPPPPPRYLLGAPGGPPPGRKKGGGGAPPLKRGGGGGFPPPPPKRGGGAFFVPLGEKGGGGSWGGGXKNWW

SEQ ID NO: 33354 - DNA, 750 bp, Zea mays
  misc_feature: Ceres CLONE 1410983-F
  misc_feature: Encodes the peptide sequence at SEQ ID NO. 33355
  misc_feature (23)..(23): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ggggcccccccccccccccccanacacaccnnnntnnnggggggnnngttcaaactggggctccccgcggtggcggccgctctagaactagtggatcccccgggctgcaggaattcgcacgagaccattacctagaacatcctaatcgaaaaacgcacctcccgacttctccggttctcccttcttcatagcagccacccacgcatctcagcgccgaggcgagcgaggacctcgtggttcgtgccctgctcacctcgtgaggatgtggatcgcgagccggctcttcctcgcggcggcggcgctgctgatggctgtgcttctgctcgtcgcggggccggtggcggcgcaggacgcggcggtggagggcgtggccccgcctgcggaggagatcgcggcgaacgcgagggccaaggaggcggtggttctggccgccgagctagtgcagctcagggcgaagatctccgcgttagagtctcgcattgcagagcagaccctggaggtcaagaccaagaatgatgcaatcgaaacactgaatatgattgtcaaggaaaagccacagaagaattgctactatggagaatggaaccccaaaggtcctttacctgcagagggagcagggcaaggcaagggcaaagggcctgggcttattggggttcaagaaaggagaaccgagaaagcttcggggaaggggtgttttcccggaacccaaaaaaatttaaaaaaagcggcgcctcctgggggaggggtagg

SEQ ID NO: 33355 - protein, 162 aa, Zea mays
  misc_feature: Ceres CLONE 1410983-F
MWIASRLFLAAAALLMAVLLLVAGPVAAQDAAVEGVAPPAEEIAANARAKEAVVLAAELVQLRAKISALESRIAEQTLEVKTKNDAIETLNMIVKEKPQKNCYYGEWNPKGPLPAEGAGQGKGKGPGLIGVQERRTEKASGKGCFPGTQKNLKKAAPPGGGV

SEQ ID NO: 33356 - DNA, 660 bp, Zea mays
  misc_feature: Ceres CLONE 1410989-F
  misc_feature: Encodes the peptide sequence at SEQ ID NO. 33357
  misc_feature (660)..(660): n is a, c, t, g, unknown, or other
caagctggagctccccgcggtggcggccgctctagaactagtggatcccccgggctgcaggaattcgcacgagaccattacctagaccttccaatcgaaaaattcctctattgtctctctcgaaatcggccgtctctctcccgaccggcacttcctccgatcgactagcctgcggcgagcgccggcgccggcgaccagcggacatgcgggtggtacccagggtgctcttcctcgtccgcgacgccgcgggctacggcgctgccctcgtcgacgcgctccgcccgccgaccgggctaacgagggagtcctcgccctttggagctacccccttagaaaggacctgccctcgacagggatggtagtggggcccccagcttccctgagtttttcggagtccgggggctctccacgggggcccattttttgggccggcagaaccaaaaccccccctttgcggccaggggcggaaaaggcggccctggaaatggtttcctttggaaacccccccccccgggggggaaattccaatggggcccaataatccccaggacccgccgccccctccctcccttgggaacgaggaagggggaaccagggggggggttcgtggcccccccccgggggggggacaaccggggggcgcccccccctgtttgtttn

SEQ ID NO: 33357 - protein, 52 aa, Zea mays
  misc_feature: Ceres CLONE 1410989-F
MRVVPRVLFLVRDAAGYGAALVDALRPPTGLTRESSPFGATPLERTCPRQGW

SEQ ID NO: 33358 - DNA, 760 bp, Zea mays
  misc_feature: Ceres CLONE 1410991-F
  misc_feature: Encodes the peptide sequence at SEQ ID NO. 33359
cagagctggagctccccgcggtggcggccgctctagaactagtggatcccccgggctgcaggaattcgcacgagaccattacctagaacatcctaatcaaaaaccaaaccagcgaggcagctaccgttttgtcgccatagcactcccgccgaccccctcgccgccgcctggaatggagaccagcaccaagaagcttagcagccttcgtatcacctccctggacgacgatgacgacgagaccgagatcccgcaccagccccctcaagcaggcctctccaccgctgaagcggattatgaggacgacgacgatgaggaggaagaagccgaagtgactcttggtgtccttagcaaaccgaagcacccaggcctcctcctccgccacttgttccccagcaaggccggtggcatcccggcgtggctagacccggtgaacttgccgtcgggaaagtccagctactgtggtttctgtggcgagcctctgcagttcgtcctccaggtgttttctttgtgtgcaatgaagttgccacactcgactgcttattgtttggatatcgacttggtcacagttaggcttggttgtgtttagatttatgcaccaattgaagataatgtagcagccttccaccgaacgctgttcatgttcatgtgcccatccatggcatgcttgcttcgagatcaacatgaacaaggggagcacaagtacgggaatccatgtagaagcgtgaagattttccggtgccaattgccacggaataatgcc

SEQ ID NO: 33359 - protein, 137 aa, Zea mays; identical to SEQ ID NO: 22894
  misc_feature: Ceres CLONE 1410991-F

SEQ ID NO: 33360 - DNA, 656 bp, Zea mays
  misc_feature: Ceres CLONE 1410992-F
  misc_feature: Encodes the peptide sequence at SEQ ID NO. 33361
  misc_feature (123)..(123): n is a, c, t, g, unknown, or other
  misc_feature (422)..(422): n is a, c, t, g, unknown, or other
  misc_feature (453)..(453): n is a, c, t, g, unknown, or other
  misc_feature (595)..(595): n is a, c, t, g, unknown, or other
aaagctggagctccccgcggtggcggccgctctagaactagtggatcccccgggctgcaggaattcgcacgagaccattacctagaacatcctaatcaaaagtcacaactcacatcgaggtcngtcagcttcaggaaagggaaggaagcatgttcgggcaccaccacggccacggcgggcaccaccaggccccgccgccgcacgagcagacgctgttcaggatcttctgccgcgccgacgaggcgtactgcctcaccgtgcgtcacgacgccgtcgtcctcgcgcccaccaacccccgcgacgagtaccagcactggtacaaggacatgaggcacagcacgaaggtgaaggacgcggagggccagccagcgttcgcgctcatcaacagggccaccggcctcgccatcaagcactcgctcggncagtcccatcccgtgaagctggtgccctacnacgcggagtacctggacgagtcggtgctgtggacggagaagcacgacgtgggcaagggcttccgctgcatccgcatgggtcacagcatcacctcaacttcgacggcttccacggcgacaaggacacgggggcgtgcacgacngcaccacgtggtgctctgggagtggtgcgagggccccaccagaactggaggggtgccctgg

SEQ ID NO: 33361 - protein, 169 aa, Zea mays
  misc_feature: Ceres CLONE 1410992-F
  misc_feature (102)..(102): Xaa is any aa, unknown, or other
  misc_feature (149)..(149): Xaa is any aa, unknown, or other
MFGHHHGHGGHHQAPPPHEQTLFRIFCRADEAYCLTVRHDAVVLAPTNPRDEYQHWYKDMRHSTKVKDAEGQPAFALINRATGLAIKHSLGQSHPVKLVPYXAEYLDESVLWTEKHDVGKGFRCIRMGHSITSTSTASTATRTRGRARXHHVVLWEWCEGPTRTGGVPW

SEQ ID NO: 33362 - DNA, 593 bp, Zea mays
  misc_feature: Ceres CLONE 1410995-F
  misc_feature: Encodes the peptide sequence at SEQ ID NO. 33363
  misc_feature (370)..(370): n is a, c, t, g, unknown, or other
  misc_feature (479)..(479): n is a, c, t, g, unknown, or other
aaagctggagctccccgcggtggcggccgctctagaactagtggatcccccgggctgcaggaattcgcacgagaccattacctagaacatcctaatcgaaaaaagataacaatcaacaaacaacaagcccgcgcgagactgttctttctccatttcccaatggccgccgccgccgccgtcttctttccctccaccccgaatcctcggcaccgcctcgccgccgccgcccgccgccctccacccagcttcaccggcgccaccgacgccgtgccgctaccggaggacgaggactccagcgacgacgatgccgacgacgacggcgcgccacgcaggagcgggcgcagggaccggcgccgcgcggtgcgcgtcncgtgggagaagctagtccgtggtcccgctcctggcgcggcgcaaccgcagcgacgtcctcgagacacgcgcaaggtggtggttctcgggggcgggtcgttcgggacggncatggccgctcacgtggcggccaaaaagccgatttcgaggtggcatggcctcaggaagaccacatttggcggtccttaaaaaaggaaatgggcattgcaggactttttcaaaag

SEQ ID NO: 33363 - protein, 132 aa, Zea mays
  misc_feature: Ceres CLONE 1410995-F
  misc_feature (71)..(71): Xaa is any aa, unknown, or other
  misc_feature (107)..(107): Xaa is any aa, unknown, or other
MAAAAAVFFPSTPNPRHRLAAAARRPPPSFTGATDAVPLPEDEDSSDDDADDDGAPRRSGRRDRRRAVRVXWEKLVRGPAPGAAQPQRRPRDTRKVVVLGGGSFGTXMAAHVAAKKPISRWHGLRKTTFGGP

SEQ ID NO: 33364 - DNA, 680 bp, Zea mays
  misc_feature: Ceres CLONE 1411000-F
aaagctggagctccccgcggtggcggccgctctagaactagtggatcccccgggctgcaggaattcgcacgagaccattacttagaacatcctaatcgaaaacaaagcctttcttcctcctgtgaagccaactcgtcccctcgggtcaacgcgaggccaaaaccaatctcacatctcctccccctcccaccaccgaggacccttccccaagaactgctccgagtcctcggagcgggtagagaggtcgcaggcgacggagcccaattaagagtgttctccctcgcactctcctctcctctctttctggtcggaaaaattattgtcgccattggtttggcttcccttgccaaaaggagggtgggtttttccgggcccccccggacccaaacctgacgggggaagaacgggaattaacgaacgggcgccgcgccgaacgcgttggggattttggggggaaacccccccaagccccggtgggaaccggggcgggtgggggggggcgccccgcgccaagggggggccactgcccggggcgaaaaagggggggcctctccccgggggaggaggggggggggatcttaaaacaacccggcggggggggaggcctcccagaacccaaagggggggggggcccaccagggacgccccccaacagtgttactcccgccgcccccccccca

SEQ ID NO: 33365 - DNA, 672 bp, Zea mays
  misc_feature: Ceres CLONE 1411005-F
  misc_feature: Encodes the peptide sequence at SEQ ID NO. 33366
  misc_feature (26)..(26): n is a, c, t, g, unknown, or other
  misc_feature (27)..(27): n is a, c, t, g, unknown, or other
  misc_feature (33)..(33): n is a, c, t, g, unknown, or other
  misc_feature (672)..(672): n is a, c, t, g, unknown, or other
aaactggagctcccctcggtggcggnnggtggnttacggtgcatcggcgggctgcaggattccacacaagaccattacctagaacatcctaatcgaaaaacatacctcccgacttttccggctctcccttcttcatagcagccacccacgcatctcaatgccgaggggagagaggacctcgtggttcgtgccctgctcacctcgtgaggatgtggatcgcgagccgtctcttcctcccggcggtagagctgctgatggatgtgcttctgctcttcgcggggatcggtggcggcgcatgacgcggtggtgtacggcgtggccccgcctgcgaaggagatcgcggagaacgcgatggtttatgaccacatggttgtggggggcgagctaatgccgatcagggcgaagatctccgcgttagagtctcgcattgcagagcagaacctggagttcaagaccaagaatgatgcaatccaaacactgaatatgattgtcaaggaaaagactcagaatattgctactatgcagaatgaagtcaaagggtctttacctgcaaaggagcaagcaaggaaggccaatgcactggctattgagctcaagaaacataccgagaagctcaagaatgatattacggaacaaaaaattaataaactagctctggaggctacggatggn

SEQ ID NO: 33366 - protein, 138 aa, Zea mays
  misc_feature: Ceres CLONE 1411005-F
MCFCSSRGSVAAHDAVVYGVAPPAKEIAENAMVYDHMVVGGELMPIRAKISALESRIAEQNLEFKTKNDAIQTLNMIVKEKTQNIATMQNEVKGSLPAKEQARKANALAIELKKHTEKLKNDITEQKINKLALEATDG

SEQ ID NO: 33367 - DNA, 728 bp, Zea mays
  misc_feature: Ceres CLONE 1411012-F
  misc_feature: Encodes the peptide sequence at SEQ ID NO. 33368
aaagctggagctccccgcggtggcggccgctctagaactactggatcccccgggctgcaggaattcgcacgagaccattacctagaacatcctaatcaaaaaatgtcgtcgaccacagaagctctggctccgatgatgatcttggcgctcgccgctgtgctgctggccaccgctgcacgtcagccgtcgccggttatgtccacgaccaccaccaacctgaccctccacaacctgtgcccgtacccggtgtggccgctggtgaccgccaacgcgggcaatccgtccatccccaccgacgccgacggcgagccggcggggcggctggacggcaacggcgagggcctggcgacgctagcgttcccgccgggcgcgtggtcgggccgcgtggtggcgcggacgggctgcactggcggggacgacaacgacgaggcggacgcgtacgacccgctgcttccgacccctcctctccgttgcacgactggcgacgcgccgccggtgacggtggcgcaggtgagcgtgggcgggatgggcggggccgcggcgtacagcgtgatggtgcacccgatcgcggaggccgacgagcggagccccttcggccgcctgacgccggacgagttctacgcgcgccacggcgtgacccactccgcctcgtccttcgtcaacccgcgggggctccgcatcttcacccagcgctgggtgcccagtggggacgcccccgtcctgggcgc

SEQ ID NO: 33368 - protein, 208 aa, Zea mays
  misc_feature: Ceres CLONE 1411012-F
MSSTTEALAPMMILALAAVLLATAARQPSPVMSTTTTNLTLHNLCPYPVWPLVTANAGNPSIPTDADGEPAGRLDGNGEGLATLAFPPGAWSGRVVARTGCTGGDDNDEADAYDPLLPTPPLRCTTGDAPPVTVAQVSVGGMGGAAAYSVMVHPIAEADERSPFGRLTPDEFYARHGVTHSASSFVNPRGLRIFTQRWVPSGDAPVLG

SEQ ID NO: 33369 - DNA, 749 bp, Zea mays
  misc_feature: Ceres CLONE 1411014-F
  misc_feature: Encodes the peptide sequence at SEQ ID NO. 33370
  misc_feature (670)..(670): n is a, c, t, g, unknown, or other
caaagctggagctccccgcggtggcggccgctctagaactagtggatcccccgggctgcaggaattcgcacgagaccattacctagaacatcctaatcgaaaaattccgcgccgcatctgggaaggtctcgtcttgctcgcctccgtccgtcgccgcaccctgcgtcgtcgccatggccacgacgcagggtgcggcggcggccggagtgttcgtctcttgctccgccgggaactccggcccatccggatccaccgtctcaaactccgctccgtgggtcgccaccgtcggcgccgggacactggaccgcgacttcccggcatacgtgatgctccccacgggtgcgcgcctggccggcgtgtccctctacgcggggccttctccctccccacgccccgccatgctcccgctcctctacggcagcgggcgtgacaacgccagcaagctctgcctctccgggacgctcgacccggccgccgtgcgcggcaaaatagttgtgtgcgaccgcggcgtcaacgcgcgcgtggagaagggcgccgtcgtgaaggcggccggcggcgccggcatgatactggcgaacacggcagccagcggagaggagctcgtggcggacagccacctgctccccgcggtggcggtggggcgcgcggtgggcgacaaaatacgggagtnacgcgcgcgcggtggcggtagcccatggcgatgctgagcttcgcgggacgggtctgggcgtccggcgtctccggtcgtg

SEQ ID NO: 33370 - protein, 177 aa, Zea mays
  misc_feature: Ceres CLONE 1411014-F
  misc_feature (70)..(167): Pfam Name: PA Pfam Description: PA domain
  misc_feature: SWISSPROT Homolog: EC 3.4.21.25 Cucumisin
  misc_feature (166)..(166): Xaa is any aa, unknown, or other
MATTQGAAAAGVFVSCSAGNSGPSGSTVSNSAPWVATVGAGTLDRDFPAYVMLPTGARLAGVSLYAGPSPSPRPAMLPLLYGSGRDNASKLCLSGTLDPAAVRGKIVVCDRGVNARVEKGAVVKAAGGAGMILANTAASGEELVADSHLLPAVAVGRAVGDKIREXRARGGGSPWRC

SEQ ID NO: 33371 - DNA, 757 bp, Zea mays
  misc_feature: Ceres CLONE 1411016-F
  misc_feature: Encodes the peptide sequence at SEQ ID NO. 33372
cacagctgtagctcctccttagactggcggccgctccatcactaatggatcccccgggctgcaggaatacccacgagaccattacctagaacatcctaatcgaaaagctagggtttactgcttgtcttcctttctcggcagtcggcaccttcgcggcttcgcctgatcgcctacgccgcttcgtcctgattctgattctctggtgctcccaagaagaaagtcagggaatgaaggaccgccacctctcgctgaaccagacccagcgggtccgcctcgaggccgcgcttcaagagctccagtccgttgcgcccgccgccgcgtccgccgccgccgtcaccgtcgcggacaccattcccgtcaatcaagaggacaacatcctcaaggggcatgggacgtcggatcaggacggggaggtggttgcgacgctctggcggggggtggagcggggcaacaaggtgggctacgtccggactcttcgcgcgagatacaagccggagggtggtgatatcatagttggccgggggattgagattgctcctaagcggtggaggggggagataaattttaaccaaggagcgtgtccgatgccttcctccatgaacttgccctgatggtattccgagaaaggaaaactggtggtggaggaaactaatacgggggaggaccttttgaagaaaatggtggtcatccggggctggaagtccagggcttcccaacatggacggggcctctggggcctaccggggaggggggggaa

SEQ ID NO: 33372 - protein, 127 aa, Zea mays
  misc_feature: Ceres CLONE 1411016-F
MKDRHLSLNQTQRVRLEAALQELQSVAPAAASAAAVTVADTIPVNQEDNILKGHGTSDQDGEVVATLWRGVERGNKVGYVRTLRARYKPEGGDIIVGRGIEIAPKRWRGEINFNQGACPMPSSMNLP

SEQ ID NO: 33373 - DNA, 719 bp, Zea mays
  misc_feature: Ceres CLONE 1411023-F
  misc_feature: Encodes the peptide sequence at SEQ ID NO. 33374
aaagctggagctccccgcggtggcggccgctctagaactagtggatcccccgggctgcaggaattcgcacgagaccattacctagaacaatctaatcgaaaatttcttctctcgttcacctcgcgtgcgcgaaccaactagggcgaccgctgccgccctacggcctacgcccagctgctcaggtcttattcgggcctttggcggcgagaaccgaccgcgccaggataatggctcaccgtggacacctagatggactgactgcccaagctccagcactgatgcgccatggttccttcgctgcaggcagcctttctagccactcacctttggagtcttcatctacactggagatgctggagaacaagcttgccatgcaaactgcagaagtggaaaagcttatcatggagaatcagcggttagcatcaaggcctgtgggccttgaggcaggacattggttgattcccaagaaggagatggaaataatcccgccctcccctagggggaagttcaaaaggagactgatttggcatattaaaaatttattgggaaagatttaattaatgggggggggaccttacctaaggggggagggcggggaaaaaaaagactttctccacagggggtttgggggggccaaaaaaaccttttttttggaaagggggaaatgcttgccccttgagaaaaaaaaaggtgggcctataaaaaattcaacaaaaccc

SEQ ID NO: 33374 - protein, 109 aa, Zea mays
  misc_feature: Ceres CLONE 1411023-F
MAHRGHLDGLTAQAPALMRHGSFAAGSLSSHSPLESSSTLEMLENKLAMQTAEVEKLIMENQRLASRPVGLEAGHWLIPKKEMEIIPPSPRGKFKRRLIWHIKNLLGKI

SEQ ID NO: 33375 - DNA, 779 bp, Zea mays
  misc_feature: Ceres CLONE 1411025-F
  misc_feature: Encodes the peptide sequence at SEQ ID NO. 33376
  misc_feature (29)..(29): n is a, c, t, g, unknown, or other
  misc_feature (57)..(57): n is a, c, t, g, unknown, or other
tactagctggagctccccgtaggtggggncgcgcaatccatcccggacccccggggngcaggaataacaaccacagcattagcgagaacatcctaatcgaaaaatccggccattccaatccccctcttccggtccgcctccctctagctcctctccctctcgcagccatcctcgtccccccaagaatccggacggcggggggcccctccttttctgggcggttacatctttaagctcaaagagaaagtattatggaaatggggcacttgatcactaattggagctttcagacattctcgaggtctcctaattactggcgcaatattgggcaactacagaactcaaaatcttcaaatctggccctcaaatcttggtccaggagacgaaaggaggcatatggtacctgggctagcgctgccggacaagggcagacacaaacacctcttactgggaggcagcaagcttatgagcattcatcctccaaacctaaaaagggaatggttattggtggggatggatactgggggggggcaacagcacttcatctctcaaaccaagggtatgaggggtggagtgggtgataatccttgggcggcggtggttttgataaccaactcgggtgttggagtcccttaacgcccctaaacctccattccaaaaatccggggcccggaaaatgggaagtcttcccacctgcgtaaaaacaaacccaggcttctttatacgggggggcatattggggagtttgtgcagaattcctcctccagaaaaggcctttc

SEQ ID NO: 33376 - protein, 109 aa, Zea mays
  misc_feature: Ceres CLONE 1411025-F
  misc_feature: SWISSPROT Homolog: EC 3.13.1.1 UDP-sulfoquinovose synthase
MEMGHLITNWSFQTFSRSPNYWRNIGQLQNSKSSNLALKSWSRRRKEAYGTWASAAGQGQTQTPLTGRQQAYEHSSSKPKKGMVIGGDGYWGGATALHLSNQGYEGWSG

SEQ ID NO: 33377 - DNA, 743 bp, Zea mays
  misc_feature: Ceres CLONE 1411036-F
  misc_feature: Encodes the peptide sequence at SEQ ID NO. 33378
aaagctggagctccccgcggtggcggccgctctagaactagtggatcccccgggctgcaggaattcgcacgagaccattacctagaacatcctaatcgaaaagagcaacccggcgaaagccccccaaaccctcgcaccctaaaacagcggcgcacaagatgtccgacgaccccaccaacggcggcggcggtgatcgcgtggaggacgtcgtccgcaccgagggtgaaacacaacctcgtgatgatggcttgtcgaaatccaaggatagggacaaagatagagaaaaggacaaggacagagatcgtcgcagagaccgtgacagagatcgagggagagacagggaccgtgatagggacagggacagggatcgggacagagacaagaatcgccaaagtaggcatcaccgtgaaagacgggaacagcgagaccgtcctgatgatcacagagtccgtgattctgaaagaagaagagaacgcgacaaagatgggcatcgtaggcatcgttctcggtctcgttcaaggggtagagatcgaagatctaggtcacgttcaagaagcaagcgagttagtggattcgatgcgccacccccgcaagcaatgggttcaacatttccagttattccaaccccaagtcagtaccaggctcttcgcttcctaacattggtggcatgtttccaaaatgctcccctttcggtgttgctgggcagccacaagcaatggactcacaggctactcgtcatgctc

SEQ ID NO: 33378 - protein, 195 aa, Zea mays
  misc_feature: Ceres CLONE 1411036-F
MSDDPTNGGGGDRVEDVVRTEGETQPRDDGLSKSKDRDKDREKDKDRDRRRDRDRDRGRDRDRDRDRDRDRDRDKNRQSRHHRERREQRDRPDDHRVRDSERRRERDKDGHRRHRSRSRSRGRDRRSRSRSRSKRVSGFDAPPPQAMGSTFPVIPTPSQYQALRFLTLVACFQNAPLSVLLGSHKQWTHRLLVML

SEQ ID NO: 33379 - DNA, 698 bp, Zea mays
  misc_feature: Ceres CLONE 1411047-F
  misc_feature: Encodes the peptide sequence at SEQ ID NO. 33380
agagctggagctccccgcggtggcggccgctctagaactagtggatcccccgggctgcaggaattcgcacgagaccattacctagaacatcctaatcgaaaagtcggaagctcccttcatttctttcacctccgattcgattccttgtcccctcttgatccgagccgccaccaaaccctaactatctaaaacccccgtctcgctgtccgatggccgccgcctcgccgccgccctccccaccccacgcaaagcgccccaagatgtcctcctcctccgacccggaagccgatgctgagcccacctcggcctccgccgccgttgagggcgccgatcctgcgcagcgtcgtcccaggtacaagcgccgcaaggtcgccatccttctcgggtactgcggcgcggggtatcagggcatgcagaagaatccgggcgcgcgcaccatcgagggggacctcgaggaggcgctctaccaggcgggcgccgtgcccgaggccgaccggtccgcgccgcgccgttacgattgggcacgtgctgcgcgcaccgacaagggcgtcagcgccgcggcgcaggtggtgcccgggcgcttctaacgtgacccggcggggtttcatcaatcctttgaacgcgaatttccgccccaaaatcccggccctaaggttatgggggggttccactcttttcaccaaaaaattccgccccgc

SEQ ID NO: 33380 - protein, 125 aa, Zea mays
  misc_feature: Ceres CLONE 1411047-F
  misc_feature: SWISSPROT Homolog: EC 5.4.99.12 tRNA-pseudouridine synthase I
MAAASPPPSPPHAKRPKMSSSSDPEADAEPTSASAAVEGADPAQRRPRYKRRKVAILLGYCGAGYQGMQKNPGARTIEGDLEEALYQAGAVPEADRSAPRRYDWARAARTDKGVSAAAQVVPGRF

SEQ ID NO: 33381 - DNA, 775 bp, Zea mays
  misc_feature: Ceres CLONE 1411053-F
  misc_feature: Encodes the peptide sequence at SEQ ID NO. 33382
  misc_feature (1)..(1): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (28)..(28): n is a, c, t, g, unknown, or other
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (38)..(38): n is a, c, t, g, unknown, or other
  misc_feature (775)..(775): n is a, c, t, g, unknown, or other
ntttcccccccccccccccccccnnncnttnntnnggngggggggcccgcgcagagctggagctccccgcggtggcggccgctctagaactagtggatcccccgggctgcaggaattcgcacgagaccattacctagaacatcctaatcgaaaaaccggacagaaaagcgccactaaaaccctagccatccgccatgtccacctccccagccgcctcatcctccgctccgaccgccttcgccgcctctgcggttactatggctgccgaggccgccgacgggccggtactcagcgtagtatcgaagcgtctccgcgcgctgcggaagaagtacaatcgtatcacgcagatggaggagtcgctcgccgccggcaagtcgctcaaccgagagcaggaggaggttctccgctccaagcccgtcgtcgctgctctgatcgacgagctcgagcgcctccgccccccgctcgcatcagctctcgcggaggagctctccccccggctctgcccccgccccggctcccgcccccgccgccaccgattcctcctccgacccaaattcgtcaggcccaggaccctcctcgcggctcggactacttttggctcccctctttcgaatgtcaaaggaaaaaaaagcggactttccgtcttcctttggggaataaccccggcgggggaggcgtccggagcggggaagaacaggctgggcccctcaacttttatggggaccaagccgttccggggggggaagttgatacccccggagaaagaaacacaggn

SEQ ID NO: 33382 - protein, 193 aa, Zea mays
  misc_feature: Ceres CLONE 1411053-F
MSTSPAASSSAPTAFAASAVTMAAEAADGPVLSVVSKRLRALRKKYNRITQMEESLAAGKSLNREQEEVLRSKPVVAALIDELERLRPPLASALAEELSPRLCPRPGSRPRRHRFLLRPKFVRPRTLLAARTTFGSPLSNVKGKKSGLSVFLWGITPAGEASGAGKNRLGPSTFMGTKPFRGGKLIPPEKETQ

SEQ ID NO: 33383 - DNA, 692 bp, Zea mays
  misc_feature: Ceres CLONE 1411054-F
aaagctggagctccccgcggtggcggccgctctagaactagtggatcccccgggctgcaggaattcgcacgagaccattacctagaacatcctaatcgaaaaacacaatacgcacacttcgcaaagcgtcttcctccgaccccatcgcctctgtggcttcctggctgtctgactgcatctgcctggtcgtacgcgagcgcgtgcgtcccttcaccgtcacgagcggagcacaccgtcaccgccacgctccggcgccttcctgaaaatctaaaccccagcggatccggccacgggcagtcagccctcacacggactccgacgcgctgcccgctcgcctgccaaacccccatcccctcgccggcgatgctgccgcgctcttatagcaaccacccgggctcctcctcacccctaccgttcatcgtcgtctgcgacctgctcctcactgccaccgaatcattttcccccgtcgctgtcgacgaggactctgtctgcccaccaattctgcgtcatgtctgtcataacgcttgtaggaatttttcctgttgtcgcggtgaacgcacaggagcttcatccaatgtttgatcacgacggatgtcgcaaaccaaacgtcctttctctacttggcccttaggtctgcggcgatctgctcgacgggagattaccggtaccatggaaaatgagtcaccggattc

SEQ ID NO: 33384 - DNA, 736 bp, Zea mays
  misc_feature: Ceres CLONE 1411055-F
  misc_feature: Encodes the peptide sequence at SEQ ID NO. 33385
agagctggagctccccgcggtggcggccgctctagtaactagtggatcccccgggctgcaggaattcgcacgagaccattacctagaacatcctaatcgaaaaacccgacccgcctccaactccaagccaagccgccatggcggctccgcccgcgaccaccgccacgactcaccaccgcgcgctcctcccgcccacgcgcacccacgccgccgctacgcactccgcgctccgcctcccgctccgcgcgcatccccacgcccacgcccagcgcgcgcgcctcaccgccgccgctgccccggcccccgcggcgtcgacggcctccctcgagtcctccgccgcggggaagcctacggtgctcgtggccgagaagctcggcgccgcggggcttgcgctgctgcgggaattcgccaacgacgactgctcctacggcctctcccccgaggacctccgcgccaagatctcgctctgcgacgcgctcatcgtcaggtccgggaccaaggtcggccgcgacgtcttcgaggcgtccgggggcaggatccgcgtcgtcggccgcgccggcgtcggcatcgacaacgtcaaccttgccgccgccaccgagcacggatgcctcgtcgtcaacgcgcccactggcaacaccgtcgccggccgccgagcatgggatcgccgctgctccccgccatggccaggaacatcacgcaagggagacgcgtccctcaaggcctgcaaaaaggcaac

SEQ ID NO: 33385 - protein, 199 aa, Zea mays
  misc_feature: Ceres CLONE 1411055-F
  misc_feature (73)..(199): Pfam Name: 2-Hacid_dh Pfam Description: D-isomer specific 2-hydroxyacid dehydrogenase, catalytic domain
  misc_feature: SWISSPROT Homolog: EC 1.1.1.95 Phosphoglycerate dehydrogenase
MAAPPATTATTHHRALLPPTRTHAAATHSALRLPLRAHPHAHAQRARLTAAAAPAPAASTASLESSAAGKPTVLVAEKLGAAGLALLREFANDDCSYGLSPEDLRAKISLCDALIVRSGTKVGRDVFEASGGRIRVVGRAGVGIDNVNLAAATEHGCLVVNAPTGNTVAGRRAWDRRCSPPWPGTSRKGDASLKACKKA

SEQ ID NO: 33386 - DNA, 690 bp, Zea mays
  misc_feature: Ceres CLONE 1411057-F
  misc_feature: Encodes the peptide sequence at SEQ ID NO. 33387
agagctggagctccccgcggtggcggccgctctagaactagtggatcccccgggctgcaggaattcgcacgagaccattacctagaacatcctaatcgaaaaatctctctcgatttctctagccatgacgctggtgaggatgccttgccgcctctgctgcttcctgctcgtcgtcgccgcctccgccgtctccgggcgggggcgggtggacaccaccctcccgggctacgagggccgcctccccttccacctcgaaacaggggatgcggaggtggacgaggacgccggcgcggagctcttctactacttcgtccggcccgagtccggcgccgacgacagcgacaccccgatcgtcctccggatccccagcggtcaaggctggtccgccttcagaggcctcgcctacgagataggtcccatcatgttcgtcgcggagccctacaacggcggcttgccgcgcctgcgctacaacccaaactcgtgtagaaaggtggagcatattctttttgcggattcgccagctggcgtgcgggttttccttctccatagatgccaaaggctaccaccctggagcgggatcaaccacggctcagcgggggggaggtcctcaacaagggggtgggacgaccaaacctgaggtagcatggaaaatcctttgcgacatcccatggaagaatccaacggctgggg

SEQ ID NO: 33387 - protein, 170 aa, Zea mays
  misc_feature: Ceres CLONE 1411057-F
  misc_feature: SWISSPROT Homolog: EC 2.3.1.91 Sinapoylglucose--choline O-sinapoyltransferase
MTLVRMPCRLCCFLLVVAASAVSGRGRVDTTLPGYEGRLPFHLETGDAEVDEDAGAELFYYFVRPESGADDSDTPIVLRIPSGQGWSAFRGLAYEIGPIMFVAEPYNGGLPRLRYNPNSCRKVEHILFADSPAGVRVFLLHRCQRLPPWSGINHGSAGGRSSTRGWDDQT

SEQ ID NO: 33388 - DNA, 703 bp, Zea mays
  misc_feature: Ceres CLONE 1411058-F
  misc_feature: Encodes the peptide sequence at SEQ ID NO. 33389
agaagtggagctccccgcggtggcggccgctctagaactagtggatcccccgggctgcaggaattcgcacgagaccattacctagaacatcctaatcgaaaaaaaaccgaaaaggaggacaaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgatctccggcgaggtgccggacgagccggtcgtgtcgaagaagtcggggctactcttcgagcggcggctcatcgagcgctacattgaggaccatggcaagtgtcccgccaccaaggaggacctcaccatggatgatatcgtgccggtcaagaccaacacgatcgtgaagcccaggcctttgcaggctgcaagcattccaggactccttgggatttttcagaacgagtgggatgctctcatgctttctaattttgctttggagcagcagcttcacacagcaagacaagaacttagtcatgcactctaccagcatgacgctgcctggcgtggttattgcccgatttaggaaaggaaagaattgccctttaacccttttggtcaatggaaaaacaattcc

SEQ ID NO: 33389 - protein, 118 aa, Zea mays
  misc_feature: Ceres CLONE 1411058-F
  misc_feature (64)..(113): Pfam Name: Prp19 Pfam Description: Prp19/Pso4-like
MICAISGEVPDEPVVSKKSGLLFERRLIERYIEDHGKCPATKEDLTMDDIVPVKTNTIVKPRPLQAASIPGLLGIFQNEWDALMLSNFALEQQLHTARQELSHALYQHDAAWRGYCPI

SEQ ID NO: 33390 - DNA, 827 bp, Zea mays
  misc_feature: Ceres CLONE 1411068-R
tgggggggcgggcctccgtctccacgacacaccatccccacaattcttccctcgattgagtaccgggccccccctcgaggtcgacggtatcgataagcttttttttttttttttttcagagcttgcacatttttatttttttaccatgtccctgcaaattacagatcaatatctacacatattaccatggttcaatccatcagctatttatagttttaccataccctgcaaattacagatcaacatcagcgcatgtcctaacatggtaccataaagctcgccacacaatcatttacattggggggtggggggttgcaaacttgcaacgatcgatgcgccgaaatgtagaaatgtgaccactaataccctatagcggttgtttgtagggtgttcgtgatgatccctccaatatctgaagcctctgcccccccaccgcaaaattaaaaccttcgttgaatgaatattttaaaccccccccccacatgctattaaaagcaatctcggaccatatggggaaaaaaagaaaacccgcccaaaaacctttttttttcgcaattaataaaatcaacctacggggggcgcctaaaaaaaatccgaaccacttttccattggggagaacacacccagaaaacacaaatgctgcaaacatatggacccttttcttcctctcggttggcccgctgccccgcctattgtctgcctccgtaaatccccaccaacaaaacatccccccttacaacacaccctccaccacttatttgcatttgaatgcaccaacgaggtggcttttcacgatcattaccatatacacctcgccgcactcaaa

SEQ ID NO: 33391 - DNA, 726 bp, Zea mays
  misc_feature: Ceres CLONE 1411068-F
  misc_feature: Encodes the peptide sequence at SEQ ID NO. 33392
  misc_feature (726)..(726): n is a, c, t, g, unknown, or other
aaagctggagctccccgcggtggcggccgctctagaactagtggatcccccgggctgcaggaattcgcacgagaccattacctagaacatcctaatcaaaaactctgttctcgattctcccgcctcgtgctcgccgttccgcgcttcttccctacccagtcctacatcacctccccgtccgtctttggcccgcaaccggcggccctcgccgctgatggactcccactcctccccctcggcggcaccgccggcagctgctgaaaatgcgcggtacacatacagcccgaggctgcggtggcagccggaagttgaggagtacttcaacacggcgtacggccgcgaccactttgcccgcatctctgaggccctggcgcatccgtcttgttattcttgtatccgtgtcaatactctgaagtcttccactgatgctgtcatgcataaactgctggatttagtatgcaaaaatgagctctctgctgtaatcaatggattggaggttgttgagctgaatggtggagaccaatcacaagaagggtgctctctggtccacaagtgcccctatgccggccttgaaaatgttttgtttgttcagggatcaggaccacatgtgctgcattatggtagccaaccagatcaagctggttaagaaagtaagtgaaagtcgaaaatgtgcagagccagttccttcggggggccaagttgattgtccctggtgttttagcatgn

SEQ ID NO: 33392 - protein, 143 aa, Zea mays
  misc_feature: Ceres CLONE 1411068-F
MDSHSSPSAAPPAAAENARYTYSPRLRWQPEVEEYFNTAYGRDHFARISEALAHPSCYSCIRVNTLKSSTDAVMHKLLDLVCKNELSAVINGLEVVELNGGDQSQEGCSLVHKCPYAGLENVLFVQGSGPHVLHYGSQPDQAG

SEQ ID NO: 33393 - DNA, 675 bp, Zea mays
  misc_feature: Ceres CLONE 1411069-F
  misc_feature: Translation starting site: 168
  misc_feature (491)..(491): n is a, c, t, g, unknown, or other
agagctggagctccccgcggtggcggccgctctagaactagtggatcccccgggctgcaggaattcgcacgagaccattacctagaacatcctaatcgaaaacctcactctgtctcttcctcagtcccggcatcagcgctcaaaccctaacacgccacgcgatcccgatgcgcaggggtctgggcagcgaggcatcgttgcgccggcggcgcgggccggcgcggctttgggtggcagtggcggcgctggtggtcggcaccgtgtgcctcttctcctcctcttcggtcgggctgttgggcgcctcttacagggtccaggatgttgatgtaaataagttgtggagaactgcagattcaaatggttggagagcatcttctgcacggcgcacctactggcctcccccaccaactgaatctgagagcaatggctacttgcgcgtccggtgcaatggtggcttgaaccaacacgtagtgcaatatgtaatgctgttngtgctgcacggatcatgaatgctacactggtggtgccaaaattagacacaaattcatcctggcatgatgaaagtgctttgtaggtatttatggatgtcccccactcatccagacctgaaatatgaccgtccgatttgtatgagcatccctgaatcactacaagtggaagaccaggagctcagag

SEQ ID NO: 33394 - DNA, 729 bp, Zea mays
  misc_feature: Ceres CLONE 1411070-F
  misc_feature: Encodes the peptide sequence at SEQ ID NO. 33395
  misc_feature (27)..(27): n is a, c, t, g, unknown, or other
  misc_feature (729)..(729): n is a, c, t, g, unknown, or other
aaagctggagctccccgtggtggcggncgctctcaacctcaactatcccccgggctgcaggatttcccacgagaccattacctagaacatccgaatcgaaaaatcgcagaaattctccgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaaggccaaggcggagaagcggctacctgcgggcaagtccgccggcaaggagggcggcgacaagaaggggaggaagaaggcgaagaagagcgtggagacctacaagatctacatcttcaaggtctccgttctcccccaattcgccttcacctcgccgcttcctccttgaccgccaccgttgacgtcgtcttccggcgaggtagctcgccggaagacctcacctggacttttccgacgcaccctccacacactctttaaccctccggaatggccgcctgcttctagctcgtcgacgccccaatctccgcttgcttcctcgacagccccatccgcctcttctcgctctcgctacggctcctctgcctgttcgccatggcgatccgcatcaccgtctcctactccggctacgtggcgcagaacctcgccgcgtcgctcggccacgn

SEQ ID NO: 33395 - protein, 88 aa, Zea mays; identical to SEQ ID NO: 7324
  misc_feature: Ceres CLONE 1411070-F

SEQ ID NO: 33396 - DNA, 605 bp, Zea mays
  misc_feature: Ceres CLONE 1411078-F
  misc_feature: Encodes the peptide sequence at SEQ ID NO. 33397
tgccggatacccacgacaccattacctagaacatctaatcgaaaactcgaaccctctcgcgcttggcttgctttcactctccagggccccactcccacctcgccgccgcagccatggggatcacagcgccaactcccgacatcctcggcgagcgccagtccggccaggacgtccgcacgcagaacgtgatggcttgcggggcggtggccaacatcgtcaaatcctcgctcggccccgttggtctcgacaagatgctagtggacgatattggtgatgttacaatcactaatgatggagcaaccatacttaacatgttggaaggggggggtgcagccgccaaggttcttgttgagttggctgagctccaagatcgtgaggtaggagatggaactacttccgttgtcatcatagcggcagagttactcaagagaggcaatgatcttgtgaagaataagatccatccaacctctataatcagtggctacaggcttgctatgcgtgaagcctgcaaatatgttgagggaaagttagcagtcagggttgacaaactgggaaaagaatcccttatcaactctgcaaaactagcatgtcttcgaaattgataa

SEQ ID NO: 33397 - protein, 162 aa, Zea mays
  misc_feature: Ceres CLONE 1411078-F
MGITAPTPDILGERQSGQDVRTQNVMACGAVANIVKSSLGPVGLDKMLVDDIGDVTITNDGATILNMLEGGGAAAKVLVELAELQDREVGDGTTSVVIIAAELLKRGNDLVKNKIHPTSIISGYRLAMREACKYVEGKLAVRVDKLGKESLINSAKLACLRN

SEQ ID NO: 33398 - DNA, 702 bp, Zea mays
  misc_feature: Ceres CLONE 1411088-F
  misc_feature: Encodes the peptide sequence at SEQ ID NO. 33399
  misc_feature (232)..(232): n is a, c, t, g, unknown, or other
aaagctggagctccccgcggtggcggccgctctagaactagtggatcccccgggctgcaggaattcgcacgagaccattacctgaacatcctaatcgaaaaacgaaatggttttgccttcgcttttgcttatgcgtacgcgcggcgaatcacggcgcccaccttccaaccggacttgagtcacttgactccgccgcgggattccccgccagatctcattctcgccccaaccnctaaccgccgacggtggccatgatggccaccgagcccttgtccccggggaatctcgtcgaggacgtcgaaacactacccctggactcctcctccactctcgcggctacgacggacccgctgctccgcccacctcccccctcgtccaccttctctcccaccgccggtgagaaccatggcgcttttctggacgaggaggatgaggacggtggtggatgacttcacgcctccgctggctccccatgccgctacggcccgcgacgaagtcccgcgaggcggtcaccggtggtttcgctgagaacactgtcccctgagcctaggaagcacgcggagcccgagaaccgggacccgtgggcgccctttcccgggtcgagccagctaaggcctcctacctgatcggcaactcgaggggccccgagcggtgtggcaattcccgcgtgcggccctcccatgcccaggcgcgcgcgcctgg

SEQ ID NO: 33399 - protein, 65 aa, Zea mays
  misc_feature: Ceres CLONE 1411088-F
MMATEPLSPGNLVEDVETLPLDSSSTLAATTDPLLRPPPPSSTFSPTAGENHGAFLDEEDEDGGG

SEQ ID NO: 33400 - DNA, 636 bp, Zea mays
  misc_feature: Ceres CLONE 1411091-F
  misc_feature: Encodes the peptide sequence at SEQ ID NO. 33401
tcagaactagtggatcccccgggctgcaggaattcgcacgagaccattacctagaacatcctaatcgaaaaacactcgtccactcaccccctctttgctctgcctcgccgcgccgcagagcagagcatggcgcccccacgccctctcctcgccgccgtcttcctcgccgcggcggttctgctcctcctttctccggcagaggcggggacggtgggcgtgaactacggccgcgtggcgaacaacctgcccaacccagcggcggttgtgcagctgctcaagcagcagggcgtcgcgcaggtgaagctgtacgacgccgaccccaccgtgctgcgcgccctcgcgaacaccggcatcaaggtggtggtggcgctgcccaacgagcaggtcgcggcggcggcgtcgcgcgcgtcctacgcgctgctgtgggtgcgccggaacgtggcggcgtaccacccggccacgcagatccagggcatcgccgtgggcaacgaggtgttcgcgtcggccaagaacgtgacgggcgcaagctggtcccgggcatggccaacgtgcaacgccgcgctgggcagctccggcctccgaccggggcccgccaaggggggccgtccgcccatcggcgctcaccgggggctcggg

SEQ ID NO: 33401 - protein, 170 aa, Zea mays
  misc_feature: Ceres CLONE 1411091-F
  misc_feature (29)..(165): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
MAPPRPLLAAVFLAAAVLLLLSPAEAGTVGVNYGRVANNLPNPAAVVQLLKQQGVAQVKLYDADPTVLRALANTGIKVVVALPNEQVAAAASRASYALLWVRRNVAAYHPATQIQGIAVGNEVFASAKNVTGASWSRAWPTCNAALGSSGLRPGPAKGGRPPIGAHRGLG

SEQ ID NO: 33402 - DNA, 688 bp, Zea mays
  misc_feature: Ceres CLONE 1411096-F
  misc_feature: Translation starting site: 148
  misc_feature: SWISSPROT Homolog: EC 2.5.1.18 Glutathione transferase
  misc_feature (547)..(547): n is a, c, t, g, unknown, or other
aaagctggagctccccgcggtggcggccgctctagaactagtggatcccccgggctgcaggaattcgcacgagaccattacctagaacatcctaatcaaaaaacttctctctttgtctgcgcttccaacgcaggaggcgttgcggccatggcggcttcgaagcccatcttgtatagcgcgtggatcagctcctgctccttccgagtccggatcgccctcaacctcaaaggtgtggattatgagtacagggctgtgacaaggaacgatctagattacgaaaagatcaatccaatcaagtatgttccagcattggttgatggggattttgttgtttctgactccctggcaatcatattgtatcttgaagataaatatcctcaacaccctcttttgcctcaagatctcaaaaagaaagctataaatctgcagattgcaaatatagtttgttcaagcattcaacctcttcaatgttatgctgtaattggtctgcttgatggcaccttaggctctaaccagagccttcagattgttcggaattacaccgacnagggatttaaagcaatcgaaaaacttctgggaaggttgtgacagtaaatatgctactgggagacgaagtccaactggatgtgtttcttgcgccccagatgtatgcaggcgtgacgcgcttcgggattgatatgtcacatac

SEQ ID NO: 33403 - DNA, 803 bp, Zea mays
  misc_feature: Ceres CLONE 1411100-F
  misc_feature: Encodes the peptide sequence at SEQ ID NO. 33404
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (26)..(26): n is a, c, t, g, unknown, or other
  misc_feature (27)..(27): n is a, c, t, g, unknown, or other
  misc_feature (29)..(29): n is a, c, t, g, unknown, or other
nnnnnnttttnnnnnnnggggatttnntntggggcctacttcccccggcaagctggggctccaccgcggtggcggccgctctagaactagtggatcccccgggctgcaggaattcgcacgagaccattacctagaacatcctaatcaaaaaaaaaacgcattccgcagacgcgcggcgagggagtaggaggggacggcgggtgccgaggcccgcaggcacggggaagctacctgcttgcgtagccgggcgggctcgcgctgtgctgtcgctccatgtcggtcgccggcgagagcggcggggatccggcggcggcacgccgccggtgggatctctccaacaagggccccgacagcactccaatgttgaaagaggctgtggaaatgtctacagatgaagaatcggatggcgctgttatatgcccatccgggaggggaacaactgatggatgtgacgaagccattagtggcagtcatgatgatgatagccccagaaggcgaggaaaagctagtccatcaaggacccgtggatggagaaggggacaccacaggaaggaccagtggggtaaactcaggagtccacctggaaggctggagttgagccaagaagacgtgcggctcccccccaaggcccccaggggaagcgccgcgcactggcgagttcctgcacccaaagacaggcttagaggcggggtggggcaccccgagaccattgggggggcctttccggacgtcgaagggagagtgtccttcctggggaggaaaaaatggcgggggcggtgggaggcggaatgcccagtcggccg

SEQ ID NO: 33404 - protein, 176 aa, Zea mays
  misc_feature: Ceres CLONE 1411100-F
MSVAGESGGDPAAARRRWDLSNKGPDSTPMLKEAVEMSTDEESDGAVICPSGRGTTDGCDEAISGSHDDDSPRRRGKASPSRTRGWRRGHHRKDQWGKLRSPPGRLELSQEDVRLPPKAPRGSAAHWRVPAPKDRLRGGVGHPETIGGAFPDVEGRVSFLGRKKWRGRWEAECPVG

SEQ ID NO: 33405 - DNA, 664 bp, Zea mays
  misc_feature: Ceres CLONE 1411101-F
  misc_feature (277)..(277): n is a, c, t, g, unknown, or other
  misc_feature (449)..(449): n is a, c, t, g, unknown, or other
  misc_feature (504)..(504): n is a, c, t, g, unknown, or other
  misc_feature (549)..(549): n is a, c, t, g, unknown, or other
aaagctggagctccccgcggtggcggccgctctagaactagtggatcccccgggctgcaggaattcgcacgagaccattacctagaacatcctaatcgaaaaatcacacactaatcaacaagcaggaccagctagctagctcctctcactgctatcacccgcccagccatctcgctgaaagagaaaagcgcagccatgaagactactagctcgggcattgcagtcgtcctactggtggccatgctggcagtccattccgcgttggccgacatctcgntgctccgacgtgctcaacgacctgtcgccgtgcctgcccttcctgcagggcaaggcagccaaacccagcgagagcaacaaccagtggctgcgacggcgtgagggccctggtacgcggcggcggacaccaggcccgacaggcagccccacgtgccggttcctcaaggcggccntacgttcgggtccacgctgtgctctccgcggcgcaggagctgcccggcgactggnccctctcgctgtcctacaacatcacccccgacatcgactgcgacnagatcgaagaaagggatactgttcccttaccagaaccatacgacggggatgggggatgttccgtgccctgctagcagtaggctgcatctgcactgagtgactaaaataaaggatt

SEQ ID NO: 33406 - DNA, 660 bp, Zea mays
  misc_feature: Ceres CLONE 1411104-F
gctctagaactagtggatcccccgggctgcaggaattcgcacgagaccattacctagaacatcctaatcgaggagacgagaaaaccccacagacctgcacctcggggacgccgaggcgcagggatggagagccaccccctacagtggtttctcccccgctccgatccccggggcatgaccgggtcggctggcctatgcgtcgcagcaggagatgtcgtcgattgcccctgcctgccccaattaatcccgcccggtcggaatccagtattacaggggccgatatcctgtcccgtcctggcctgtgtattatcgacggaggcgccgtataccacggcagagaaggaagacaaggaggggcgccgaaactaacttgcttgtgacggcccaaggacgagatgcgagggcagacgagtcggtacccgaaactctacgcgagattgcaagtgcaggttcccacaatataagtatacccgatggatcctggaggttcctcgaaagaaaagacataaatctgttagaaatggtgacatcatcaggcaatctacctggatgttattaaagaacaaaattctctgctggtttggccataaaaagaagcgtgtaagaacatggcctcttgacaaaggaaaatggggggccacatgggcccttcaatgactg

SEQ ID NO: 33407 - DNA, 692 bp, Zea mays
  misc_feature: Ceres CLONE 1411108-F
  misc_feature: Encodes the peptide sequence at SEQ ID NO. 33408
  misc_feature (321)..(321): n is a, c, t, g, unknown, or other
  misc_feature (329)..(329): n is a, c, t, g, unknown, or other
  misc_feature (528)..(528): n is a, c, t, g, unknown, or other
aaagctggagctccccgcggtggcggccgctctagaactagtggatcccccgggctgcaggaattcgcacgagaccattacctagaacatcctaatcgaaaaattcaatccggccgggccgcgcgcacgcgcaccaccggcacgcacatcaaatctcagccttcacccctctcacactgtcttcactcggttcgagcaaggggggcagcgagcgaagcggtaggtagcagcagtgtacgtgctgccgccaagctagtgccaatggcgagggcggtggcgatgctcgtggccctggcgctggtcgtggtggtggcggtggcnagcgcggncggggcgccggcgcaacagtgcagcgcggcgcagctggcggcgtgcgccccggcgatcatcagcgggtcgccgcccacggcgtcgtgctgctccaacctgcgcgcgcaggagccgtgcttctgccagtacgcgcgcaacccggcgtacagcagctacatcaaacagcccaacgcccgccggacgctcgcctcctggggnatcgccggccccgagctgctaggcgctatagctccccggtgggggggggggataaaaagatgcatgcatggcgatctgggcctactggtatcggtttgcgcctcggggggaaatatgaacaatatatatattaatttatcaaaaaaaaaaaaaaaaaaggctta

SEQ ID NO: 33408 - protein, 143 aa, Zea mays
  misc_feature: Ceres CLONE 1411108-F
  misc_feature (23)..(23): Xaa is any aa, unknown, or other
MARAVAMLVALALVVVVAVASAXGAPAQQCSAAQLAACAPAIISGSPPTASCCSNLRAQEPCFCQYARNPAYSSYIKQPNARRTLASWGIAGPELLGAIAPRWGGGIKRCMHGDLGLLVSVCASGGNMNNIYINLSKKKKKKA

SEQ ID NO: 33409 - DNA, 643 bp, Zea mays
  misc_feature: Ceres CLONE 1411109-F
  misc_feature: Encodes the peptide sequence at SEQ ID NO. 33410
  misc_feature (111)..(111): n is a, c, t, g, unknown, or other
  misc_feature (120)..(120): n is a, c, t, g, unknown, or other
  misc_feature (121)..(121): n is a, c, t, g, unknown, or other
  misc_feature (138)..(138): n is a, c, t, g, unknown, or other
  misc_feature (329)..(329): n is a, c, t, g, unknown, or other
agagctggagctccccgcggtggcggccgctctagaactagtggatcccccgggctgcaggaattcgcacgagaccattacctagaacatccctaatcaaaaaagcaaccnacttctgcnntctgcatcccgtctggngcctctgcatttgcttggctgctgctcccttctcccaccgaccaactcgatcccgcgccatggatcgcgccgaccccgcgcggggccgccttgccgtgctctcctcccacctccgtggtgcaggggccgaggaggcggcggggctggagaagtcgccggtatccgcgccggcgcccgggccccgcgccggngcgcttgccgtggtggacgggaggaccgggaagcggcacgaggtcaagggctgcggagacggcaccgtgcgcggcacccacttcagaaggattaccactggaaaggacaacaagggtctaaggaattatgatcctgggtaaccttaacacgggcccctgttcccttcgccattttggtaaattgaggggaaagggggggatcccttccctttggggggttacccaacccaaaaaattggctgaaaaaacacccccttttttggggggggcccacccttttaaggggggggggaaaatttccccccccccaagaa

SEQ ID NO: 33410 - protein, 90 aa, Zea mays
  misc_feature: Ceres CLONE 1411109-F
  misc_feature: SWISSPROT Homolog: EC 2.3.3.1 Citrate (Si)-synthase
MDRADPARGRLAVLSSHLRGAGAEEAAGLEKSPVSAPAPGPRAGALAVVDGRTGKRHEVKGCGDGTVRGTHFRRITTGKDNKGLRNYDPG

SEQ ID NO: 33411 - DNA, 748 bp, Zea mays
  misc_feature: Ceres CLONE 1411110-F
  misc_feature: Encodes the peptide sequence at SEQ ID NO. 33412
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
nnnnncccccccccccccccccccnnncnannnnnnnnnnnggggggggtttgggcaaagctggagctccaccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcggggtgccccgggagatggcagcggaggttgccgccgctgcggcgctccggtgccgacggggcggagctcccagggccggctgcctcaacggcttcaagccatgcagggacctggcccggggtttctcgcccaggcccggttcggtccccgttaatcgtgacctacaagggcccaaaattgggggaggggaaggcccagtaaccccagggcgaaaaaatagaacccaccggt

SEQ ID NO: 33412 - protein, 72 aa, Zea mays
  misc_feature: Ceres CLONE 1411110-F
MAAEVAAAAALRCRRGGAPRAGCLNGFKPCRDLARGFSPRPGSVPVNRDLQGPKIGGGEGPVTPGRKNRTHR

SEQ ID NO: 33413 - DNA, 629 bp, Zea mays
  misc_feature: Ceres CLONE 1411143-F
  misc_feature: Encodes the peptide sequence at SEQ ID NO. 33414
  misc_feature (548)..(548): n is a, c, t, g, unknown, or other
cacagctggagctccccgcggtggcggccgctctataactagtggatcccccgggctgcaggaattcgcacgagaccattacctagaacatcctaatcgaaaagtctcttttccagttccagacctgaagaaactccgaccggtggcggcaggatctgtgccgcgatggcgacgtcgaacaccgctcggatggaggacggcggcggtgacctgcggagcaccatcaagaagtggaacatcatctaccctgtctacctcaactccaagaagacggtcgccgagggccgccgcatcgccgctgccaaggcctgcccggaccccacctgcatcgagatcgctgactgctgttcgcacctcaagatcccccacgccatcgagttggataaggcgtaccctcgggatttcttccaggtggggagggtcagggtgcagcttaagaaagatgacggctcccccgtcaatcctgctattaaacaaagaagcagctgatgatccaagtagcagagctagttcccaagcatcacggaaggacaaagaaagcagagttncatttgaggaaaccctccatcctccactatgatttgcttctcttaggcttcctgacgttaatgtgtgggcctaatggtatc

SEQ ID NO: 33414 - protein, 107 aa, Zea mays; identical to SEQ ID NO: 24396
  misc_feature: Ceres CLONE 1411143-F
  misc_feature (24)..(108): Pfam Name: SRP19 Pfam Description: SRP19 protein

SEQ ID NO: 33415 - DNA, 641 bp, Zea mays
  misc_feature: Ceres CLONE 1411146-F
  misc_feature (22)..(22): n is a, c, t, g, unknown, or other
tcactttgtgactttcttaggnggcggccgctctagatactagtggatcccccgggctgcaggaatttgcacgagaccattacctagaacatcctaatcgaaaaccattcccagtcccaccaccacttgtctcaccgccgccatggcgtcctccaccgcggcctcgccgctcacctgccaccacctcggcagcgttggtgcccgccctcgcctcccgtccctctccatctccctccgccgccgctcgtcctcttcctctaagcccacctccctttcccactccctcccctccaagcactcgctggccccaccccccgccgcatccgcatcctcccgtcgcggtctcacccccgtacccgcctccgcctccgccgccgcggctccagcgccggatccagtgccggttccagcaccggctccagcgccggctccagcaccggccgccccgccgaagaagcccgcgctgcagggcgcgggcatcaagccgctcctgggctccatcgcgactggcgtcctcatctggctcatccccgcccccgccggggtggcccgcaacgcgtggcagctcctagccatcttcctctccaccatcgtcggcatcattaacccagccgctgcccctcggcgcgggcgcccctcct

SEQ ID NO: 33416 - DNA, 658 bp, Zea mays
  misc_feature: Ceres CLONE 1411148-F
tccatctgtagctcccctaggtggcggccgctcttttcctagtggatcccccgggctgcaggaattcccacgagaccattacctagaacatcctaatcgaaaagtccctgtccctccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcggccccgagccgtcgcgcggtcgcctccacatctcgtcgttcttcaaggtctttggcctccgccgttcttggacaggggcacaccactgtccaccggtgcccactacgcgaaatacgagtccctcgtgcggctccgtagggtggaagagatccatcaggcggtgagtgggaggggcggcgtccacacaaccggaggggaggggggcaatggcgggcgtggcaggcccactctggacgtggctcggcgccgcgtgcttatctgcggaatgcgaccctgaagaacaaaagcaaaaaccatttctgcccaggcggaaacccgcgctggggggcggtggtcatgcgtccgccaagggccgccgcccccgggggcggcggggttcccgggctgggcccggttctg

SEQ ID NO: 33417 - DNA, 1001 bp, Zea mays
  misc_feature: Ceres CLONE 1411149-R2
  misc_feature (386)..(386): n is a, c, t, g, unknown, or other
  misc_feature (944)..(944): n is a, c, t, g, unknown, or other
caattgggtaccgggccccccctcgaggtcgacggtatcgataagcttttttttttttttttttacaaggaaccatcctacttggaaataaataaaaaccccttgacctcaaaattaaaccaaaaggccaaaaggacatggccggttctccatgtcccctctctttcacgccctgcaaacaaaagggctacttggtcggaaaggtttttttttcagaagtagtagaaaacatgcaagtcttaatcatgcctaggtaaatatggtcatgacggtccaatccgcgggccccaacaacggcgggaaaaatatggatcttcttcaggcggccgccaccgcggtggagctccagcttttgttccctttagtgagggttaattaaagtcccncttggttgaatggaaaaaacccccgggggaaggaagcaggtggctgacgaaatgtgattcgtctgttaaaaatttgtttcggaatattaattccgccccgtgggtggagagtggataataaaatgttttgtgctctagagtaagggaggaaggggtccgcgacacaaaggattctcggcatgtaattagttcctaatggtttggattgggtgatacacaaaatccgaccatgggggtagatccgcgacattttgtctgtccgtggtagaagtggtttttgtgaaatttatgtgatttacggagtaataggaggatgttgtcgcgattgaatgtgcagtgggggggtgaggaccgatcgggacgttcaagtataaattgtggcggtgacttgcacgatttgacgatactagcacgcagtctaagaataaaaaagggaagtaaattattattaactcacgcgcatgtatgtgttccgcatgctaagagggaggtgcgggctcgctaccagcaagtaacaacgaatatatgtacgactgtatataatattcgtactcgagnatactggtcacattgtcatatcctagcgagtgcacatggagttggcggtagtgtggg

SEQ ID NO: 33418 - DNA, 636 bp, Zea mays
  misc_feature: Ceres CLONE 1411149-F
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
tggagctccccgcggtggcggccgctctagaactagtggatcccccgggctgcaggaattcgcacgagatcattacctaaaacatcctactcgaaaactcgatgatatacattgagactgactaccaacataatggggaaaatagtgtaccaacaatggcaggcaaaatattttgatatcttatgctccatggtctatctgacagcgctgataccgcaagcatattagacgaatgatcacgagctcctatacattaactatcttcccccctacctctcaccccaggagaattccgaatacgaaaaggacattctctctgcctaccagatcaagcacgtgatcctaacaggcatcttagctctatcacccttgttcctccaagaacagccagcccaattacagtaggtacatttggagcatttgttggcacatacatctaggtgaatgaactacaagaactagggctaggacaccttggtacctactctcatgaacagcaatttcttcaaatcaaccatccggctggaatgaactctgctgcttatttgcatgaataactaccaatcatatgagtagctgctgcctacccccaccaatttcttccattaaaccaattgtcaacattgtattgnnnng

SEQ ID NO: 33419 - DNA, 860 bp, Zea mays
  misc_feature: Ceres CLONE 1411149-R
  misc_feature: Translation starting site: 489
cgtcatggcaagtgataaagaccgcatgaactcaaaaataaaccaaacagccaaaaggacatggccggctctccatctcctctctctctctcacacacaaacacaaggacgacgtgcgcggagaggttttttattcagtagtagtagtagacatgcaagtcgtgatcatgcgtaggtagatatggtcatgacggtccgatccgcgggcgccgacgacggcgggatagatatggatcgtcttcaggcggccgccaccgcggtggagctccagcttttgttccctttagggagggggtaattatgctgccagttggttgaatggaagaaattgctgggggtaggcagcagctagctgactgaatggtagttgttgttgcaaataagcagcagagttcaatgcagccagttggttgaatggaagaaactgctgttgctgagagtaggcagcaaggtttcctagcacaagttgttgtagttgttgtgccttgatgttttgtgccaacaaatgcaccaaaggtaactgctgtaatagggctgacggttgttggaggaacaagggtgataaaggtaagatgcctgctgcgattgcctgttggatcctgtagggttgaagatttgggttttcacatacttgagacaccgctggtgagagtattgggggaagaaagggagctttaggagcttgtgagcattgtggggaaaatggttgcggtagccagccttggcgtaaagaccaaggagccttaagggagccaaaattcttttggcggcattgttgggtacactattggggctttccatggtggctgagagggctcaataaaagttggggaattttcccattaggatggtcctagggt

SEQ ID NO: 33420 - DNA, 687 bp, Zea mays
  misc_feature: Ceres CLONE 1411152-F
  misc_feature: Encodes the peptide sequence at SEQ ID NO. 33421
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (38)..(38): n is a, c, t, g, unknown, or other
  misc_feature (49)..(49): n is a, c, t, g, unknown, or other
  misc_feature (50)..(50): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (81)..(81): n is a, c, t, g, unknown, or other
  misc_feature (83)..(83): n is a, c, t, g, unknown, or other
  misc_feature (84)..(84): n is a, c, t, g, unknown, or other
nnnnnggggggggnnnccccccccgccccnccnncggngggggggcccnnttttnnnnnnnttnnnnnnnnnngggggggngnntcaagctggagctccccgcggtggcggccgctctagtatacaggatcccccgggctgcaggaatttgcacgagaccattacctagaacatcctaatcgaaaactctcgattcggaaaacctccaaccctagccgcgatccgacaacgcctccatccctagccgactgctgcaagcttcagagctcaagagtcagggcgccatggcgacagagacggagaccttcgcctttcaggctgagatcaaccagctgctctcactcatcatcaacaccttctattccaacaaggagatcttcctccgggagctcatttccaactcttccgatgcgttggacaaatcaggttcgagagcctcactgacaagagcaagctcgatgcgcagccggagctgttcatccacagtgtaccaggacaggggttcgaacactctctccatcatcgacagcggcatcggcatggacaaggccggacttgggcaacaccctcgggaccatcggcagggtcggggacaaggaggtcatggaaagcccttggtgcgggcggtgagggggccatgagtggggggggccgggggggggttctactcgggctaccctcgggggc

SEQ ID NO: 33421 - protein, 118 aa, Zea mays
  misc_feature: Ceres CLONE 1411152-F
MATETETFAFQAEINQLLSLIINTFYSNKEIFLRELISNSSDALDKSGSRASLTRASSMRSRSCSSTVYQDRGSNTLSIIDSGIGMDKAGLGQHPRDHRQGRGQGGHGKPLVRAVRGP

SEQ ID NO: 33422 - DNA, 653 bp, Zea mays
  misc_feature: Ceres CLONE 1411160-F
  misc_feature: Encodes the peptide sequence at SEQ ID NO. 33423
aagctggagctcaccgcggtggcggccgctctagaactagtggatcccccgggctgcaggaattcgcacgagaccattacctagaacatcctaatcgaaaaatatatgtaacttcattcttgcaacatcacaagcacacaggctttcacacccatcttgcattggctctccggctgctgttcttgcttcctcgctgcacacaaccaagcaaagtcacttttccaaggtaaagaagcatgcatccgagctgctctccactggcagtgcctccgggcttccggttccacccgacagacgaggagctcctctactactacctgaggaagaaggttgcctatgagcccatagatcttgatgtcataagggaggtggacctcaacaagcttgaaccatgggacctcaaagatcggtgcaggattgggacggcggagcctcaggacgagtggtatttcttcagccacaaggacaggaagtaccctacggggacgcgaaccaaccgggcgacgacggctgggttctggaaggcgaccggacgggacaaggccatcttcctcggcaacgctgggaggaggatcggcctgaggaagacgctggtgttttacactggcagggcaccccatggcaagaagacggactggatcatgcacgagtac

SEQ ID NO: 33423 - protein, 139 aa, Zea mays
  misc_feature: Ceres CLONE 1411160-F
  misc_feature (10)..(139): Pfam Name: NAM Pfam Description: No apical meristem (NAM) protein
MHPSCSPLAVPPGFRFHPTDEELLYYYLRKKVAYEPIDLDVIREVDLNKLEPWDLKDRCRIGTAEPQDEWYFFSHKDRKYPTGTRTNRATTAGFWKATGRDKAIFLGNAGRRIGLRKTLVFYTGRAPHGKKTDWIMHEY

SEQ ID NO: 33424 - DNA, 624 bp, Zea mays
  misc_feature: Ceres CLONE 1411167-F
  misc_feature: Encodes the peptide sequence at SEQ ID NO. 33425
  misc_feature (624)..(624): n is a, c, t, g, unknown, or other
aaactggagctccccgcggtggcggccgctctagtactagtggatcccccgggctgcaggaattcgcacgagaccattacctagaacatcctaatcgaaaaattcggatttccttccgccttccgacagcggctgtctcggcgacccaaccccagcctgaccccacctcccgccgccgccgccgccgccgccgcgccttcgtcgtcaggagaagggtcccggtggctgcgtctctctcccctgcccccctgctccacactcggttcacgcgtcggctcgctaccgcaggccctcgactcgtacgcccgtccccggcggcgatccggccggcaccgtaaccctaggactccgacggagcaggaatgatgagtcatgaacaacaaattgtccctcctagtaagggttctgtgaatgggttcccccatagaaaactggataagggagggcagtggaacgcaaaagtacaataaatttggtgaggtcatcctctcggtggttttactaattcagggcatggaagtcattcccgggaccgcctaatctatgttctaaccccaacttatttgggcatcatggtggacgtgcatgtgaaataaccggcttctaataatctcctggagattn

SEQ ID NO: 33425 - protein, 35 aa, Zea mays
  misc_feature: Ceres CLONE 1411167-F
MMSHEQQIVPPSKGSVNGFPHRKLDKGGQWNAKVQ

SEQ ID NO: 33426 - DNA, 644 bp, Zea mays
  misc_feature: Ceres CLONE 1411190-F
  misc_feature: Encodes the peptide sequence at SEQ ID NO. 33427
aagctggagctccccgcggtggcggccgctctagtactagtggatcccccgggctgcaggaattcgcacgagaccattacctagaacatcctaatcgaaaaatcatcagtcatcacataccaccaagaccacatcggcacatcgacgtgagctcgtgcgtgagtgccctggtcgacgaccgctcgcgcgccatggactcaacgacgacggcgccgctgctgcagccgtccgccgcctcgagcaaggaggggccggggccggcgccggctcagcacggtgagggcagccgggagctggaggcgatcctggccgacgcgtccaagccgtgggcttggcgggcctgggaaggcgcccgcctggagctgccgctgctgctgcgggtggcgctgccggcggtggccgtctacatgatcaacttcgtcatgtccatgtccacgcagatcttctgcggccagctcggcaacctcgagctcgccgcctcctcgctcggcaacaccggcatccagcccttggcctacggcctcatgctgggcatgggcagcgcggtggagaccctgtgcagggaggcgaacggggcgaacaggaacggatgctgggggtgtaccttgacggctcgacggtgctgctcatgggccccgccgtgc

SEQ ID NO: 33427 - protein, 151 aa, Zea mays
  misc_feature: Ceres CLONE 1411190-F
MDSTTTAPLLQPSAASSKEGPGPAPAQHGEGSRELEAILADASKPWAWRAWEGARLELPLLLRVALPAVAVYMINFVMSMSTQIFCGQLGNLELAASSLGNTGIQPLAYGLMLGMGSAVETLCREANGANRNGCWGCTLTARRCCSWAPPC

SEQ ID NO: 33428 - DNA, 658 bp, Zea mays
  misc_feature: Ceres CLONE 1411201-F
aagctggagctccccgcggtggcggccgctctagaactagtggatcccccgggctgcaggaattcgcacgagaccattacctagaacatcctaatcgaaaatcgtactcagacgcacatatctactatactatagtctaggaacttgggatagcacccgtcatggaagacaggatgcttgcattgctcgctctcctaactctttgtgcaagaagccactagcgcgaaccatatttcagggcacttgccaccaaccatgccattgcctaccatgaacccatgcaagcagaactgcatgatgtaacagggacttgacagcttgatggcgagtacctgcctgatgcagcagcaactgttgcccttaccgcttcatacgataacaagcgacgatgccacagatgatgtacgactaacatgatgtcatcattgatgatgtcgagcatgatgtcaccaatggtcttgccgaatatgatgtcacaatgatgatgccacaatgtccatgagactccgtctcacagattatgctgctgcagcaattaccattcatgatataccatagggccctgatcattccactaatgtgcttacagcaaacctttgtaggtggtgcattgtagatataactatctctgatgtatcgaccaatgacgtagaatgcc

SEQ ID NO: 33429 - DNA, 626 bp, Zea mays
  misc_feature: Ceres CLONE 1411205-F
  misc_feature: Encodes the peptide sequence at SEQ ID NO. 33430
  misc_feature (485)..(485): n is a, c, t, g, unknown, or other
  misc_feature (506)..(506): n is a, c, t, g, unknown, or other
  misc_feature (519)..(519): n is a, c, t, g, unknown, or other
  misc_feature (596)..(596): n is a, c, t, g, unknown, or other
  misc_feature (614)..(614): n is a, c, t, g, unknown, or other
  misc_feature (626)..(626): n is a, c, t, g, unknown, or other
aaagctggagctccccgcggtggcggccgctctagaactagtggatcccccgggctgcaggaattcgcacgagaccattacctagaacatcctaatcgaaaactgccttaaccattcctcccaacaccacctcgcctgcgatcttcgtagcctccgtcgcgtcgagcatcgatcatgtcggcctactgcggaaagtacaaggatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctgggcatcaggntgacaagggcaccattgaggntgttggcactgantaggagaccaccacccagggcatgacgacctttgcagcgttgcgccaagtactacgaggcaggtgcccgcctggccnagtggcgcgctgttctcnagatgggcctan

SEQ ID NO: 33430 - protein, 114 aa, Zea mays
  misc_feature: Ceres CLONE 1411205-F
  misc_feature (11)..(116): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (104)..(104): Xaa is any aa, unknown, or other
  misc_feature (111)..(111): Xaa is any aa, unknown, or other
MSAYCGKYKDELIKNAAYIGTPGKGILAADESTGTIGKRLSSINVENVEENRRALRELLFCCPGALQYISGVILFEETLYQKTKDGKPFVDVLKEGGVLPGHQXDKGTIEXVGT

SEQ ID NO: 33431 - DNA, 655 bp, Zea mays
  misc_feature: Ceres CLONE 1411223-F
  misc_feature: Encodes the peptide sequence at SEQ ID NO. 33432
  misc_feature (567)..(567): n is a, c, t, g, unknown, or other
aaagctggagctccccgcggtggcggccgctctataactagtggatcccccgggctgcaggaattcgcacgagaccattacctagaacatcctaatcgaaaaggttctcccaaagtctccggccaccgcccattcccgaaattcccaagcacgcatcgagatctcttgaggaccctgctcctcgcctttgacgtgaacaagccccagtctcagatcacaccaccaccatggggagcataccggtggccaacgtagccaacattgccagaatactgaatcttgtaagctatctgcgcgaggagatgcacatggatgtcgcgagggcgacgacgatggcgagcaatttctttgccgcgctgcaaatgttctccatcccagcaggcttccttgctgactcctacatcaagcgtttctacactgtcctcatctttggcccaattgaaatactgggctacatcctggtcgcgggccaagcacatgtcccatccctgaaccaaccaccgtgggtcccttggaccaagacacaagtacgtgggaagtccgtgaagcggattcgatccctgaagnctgctccctccctggggtctcctaccctgaatcccccatcggacaaatgggggccgagcctcggggaattgccctcccccgggcctcc

SEQ ID NO: 33432 - protein, 142 aa, Zea mays
  misc_feature: Ceres CLONE 1411223-F
  misc_feature (114)..(114): Xaa is any aa, unknown, or other
MGSIPVANVANIARILNLVSYLREEMHMDVARATTMASNFFAALQMFSIPAGFLADSYIKRFYTVLIFGPIEILGYILVAGQAHVPSLNQPPWVPWTKTQVRGKSVKRIRSLKXAPSLGSPTLNPPSDKWGPSLGELPSPGP

SEQ ID NO: 33433 - DNA, 625 bp, Zea mays
  misc_feature: Ceres CLONE 1411225-F
  misc_feature: Encodes the peptide sequence at SEQ ID NO. 33434
tggagctccccgcggtggcggccgctctagaactagtggatcccccgggctgcaggaattcgcacgagaccattacctagaacatcctaatcaaaaaattaatttccagggatgcacgcaggcaagtttaatttggaggatcaatggtagctagctagagctactagagacatacatggcggatcctctggtgcgagcgcgacccaaaaggaagaaggtcttagcggactacttggtgcgactccgatggattcctgccctcttcgtggcccttccaatatctgcgctgatctacctgagcgtcttcctggggaacacgtggtccgccatgaaatccgagaagcgtcgacagaaggaacaccaggagaacgtagagaggctgagagggtcgtgaagcgtctcaaggagagggatccgaagagggacggcctcgtctgcaccgcgaggaagccatgggtggtcgtgggcatgcgcaacgtggactacaagcgcgccagacgcttcgaggtcgacctctccgcgttgaggaacatcctcgagatcgacgcggagaggatggtcgccagggtggagtctctcgtcagcatggcccagataaccaaggctacctgccccatgaacctcc

SEQ ID NO: 33434 - protein, 126 aa, Zea mays
  misc_feature: Ceres CLONE 1411225-F
MDSCPLRGPSNICADLPERLPGEHVVRHEIREASTEGTPGERREAERVVKRLKERDPKRDGLVCTARKPWVVVGMRNVDYKRARRFEVDLSALRNILEIDAERMVARVESLVSMAQITKATCPMNL

SEQ ID NO: 33435 - DNA, 645 bp, Zea mays
  misc_feature: Ceres CLONE 1411245-F
  misc_feature: Translation starting site: 146
  misc_feature (645)..(645): n is a, c, t, g, unknown, or other
aagctggagctccccgcggtggcggccgctctatactagtggatcccccgggctgcaggaattcgcacgagaccattacctagaacatcctaatcgaaaaaaaggaaccagtcctcctccgtctccatcttatcatccgccgccaatgctgcgccgcaacccaacccgcatcgagctcacctcctccgaccgcgacgagctcgaagaccacctccgcgccgccgcggcgagctccaccaaggatccttccggttacaccactccgtctccagtccttggcccgcagacctccaatcccctgctccaattcctccacccgaagcccggcgccgcgccatccaagtcccaacgcatcggcatcggcctctccaccccgccggctccggccccgaacccgcgaccaccccatccacctcatagaggttgagatcaagctccgcctccccgacgccgccgcgcaccgccgcctgtccgcgttcctcgcgccccgcctccgccgcacccacgcccagcggaacctcttcttcgacgacgccgcgcgcacgctcggagccgccaccgccgcgctccgcgtccgcctctacgacgggcccgacgaccgcggtgcctcgcgcgccgtcctcgagctcaagcgccgcccgcggn

SEQ ID NO: 33436 - DNA, 647 bp, Zea mays
  misc_feature: Ceres CLONE 1411262-F
  misc_feature: Encodes the peptide sequence at SEQ ID NO. 33437
aagctggagctccccgcggtggcggccgctcttcaactagtggatcccccgggctgcaggtaattcgcacgagaccattacctagaacatcctaatcgaaaaaatccaatccaatccaatcccaccccgccccttccaagaactctagtatcaaccaaccgtccaacaaaagcaggagtcgcatccgaccccccgcatcagagacaggcagggagggaaccgagatccgtccgtccgtgtcgatggagtcaacggtggagcggataagctcgtcggagcagtcctgggtgaaggaccacgagctcgcagccatcggtgagtcagtctcagccagcgagcgaccttgttgcagatatccacaactgctgcttagtgttccgtttccggcgatgatcttctgctgaaactgaaactgaaaccgctagctgactgcctgtctatgtgtgcgcgcgcgcccagtaggcgtgtgggctgcggtggtgggcacttcggcggcgtacagtcggaggaaggcgccgcagcggggcacgggcctgcgcctcatccacgccaggatgcacgcgcaggcgctcacgctcgccgtcctcgggggcgccgccctcttccactactacggcgacggagggcgcaggaagagggccgacgac

SEQ ID NO: 33437 - protein, 31 aa, Zea mays
  misc_feature: Ceres CLONE 1411262-F
MHAQALTLAVLGGAALFHYYGDGGRRKRADD

SEQ ID NO: 33438 - DNA, 638 bp, Zea mays
  misc_feature: Ceres CLONE 1411263-F
  misc_feature: Encodes the peptide sequence at SEQ ID NO. 33439
  misc_feature (638)..(638): n is a, c, t, g, unknown, or other
aagctggagctccccgcggtggcggccgctctagaactagtggatcccccgggctgcaggaattcgcacgagaccattacctagaaaatcctaatcgaaaagctgcctgcctgtcagtcctgtctggtgtgtgcaccgcgcgtccgcgcccccgcctggctgccttcgtctcgcccagaacgcgtaggcgcagcatcaaactaggaagcaacacccagctgccccggcacaacccgtcctcttctactccagaggcacctcggcatccgccgaccggtttccgagaggtttgctggagtgcaccagcggtggggcagtaaatctgtaactgacacacgatgaatcaggaggcgaaggactcgaggccctcaaggtctcccagcgagccaaacctcttcctgcaatggggcagccggaagaggctgcgatgcgtcaaggcgcgtgacgatggctcgccatcgccgtctgaaggtcttagacgcgccataccccgtgctactaggcccctccttggagctgacattgcggcattccggcgccctagcacctttaaccgcaggaaatcagattcactagtgaacgagtacaggcactcgatggcgctatcgctggagaaaggacagttttacacaacgagn

SEQ ID NO: 33439 - protein, 99 aa, Zea mays
  misc_feature: Ceres CLONE 1411263-F
MNQEAKDSRPSRSPSEPNLFLQWGSRKRLRCVKARDDGSPSPSEGLRRAIPRATRPLLGADIAAFRRPSTFNRRKSDSLVNEYRHSMALSLEKGQFYTT

SEQ ID NO: 33440 - DNA, 668 bp, Zea mays
  misc_feature: Ceres CLONE 1411269-F
  misc_feature: SWISSPROT Homolog: EC 3.4.25.1 Proteasome endopeptidase complex
  misc_feature (366)..(366): n is a, c, t, g, unknown, or other
  misc_feature (386)..(386): n is a, c, t, g, unknown, or other
tggagctccccgcggtggcggccgctctagaactagtggatcccccgggctgcaggaattcgcacgagaccattacctagaacatcctaatcgaaaaacttcccgtgtttctaactccggtggctccaccaccagcaacccgtgcagagagaccaccccgaccactgccatgtctaggagcggtgactgggtctacgagaacaacggtggtacctgcgtggccatcgctggtgtcgataactgagtcgtcgcggcgtacacccgcctctctgtcgtatacagcatcctcacgcgcgaccactctgagatctgcgacctggctgacagatgtgtactagcatcttctggctgtcatgctgatataanggctctgcacatgaacctanctagcagagaattgctatacccacaccagataaacaaaggatgagctgccctgccatggaaaagtccccttccataccctgaattacaagcggtttcttccaaataaccccttcaatggggtccagggcctttaacgcccgagggaaaggggggggtttcccctaaagaggatcccgttccctcgggaaaaatttttattgggtttccaggaattgtttctttttgtatttgcccccccgggaacaaaaaaaaataaaccacaacccctttttgggcccccg

SEQ ID NO: 33441 - DNA, 635 bp, Zea mays
  misc_feature: Ceres CLONE 1411273-F
  misc_feature: Encodes the peptide sequence at SEQ ID NO. 33442
  misc_feature (337)..(337): n is a, c, t, g, unknown, or other
  misc_feature (377)..(377): n is a, c, t, g, unknown, or other
  misc_feature (378)..(378): n is a, c, t, g, unknown, or other
  misc_feature (415)..(415): n is a, c, t, g, unknown, or other
  misc_feature (416)..(416): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (495)..(495): n is a, c, t, g, unknown, or other
  misc_feature (499)..(499): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (578)..(578): n is a, c, t, g, unknown, or other
  misc_feature (597)..(597): n is a, c, t, g, unknown, or other
aagctggagctccccgcggtggcggccgctctagaactagtggatcccccgggctgcaggaattcgcacgagaccattacctagaacatcctaatcgaaaagctagtcttcacggcggggttgttgtcgcttgtggccagccgccagcaccagcacaaggcgatcgagagtggtgaccaccagtaaactgcaaagtgcaaaccaaacaccacccacgagaaagcggaggagggagcaatggcggagccgagccagcagctgcggtcgttcgtggaggtgccggcgggctcccacttccccatccagaacctgcccttcggggtcttccgccggcggngggtgcaggcgcaggcgccgcgccccgcggtgggcatcgnngacttcgcgctcgacctcgccgccgtcgccgacgcgnngctcttcgacgggcccgcgctctccgggtccccgtgcttccacccagagacgctcaacatgtttctgnnngatggccgnccgncgtgnnnaggagcgcgcgccacgctacagaaaatcctatcagccgacgagcccgtcttgcgtgacaacgaagcactgangaacaagtgtctggtaccnatgagtgatatagagatggttctacaatcacggggtga

SEQ ID NO: 33442 - protein, 132 aa, Zea mays
  misc_feature: Ceres CLONE 1411273-F
  misc_feature (10)..(129): Pfam Name: DUF1969 Pfam Description: Domain of unknown function (DUF1969)
  misc_feature: SWISSPROT Homolog: EC 3.7.1.2 Fumarylacetoacetase
  misc_feature (34)..(34): Xaa is any aa, unknown, or other
  misc_feature (47)..(47): Xaa is any aa, unknown, or other
  misc_feature (60)..(60): Xaa is any aa, unknown, or other
  misc_feature (83)..(83): Xaa is any aa, unknown, or other
  misc_feature (88)..(88): Xaa is any aa, unknown, or other
  misc_feature (89)..(89): Xaa is any aa, unknown, or other
  misc_feature (90)..(90): Xaa is any aa, unknown, or other
  misc_feature (114)..(114): Xaa is any aa, unknown, or other
MAEPSQQLRSFVEVPAGSHFPIQNLPFGVFRRRXVQAQAPRPAVGIXDFALDLAAVADAXLFDGPALSGSPCFHPETLNMFLXDGRPXXXGARATLQKILSADEPVLRDNEALXNKCLVPMSDIEMVLQSRG

SEQ ID NO: 33443 - DNA, 714 bp, Zea mays
  misc_feature: Ceres CLONE 1411274-F
  misc_feature (300)..(300): n is a, c, t, g, unknown, or other
  misc_feature (380)..(380): n is a, c, t, g, unknown, or other
  misc_feature (390)..(390): n is a, c, t, g, unknown, or other
  misc_feature (402)..(402): n is a, c, t, g, unknown, or other
  misc_feature (403)..(403): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (459)..(459): n is a, c, t, g, unknown, or other
  misc_feature (460)..(460): n is a, c, t, g, unknown, or other
  misc_feature (494)..(494): n is a, c, t, g, unknown, or other
  misc_feature (557)..(557): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggagngacggagtggtcgaacgggaccgcaaggagggacctgcggtggtgcaagcaggcgtgtcgagtggcagtacggaaaggancaccccgcgnaagagggaaggnnaagagcgagtgccgcgagcggcaccagcaagctgacgcgnnncgaggacggcgacnnagcggcgtgggacgcctacgtctcccgcctcggnaaagggggcgaagtggccggcgccatgtgcctgcgcccgccacgagggccagcccgtgtgagnatccaggagtggcattgagggcggtgcccgccgcctgcgaactgggccgtcgacatgggagcaaagagtacgggtcgcggcaagccagaagcgcggccaggtgggcggggaagaaggtgcgaacgcccatcaccgcgggggactgggtggcaagagg

SEQ ID NO: 33444 - DNA, 554 bp, Zea mays
  misc_feature: Ceres CLONE 1411275-F
  misc_feature: Encodes the peptide sequence at SEQ ID NO. 33445
  misc_feature (260)..(260): n is a, c, t, g, unknown, or other
  misc_feature (367)..(367): n is a, c, t, g, unknown, or other
aagctggagctccccgcggtggcggccgctctagaactagtggatcccccgggctgcaggaattcgcacgagaccattacctagaacatcctaatcgaaaaagtagagggcaggaggcggcggaatgacggagcggcaggtggcggagctgggtcccgggacggcgtgctgcggctggaaccactgtggccgccgcctcgccgctggcgccgtcgacggctccgtctccgtctatgactcccagccgccaccctcgttcnagtggcaggccatgagcaagcattgtgatgtcgtctggcttcctcagagtatgggatgctatagctgtgttgtgctgatgggacactgtccttttggtggaaggagntttcttgctggggacggctaagggcaaggaagaaaacgtggcttttcttttttgaaaaaacccagggtttaatgtttttaaaagggaaaaggtggggaaaaaaaaaaaaaaaaggggtttaaaagggggggggggggaggggggttctaaaaaaaaccaccccggtttaaaaaaaaaaaaaaaaaag

SEQ ID NO: 33445 - protein, 87 aa, Zea mays
  misc_feature: Ceres CLONE 1411275-F
  misc_feature (46)..(46): Xaa is any aa, unknown, or other
  misc_feature (81)..(81): Xaa is any aa, unknown, or other
MTERQVAELGPGTACCGWNHCGRRLAAGAVDGSVSVYDSQPPPSFXWQAMSKHCDVVWLPQSMGCYSCVVLMGHCPFGGRXFLAGDG

SEQ ID NO: 33446 - DNA, 614 bp, Zea mays
  misc_feature: Ceres CLONE 1411278-F
  misc_feature: Encodes the peptide sequence at SEQ ID NO. 33447
aagctggagctccccgcggtggcggccgctctagaactagtggatcccccgggctgcaggaattcgcacgagaccattacctagaacatcctaaaaaaaaaaccgagtcgagtccacagtccacaccaccaccgcgagggccactaaaaaaagaagagaattaccggtaccaatcaatcacgctgccagtgtagtgacagcggcggcaacaccacacccacgcgtcgccggagccgatcccccgatgcatctcccaccggtctcccacaaggacctcttcgccgccgtcagatccgccgacgcgcccgacgtacgcggggtcctgtccgactccgaggagtgggccacatccttgagcgctctcgtcgccgctcatacggacggcggggaaaccgccctgtacgctgctgcgtaggtcggcatggaggaggaagatgcgcctctcctcactgtctaggatgtcgagggagccaccggcggctcatgacttgacctcgacgacttgcatgcaaccgacgaggagggccacgcagatctcgtaagagattccttgcgaaggagctcacggctatgatcagtctgtgactctccaaaaggtagtcacctctactagg

SEQ ID NO: 33447 - protein, 56 aa, Zea mays
  misc_feature: Ceres CLONE 1411278-F
MHLPPVSHKDLFAAVRSADAPDVRGVLSDSEEWATSLSALVAAHTDGGETALYAAA

SEQ ID NO: 33448 - DNA, 812 bp, Zea mays
  misc_feature: Ceres CLONE 1411278-R
  misc_feature: SWISSPROT Homolog: EC 2.7.11.7 [Myosin heavy-chain] kinase
  misc_feature (1)..(1): n is a, c, t, g, unknown, or other
ntttttttcgattgggtaccgggccccccctcgaggtcgacggtatcgataagctttttttttttttttttataaattagctgggcctaaggtatacttattaatatcattttaagacagaattcccgtccgacctctatcactgtcatcacaattgattccttctctccaaaggggggaaacggaatataaatacatcttttgttctgctgtaatagatactacaagtagagtcaaatgcaatacaaatgcacgatttttccatgagcagagtagtacaatcacatattaccatggcatgccatgatcaatcgtgcatcacaatcaagccatagcataaacatgtactccgtcccggtttccttcacttgaacatggagatgtcaaacacacgggcggagccatctgatgaggcggagaccatggtgttgccgtcggcagtgatagccagcgactgtactacatctgcatgcccactgaactccctggcgcaggctccagagaggctgtcccagatgcgcaccttgccgtcaatgcatcctgacgcaacgtatcttgacgaacctagccatgtcagtgatgtcacgccctcatcatgttcgcaaatgcatcggctggattggtgcgtgaggtcccagatgatcagcttttgatccatgctccctgtagctacccagccatagcttgacgagataccaaggcactcaatagaactggtgtggcctgctaatgagccaacgacctggcccgagtttaaattcacaatgtgcacagaactgtccttggagccgctaacaaccgtttgtgaatcc

SEQ ID NO: 33449 - DNA, 651 bp, Zea mays
  misc_feature: Ceres CLONE 1411280-F
  misc_feature: Encodes the peptide sequence at SEQ ID NO. 33450
aaaagtggagctcaccgcggtggcggccgctctataactagtggatcccccgggctgcaggaattcgcacgagaccattacctagaacatcctaatcgaaaagtatcgtctcctctccttcctgacattggcactggcagctgcactcaccggaagccatggaagacttgctctactactccctcaccatagccatctgcatcgcagtcatcgccctcctctccatccttcgttcgttcaccgctaccggaccgccgccggcgctcccgcccggcccgtcgctgctgtcgctgatcaccccgctcctcttcctcggccgaacgaacttcggcatcgagcggatcctctccgccgcgcggtcccgctacggccccgtcttcacgctctacctgctcccgtcccgcccggccatcttcatcgccgaccactccgtggcgcaccgcgtgctggtgcagggcggcgccgccctcccccgacaggccgccggccagcctcccccttccgcctcttctccagggaacagcgcaacatcacatccggggccctacggccgggtctggggcgcggctccgttcaaaccctccggggaaacgtgggtccaccccgtcccctccagggggccggttccccccgcagcccggccgggcgagg

SEQ ID NO: 33450 - protein, 164 aa, Zea mays
  misc_feature: Ceres CLONE 1411280-F
MEDLLYYSLTIAICIAVIALLSILRSFTATGPPPALPPGPSLLSLITPLLFLGRTNFGIERILSAARSRYGPVFTLYLLPSRPAIFIADHSVAHRVLVQGGAALPRQAAGQPPPSASSPGNSATSHPGPYGRVWGAAPFKPSGETWVHPVPSRGPVPPAARPGE

SEQ ID NO: 33451 - DNA, 644 bp, Zea mays
  misc_feature: Ceres CLONE 1411281-F
  misc_feature: Encodes the peptide sequence at SEQ ID NO. 33452
tggagctccccgcggtggcggccgctctagaactagtggatcccccgggctgcaggaattcgcacgagaccattacctagaacatcctaatcgaaaaaacaacgaacaaaaaaactctactccgtaacctttccgtctctaaccttcccgtctcctgctgccacctcccgcatccgtgaagaacgactgaaccagccgccacccgcccgtccgactccggctccggccacctgcctccgtccctccgccgagctgcccgtctgccttcgtccctccggcctaggcgagcagatctccacccccacccgccccgagccgagcagcagccagcagagccgcatcgccgccggggaacgctgagttgccggcccgtcgccctgagaagatctccatcccagcagcatagccgcagcgccgcctccccaaggcaaggcccgagcgccctacgccctgccacaggccccagattaggttgatgtctttcatgagactattgcctcaaaggctaccccaacttatcaggcaggtggagcaagatgttgagactgtaatccacgttctccagccaggtccaataggaattgtggagcacaaattcacagacacggagatcttagaggccagggctacagtgaaaagagcag

SEQ ID NO: 33452 - protein, 56 aa, Zea mays
  misc_feature: Ceres CLONE 1411281-F
MSFMRLLPQRLPQLIRQVEQDVETVIHVLQPGPIGIVEHKFTDTEILEARATVKRA

SEQ ID NO: 33453 - DNA, 697 bp, Zea mays
  misc_feature: Ceres CLONE 1411283-F
  misc_feature: Encodes the peptide sequence at SEQ ID NO. 33454
  misc_feature (387)..(387): n is a, c, t, g, unknown, or other
  misc_feature (401)..(401): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggaacgacgacacatggggaagggtagtgtgggtgcatcatggtgggcgttcctcctgctcgccggcgtgctgctggtcgtagcagccacggccggggcggaggaacggagtggtcgaacgggaccgcaaggaggacctgcggtggtgcaagcaggcgtgcgagtggcagtacggaaagacaccccgcgnaagaagggatgccnagagcgagtgccgcgagcggcacccacaagctgacgcgggcgaggacgggaccgggggggtggaaagcctaagttcccggatccgacagggggcgaagggcccgctccacgtgctggccccgccccagggcccgcccgggggaaaaccccggaatgggttgagggggtccccccccccgggaatgggcccccaaattgaaaaaaaaaatacgtccccgggaacgtagagacgggacaatgtcccaaaaaaaggtcgacaccccccccccggaggtattgcgtggaaagtgtccctg

SEQ ID NO: 33454 - protein, 74 aa, Zea mays
  misc_feature: Ceres CLONE 1411283-F
  misc_feature (64)..(64): Xaa is any aa, unknown, or other
MGKGSVGASWWAFLLLAGVLLVVAATAGAEERSGRTGPQGGPAVVQAGVRVAVRKDTPRKKGCXERVPRAAPTS

SEQ ID NO: 33455 - DNA, 661 bp, Zea mays
  misc_feature: Ceres CLONE 1411285-F
  misc_feature: Encodes the peptide sequence at SEQ ID NO. 33456
  misc_feature (557)..(557): n is a, c, t, g, unknown, or other
  misc_feature (564)..(564): n is a, c, t, g, unknown, or other
tggagctccccgcggtggcggccgctctagaactagtggatcccccgggctgcaggaattcgcacgagaccattacctagaacatcctaatcgaaaaagtttcccggctccctcgctcacgcgccgcggcatcactccggccggctggccagtcgcccactcttcccacccacaccgccgctgcctttccttccacggcgaactctccgcgggcgacgtccagactggcaacggcattccaataaaagaatgcgcccctgctctggccaactctctccacctgcattccccgttccgctaaaccctagccgcctccggcgcgtagtagattcgccatcagagacgacgctcggcggccctgaggagggatgacctacgtcaacccagacccccagccgctcgccgccgctacggcggatgattccgcaacccagcatcaagctgcggtgacgcccgcgccgcagtcgacgcaggcgctctccgggttttttgcgacggcggagccgaagcagggcgcgaccatggtggcgcctcgtccccgcagggcggtccggggntcgcggncgtgccccaggccccaggggtcgagaacatagcgccccccgcgtcccgcaggcccttccgggttttgcgggacccccggctcgcccacagcaggggc

SEQ ID NO: 33456 - protein, 75 aa, Zea mays
  misc_feature: Ceres CLONE 1411285-F
  misc_feature (66)..(66): Xaa is any aa, unknown, or other
MTYVNPDPQPLAAATADDSATQHQAAVTPAPQSTQALSGFFATAEPKQGATMVAPRPRRAVRGSRXCPRPQGSRT

SEQ ID NO: 33457 - DNA, 689 bp, Zea mays
  misc_feature: Ceres CLONE 1411286-F
  misc_feature: Encodes the peptide sequence at SEQ ID NO. 33458
  misc_feature (441)..(441): n is a, c, t, g, unknown, or other
  misc_feature (689)..(689): n is a, c, t, g, unknown, or other
aaagctggagctccccgcggtggcggccgctctagaactagtggatcccccgggctgcaggaattcgcacgagaccattacctagaacatcctaatcgaaaacttctccccccactacccaaacccaacaggcggcgcagcagcatcgccaccaccgtccaaagagcaaagatggtgaagttcctcaagcccggcaaggccgttatcctcctccagggccggttcgccggccggaaggccgtgatcgtgcgcgttttcgaggagggcacccgtgatcgtccctacgggcactgcctcgtcgcgggcctcgctaagtaccccaagaaggtgatccgcaaggactccgccaagaagacggccaagaagtcccgcgtcaagtgcttcatcaagctcgtcaacttcacgcacctcatgcccacccgctacaccctcgccgtcganctttaaggacgtcgcatcgggcgggcccgacgcgctctccacccgggacaagaaggtcgaagcctgcaaggccgccaagggcgcttccgaggagaggttcaagaccggaaagaacagggtggttctttaccaaactccgcttctagaacgtcgggcgtccctccatagtgtctggatctaagttgtcaatttcttgtacctgaaaaccttaaaagggatcctctgttttgctatttccatgaaggctn

SEQ ID NO: 33458 - protein, 91 aa, Zea mays
  misc_feature: Ceres CLONE 1411286-F
  misc_feature (52)..(92): Pfam Name: Ribosomal_L27e Pfam Description: Ribosomal L27e protein family
  misc_feature (7)..(40): Pfam Name: KOW Pfam Description: KOW motif
  misc_feature (90)..(90): Xaa is any aa, unknown, or other
MVKFLKPGKAVILLQGRFAGRKAVIVRVFEEGTRDRPYGHCLVAGLAKYPKKVIRKDSAKKTAKKSRVKCFIKLVNFTHLMPTRYTLAVXL

SEQ ID NO: 33459 - DNA, 663 bp, Zea mays
  misc_feature: Ceres CLONE 1411287-F
  misc_feature (197)..(197): n is a, c, t, g, unknown, or other
  misc_feature (204)..(204): n is a, c, t, g, unknown, or other
  misc_feature (205)..(205): n is a, c, t, g, unknown, or other
  misc_feature (625)..(625): n is a, c, t, g, unknown, or other
tggagctccccgcggtggcggccgctctagaactagtggatcccccgggctgcaggaattcgcacgagaccatacctagaacatcctaatcggaactccaaagtttcgtccaccatttcgctcccgcaagcaccgatttgtttactgctctctccgacgcgcggcggcggagctccctacgacgactgaaccatgtngcggcgnngcgcgatccctttggccaaacccttttccggggggcccggggggcccccccccccccccttttttaaaaaggaggggggggagatttttgcggggggggggagaaaaaaaaaaaaaaactcccccccggcaggggggggcgcggcccccccggaagacaggaaaaggggggggttttttttttttttgtggggggggggggaagggaaaaaaaaaaaaaaaaaaattttttctttgggggcgggggcccgctttttttgtggggaggtggcggtgaggaggccccgccccacggcaagcaagggggagggagggggggggggggggaaaataatattttttctccctcgagccggcgcccccgcgctgaagggtccgggggcggcgggcggcccccccccacacccccccccccaacttnctcctcaaaatagcggttagtgccgtccgaggtaacac

SEQ ID NO: 33460 - DNA, 648 bp, Zea mays
  misc_feature: Ceres CLONE 1411301-F
  misc_feature: Translation starting site: 204
  misc_feature: SWISSPROT Homolog: EC 2.3.1.97 Glycylpeptide N-tetradecanoyltransferase
  misc_feature (244)..(244): n is a, c, t, g, unknown, or other
  misc_feature (288)..(288): n is a, c, t, g, unknown, or other
  misc_feature (293)..(293): n is a, c, t, g, unknown, or other
  misc_feature (368)..(368): n is a, c, t, g, unknown, or other
  misc_feature (371)..(371): n is a, c, t, g, unknown, or other
aaactggagctccccgcggtggcggccgctctagaactagtggatcccccgggctgcaggaattcgcacgagaccattacctaaaacatcctaatcgaaaaacaagacgagatctacccgctgccccctcgcattcccctcccccgcgtcgtcatctccccaaatccccccaaaccctaccgccgatccggccccagatcgccatggccgcgcccaacagcaatgacgccgccagcgccagcgncaccggcccggctggcgaggaggacatctccatcgaggcgttgncgcgncgcgtgcaagagcacatgacccctcactcgaaccccgccgctcgccgccacaagttctgggagacacagcccgtncgncagttccgcgacgccgcccgaccatccctaacgaacggccccatccaagccgcccacgccactctccgaggtgcgcgccgacccctacccagtggcccccccccttcaggggttcacctgccacctccatgaaaaccggctcctccgcgaactctactcttttgttcccccaccactacttccaggatgaaaagaaaatgggtccgtttcaattaatcccccggcctttcctccggttggggggttaaagccggcggtccttttttcggggggctgg

SEQ ID NO: 33461 - DNA, 628 bp, Zea mays
  misc_feature: Ceres CLONE 1411302-F
  misc_feature: Encodes the peptide sequence at SEQ ID NO. 33462
  misc_feature (426)..(426): n is a, c, t, g, unknown, or other
  misc_feature (431)..(431): n is a, c, t, g, unknown, or other
  misc_feature (434)..(434): n is a, c, t, g, unknown, or other
  misc_feature (453)..(453): n is a, c, t, g, unknown, or other
  misc_feature (516)..(516): n is a, c, t, g, unknown, or other
  misc_feature (576)..(576): n is a, c, t, g, unknown, or other
  misc_feature (582)..(582): n is a, c, t, g, unknown, or other
  misc_feature (600)..(600): n is a, c, t, g, unknown, or other
aaagtggagctccccgcggtggcggccgctctagaactagtggatcccccgggctgcaggaattcgcacgagaccattacctagaacatcctaatcgaaaagattgattcacaagacgtcgatcccaaaccctaaccctttcaacggttccactccaccaccaacctcatgtgtcggcgcccgccgccgcacccaacccctccctcctccgtctgctcccggtcctcgcgtagccgcaacctccctcgttgccccacactacccacgtccctagcgtcatgcagatcaaaaccaaggggcaggcggcgacagtggttcagagtccgccgctgacggccctgcgaggaacgggtagattcgcttggtgtccgggcggctccgcgtcgccgaatccgatagcattgtggatctggagggtagaaaggncttgntgntagacgtgaaggacgatgncgttcatggtcctagaagtaagcgcgatggtctcctcaggcatcggcttcgtggacggctggntcttcccatcatagatcagaagaagactcgagtcataaaaaaagtcatcatttgtgcttngatccnacgaaaatgcccgctggntcttctcatttcgttggagcatgcctaa

SEQ ID NO: 33462 - protein, 54 aa, Zea mays; identical to SEQ ID NO: 24650
  misc_feature: Ceres CLONE 1411302-F

SEQ ID NO: 33463 - DNA, 658 bp, Zea mays
  misc_feature: Ceres CLONE 1411305-F
  misc_feature (308)..(308): n is a, c, t, g, unknown, or other
  misc_feature (341)..(341): n is a, c, t, g, unknown, or other
  misc_feature (508)..(508): n is a, c, t, g, unknown, or other
  misc_feature (553)..(553): n is a, c, t, g, unknown, or other
aaagctggagctccccgcggtggcggccgctctagaactagtggatcccccgggctgcaggaattcgcacgagaccattacctagaacatcctaatcgaaaaacccatctctctctcccagccggctctctctctctcctctcttctccctgcttcagccgattccaagccgctggacaccaggacgccgagcaagccaggctgcccagccgcgaccccgagcgcccctgcccgaccgcgccaagcgcgcgaccctgcgcgacgacccgccgcccagcgcacgacgccctgcaacccgcgcgcctcangccgaccgaagccaggaaccgaccaagccgccnagatccgaagcgcccgtgaccgttcttcttcgcgagtaaaggagcatttagtcatccggcagcgacgatcctacggggggcaaacacgatctctgcccctcctttccccaaatcatctctctcccgatcttggcctccccagattcacaactgctctcctctccggntaacgactggttcatcctgattcgaacacgcaactggtttaacantcttggtttcgctgaggaatgatggaatcccaaaggcttggaagtgggccttttggttcccctgaaaaacccaattacgggcccgggaacggcccttgaacctgg

SEQ ID NO: 33464 - DNA, 635 bp, Zea mays
  misc_feature: Ceres CLONE 1411306-F
  misc_feature: Encodes the peptide sequence at SEQ ID NO. 33465
  misc_feature (431)..(431): n is a, c, t, g, unknown, or other
  misc_feature (434)..(434): n is a, c, t, g, unknown, or other
  misc_feature (535)..(535): n is a, c, t, g, unknown, or other
  misc_feature (540)..(540): n is a, c, t, g, unknown, or other
  misc_feature (630)..(630): n is a, c, t, g, unknown, or other
aaagctggagctccccgcggtggcggccgctctagaactagtggatcccccgggctgcaggaattcgcacgagaccattacctagaacatcctaaaaaaaaaaataggccgcaccgcatttcgaaaggccacgccaccgccacctccacctcctcgaagccgccgcgaccgatcgagcgaagcgtcccttcccgcgccgacgccgaaaccctagctcctcttacgccatggccaccgtgtcgctcactccgcaggcggtcttctccaccgagtccggcggcgccctggcttctgccaccatcctccgcttcccgccaaacttcgtacgccagctcagcaccaaggcacgacgcaactgcagcaacatcggcgtcgcgcagatcgtcgccgccgcgtggtccgactgcctcgctgcccgccgcctccgcggnggnggatgtcagcgcaattcctaacgctaaggttgcgcagccgtccgccgtcgtattggccgagcgtaacctgctcggctccgacgccagcctcgccgtccacngcggnggagaggctgggaagaaggatagccacggatgctatcaccacggcggtagtggacacgtcgggctactgggttcacactcgcaagagtanttcga

SEQ ID NO: 33465 - protein, 75 aa, Zea mays
  misc_feature: Ceres CLONE 1411306-F
  misc_feature: SWISSPROT Homolog: EC 2.5.1.48 Cystathionine gamma-synthase
MATVSLTPQAVFSTESGGALASATILRFPPNFVRQLSTKARRNCSNIGVAQIVAAAWSDCLAARRLRGGGCQRNS

SEQ ID NO: 33466 - DNA, 672 bp, Zea mays
  misc_feature: Ceres CLONE 1411313-F
  misc_feature: Encodes the peptide sequence at SEQ ID NO. 33467
  misc_feature (278)..(278): n is a, c, t, g, unknown, or other
  misc_feature (330)..(330): n is a, c, t, g, unknown, or other
  misc_feature (335)..(335): n is a, c, t, g, unknown, or other
  misc_feature (382)..(382): n is a, c, t, g, unknown, or other
  misc_feature (495)..(495): n is a, c, t, g, unknown, or other
  misc_feature (496)..(496): n is a, c, t, g, unknown, or other
aagctggagctccccgcggtggcggccgctctagaactagtggatcccccgggctgcaggaattcgcacgagaccattacctagaacatcctaatcgaaaaaggttaaagcgacgcccccgccgcaagccgtccgccttgcccttcacgaaggcttggtcctcctccttgtatctccactccccccttcacagatccgttcctccagctagggttagcgttcctctgcagcgatggcgatcaagcggactaaggcggagaagaagatcgcgtacgacnagaagctgtgcagcctgctcgatgagtacacccaggtgctcatcggcctggncgacnacgtcgggtcccagcagctccaggacatccgccggggcctcagggcngaatcggtggtgctcatggggaaagacacgctccatcagcgttgcatccaggtggacggccaggaaaacggtaaacacaacttttgaaccggtcatggacctcctgggccggnnacgtaaggctcatcttcaacaagggagacctcaaggaggggggccgagggaagtccccaataaaaaggggggggctccctgtgccgggtgggcctcggtgccccccaggaaggtgtggtgtgccccctggggaaactgggggtggggaacctccccgaacccttttttttttgggg

SEQ ID NO: 33467 - protein, 78 aa, Zea mays
  misc_feature: Ceres CLONE 1411313-F
  misc_feature (6)..(75): Pfam Name: Ribosomal_L10 Pfam Description: Ribosomal protein L10
  misc_feature: SWISSPROT Homolog: EC 4.2.99.18 DNA-(apurinic or apyrimidinic site) lyase
  misc_feature (16)..(16): Xaa is any aa, unknown, or other
  misc_feature (33)..(33): Xaa is any aa, unknown, or other
  misc_feature (35)..(35): Xaa is any aa, unknown, or other
MAIKRTKAEKKIAYDXKLCSLLDEYTQVLIGLXDXVGSQQLQDIRRGLRAESVVLMGKDTLHQRCIQVDGQENGKHNF

SEQ ID NO: 33468 - DNA, 698 bp, Zea mays
  misc_feature: Ceres CLONE 1411315-F
  misc_feature: Encodes the peptide sequence at SEQ ID NO. 33469
  misc_feature (343)..(343): n is a, c, t, g, unknown, or other
  misc_feature (488)..(488): n is a, c, t, g, unknown, or other
  misc_feature (556)..(556): n is a, c, t, g, unknown, or other
  misc_feature (608)..(608): n is a, c, t, g, unknown, or other
  misc_feature (609)..(609): n is a, c, t, g, unknown, or other
  misc_feature (634)..(634): n is a, c, t, g, unknown, or other
  misc_feature (635)..(635): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
aaagctggagctccccgcggtggcggccgctctagaactagtggatcccccgggctgcaggaattcgcacgagaccattacctagaacatcctaatcgaaaactctcgctccgttgctcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgntcccaagatgaaggtgtgcatggcttggtgatgcccagcatggttgaggaggccgagaagatgggacttgccttacatgggatgttgaggctctcaagaaaatgaacaagaacaagaagcttggttaagaggttttgccaagaangtaccatgctttcttgggcatcagaggccatcatcaagcagattcccggtctcttttggtcctggtcncaacaggggcaggcaagttccccgaccctggttactcaccagaaatcctcgnnagtcccaggtgaacgagactaaggnnaacgtcagtcannnttcaagagtttttttttatttgagaggggggnnnnntgttggaatctgg

SEQ ID NO: 33469 - protein, 93 aa, Zea mays
  misc_feature: Ceres CLONE 1411315-F
MSKLQSESVKDAISQIVGDAKEKNRKFTETVELQIGLKNYDPQKDKRFSGSVKLPHIPRSQDEGVHGLVMPSMVEEAEKMGLALHGMLRLSRK

SEQ ID NO: 33470 - DNA, 723 bp, Zea mays
  misc_feature: Ceres CLONE 1411316-F
  misc_feature: Encodes the peptide sequence at SEQ ID NO. 33471
  misc_feature (291)..(291): n is a, c, t, g, unknown, or other
aagctggagctccccgcggtggcggccgctctagaactagtggatcccccgggctgcaggaattcgcacgagaccattacctagaacatcctaatcgaaaaaaaatcccgctctcctccctcgcccctctctctctcctcatccaccaccagtgcctccacgaatcttcaacaggcaaagccaatcaataatcaccagccacatcaatccattccctttcctctcccgctccacttccatgggcaaggttcggtccttcttctcgcgctcccgcagcggcaagcgcggcangcgcccggagagcaggctcgtcctcgccgcactcctccgcggcaggcgcgccgccgtccccgtcccaactcccgaggaggtcaccggttcgtcgtcgtcaaccacaaccagggacgagacgggagcgcgtgtttccgcaagttcgacgcggaacggcgacgggcatgaactcgcgagtccgagtttagagtggaatgcacaaagagagtgggaggctggacggggaacgcacgaactcagccatcgcgcaacggccggtagggagacagagcgagggagggggccatctaggcgctcattaatttgggaggagagcgcggtctgaactacaaccaccgaggcggaagggtcggaagtgcagtgtaataatcgcatacgcatgatacttaccgcgccaaatccgccgcgaggcccccctcaccggacacacgt

SEQ ID NO: 33471 - protein, 125 aa, Zea mays
  misc_feature: Ceres CLONE 1411316-F
  misc_feature (18)..(18): Xaa is any aa, unknown, or other
MGKVRSFFSRSRSGKRGXRPESRLVLAALLRGRRAAVPVPTPEEVTGSSSSTTTRDETGARVSASSTRNGDGHELASPSLEWNAQREWEAGRGTHELSHRATAGRETERGRGPSRRSLIWEESAV

SEQ ID NO: 33472 - DNA, 765 bp, Zea mays
  misc_feature: Ceres CLONE 1411318-F
  misc_feature (40)..(40): n is a, c, t, g, unknown, or other
  misc_feature (46)..(46): n is a, c, t, g, unknown, or other
  misc_feature (47)..(47): n is a, c, t, g, unknown, or other
  misc_feature (52)..(52): n is a, c, t, g, unknown, or other
  misc_feature (54)..(54): n is a, c, t, g, unknown, or other
gtttggcgcccgccctggccggctggtcgggggggggttntttttnnccccncnaaaaaactggcgctccccgcggtggcggccgctctagaactagtggatcccccgggctgcaggaattcgcacgagaccattacctagaacatcctaatcgaaaaaaaactcctcggccccagcattttcgtgcaaggggcgagccgccagctactgctggccttttccctcacacaagtcacacgcacacccgctagcccccgtcccccgtcccgcccgtaccttcctccgccgcctccgtcctcgttccaaccgagggcagcaggcaggcccaagtatctgcagtagattggtgggagaggaagaagacggcaggcacccacgcagatcaaacgtgctccgccacccttgggtttcggcgaaatcggcgcccgtacccccgtaaaatcgagccgttcttccgaagaaaatcggacgccgctggataaagaatttcgaacccggttccgggcgaaaaatcgaagttccagaaggttggaaaattggacccattgttccgggagtggaacccccccctttgggggcccggcccaggacaccgcccccgaaagctccaccccccttcccccgggggaaccacacttccttggataaaacccgagaatgctcctaccccccagaaaaaaatttagatttcctaagcgcgtgagataccgagtgaaataagatcggagaagtggaaaacacgcgcggggggaggcaagcgtcact

SEQ ID NO: 33473 - DNA, 679 bp, Zea mays
  misc_feature: Ceres CLONE 1411319-F
  misc_feature: Encodes the peptide sequence at SEQ ID NO. 33474
  misc_feature (238)..(238): n is a, c, t, g, unknown, or other
  misc_feature (285)..(285): n is a, c, t, g, unknown, or other
  misc_feature (366)..(366): n is a, c, t, g, unknown, or other
  misc_feature (386)..(386): n is a, c, t, g, unknown, or other
  misc_feature (401)..(401): n is a, c, t, g, unknown, or other
  misc_feature (663)..(663): n is a, c, t, g, unknown, or other
aaagctggagctccccgcggtggcggccgctctagaactagtggatcccccgggctgcaggaattcgcacgagaccattacctagaacatcctaatcgaaaaaatcaccaccactgggtcttcagaccattagctttatctactccagagcgcagaagaacccgatcgcaccatgagggtgttgctcgttgccctcgctctcctggctctcgctgcgagcgccacctcccgcataccnagcggcggctgcggctgccagcacccgccgccggttcatctaccggnccgcggtgcatctgccacctccggttcactggccacctccggtgcatcttcccaccgccggtccactgggcggccgccggntccactgggcaccggcgggntcatgggcccgcccnccggttcattctgccggccggccccatggcccactacccctactcaacccggcccgggcctcaggcctcatcccccaggcccaacccattggcccgtgcccaacaggcgcatcccaggcccgtgcccagctggcagggaaacttgcgggggttggcaacacccccaatcctggggcacggggagccaggtttctgaggtattcatggcaccccgtaagcgtacgccccactggctccccccatggcccgccggttgcggganttttgttttctcaaaa

SEQ ID NO: 33474 - protein, 169 aa, Zea mays
  misc_feature: Ceres CLONE 1411319-F
  misc_feature (38)..(38): Xaa is any aa, unknown, or other
  misc_feature (65)..(65): Xaa is any aa, unknown, or other
  misc_feature (72)..(72): Xaa is any aa, unknown, or other
  misc_feature (77)..(77): Xaa is any aa, unknown, or other
  misc_feature (164)..(164): Xaa is any aa, unknown, or other
MRVLLVALALLALAASATSRIPSGGCGCQHPPPVHLPXRGASATSGSLATSGASSHRRSTGRPPXPLGTGGXMGPPXGSFCRPAPWPTTPTQPGPGLRPHPPGPTHWPVPNRRIPGPCPAGRETCGGWQHPQSWGTGSQVSEVFMAPRKRTPHWLPPWPAGCGXFVFSK

SEQ ID NO: 33475 - DNA, 639 bp, Zea mays
  misc_feature: Ceres CLONE 1411327-F
  misc_feature: Encodes the peptide sequence at SEQ ID NO. 33476
  misc_feature (391)..(391): n is a, c, t, g, unknown, or other
  misc_feature (550)..(550): n is a, c, t, g, unknown, or other
aaagctggagctccccgcggtggcggccgctctagaatagtggatcccccgggctgcaggaattcgcacgagaccattacctagaacatcctaatccgaaaactcctctcgctcgcgtccgcacaaatcccgtgctcccccgtctgaaaaccctccccacctccggcggcggcggcggcgctggcgaccgggtgtcttctccgggagtctccccctagtaacaagaaatatggatgtacctgttgatgaccctgtggagacctcactggaagtcctagtacccttggcatgaaggaagagccactacttatggctatgtggcagatcagtccaagggaggaccagaaaagctttacgaggaacccaaagacccaatgcaggacgagttggntaaccaagggcatgggagcatgaacaatggagatgtgggagggcagcaaagtggaccaagctaccccccacagagcacggcgaggaagctgggtgaagcagcatgatgctacagttcctgatgacaaaaatgggctggggggctggagagagtgggttncctatactggttctaccacaaggggggtggcctcattgggggcaaaggggatttcatcaaaaaatgggtgaggatcaagagcccccatc

SEQ ID NO: 33476 - protein, 40 aa, Zea mays
  misc_feature: Ceres CLONE 1411327-F
  misc_feature (6)..(6): Xaa is any aa, unknown, or other
MQDELXNQGHGSMNNGDVGGQQSGPSYPPQSTARKLGEAA

SEQ ID NO: 33477 - DNA, 648 bp, Zea mays
  misc_feature: Ceres CLONE 1411331-F
  misc_feature: Encodes the peptide sequence at SEQ ID NO. 33478
  misc_feature (346)..(346): n is a, c, t, g, unknown, or other
  misc_feature (347)..(347): n is a, c, t, g, unknown, or other
  misc_feature (513)..(513): n is a, c, t, g, unknown, or other
  misc_feature (617)..(617): n is a, c, t, g, unknown, or other
aagctggagctccccgcggtggcggccgctctagaactagtggatcccccgggctgcaggaattcgcacgagaccattacctagaacatcctaatcgaaaacttggatagtccgtagccgcttgccctgttcgcatcttcgcgcgtggcgcacaccgctccagctctccttcgacgggcacggccgagccgccttcgtcttggccgcagcggtgcgcgctctccatggcgtcctaattagcctagccgcaacgccgcgcccgtgcctgcgaagtagggtgtaaagttttgtatatgatgccaggcatggatgaaccccttcttggcaatggtcttaagaccagcgnnaaaagagagagcctggtagtggccgaggtcagaaaacagatgtaccttgctgggccactcatcgctgcatggatcctacagaacattgtccagatgatatctatcatgttttgtcgtcaccttggtgagcttgccctctcccagtgctccatcgccacctcctttngcagcgttactggcttcagcttattgtctggcatggcgagcagcttggacacactgtgtgggcaatcggtcggggcaaagcagtactatctttctggcatctancagcagagggcaatccttgtgctcactctaa

SEQ ID NO: 33478 - protein, 114 aa, Zea mays
  misc_feature: Ceres CLONE 1411331-F
  misc_feature (14)..(14): Xaa is any aa, unknown, or other
  misc_feature (70)..(70): Xaa is any aa, unknown, or other
  misc_feature (104)..(104): Xaa is any aa, unknown, or other
MDEPLLGNGLKTSXKRESLVVAEVRKQMYLAGPLIAAWILQNIVQMISIMFCRHLGELALSQCSIATSFXSVTGFSLLSGMASSLDTLCGQSVGAKQYYLSGIXQQRAILVLTL

SEQ ID NO: 33479 - DNA, 685 bp, Zea mays
  misc_feature: Ceres CLONE 1411343-F
  misc_feature: Encodes the peptide sequence at SEQ ID NO. 33480
  misc_feature (239)..(239): n is a, c, t, g, unknown, or other
  misc_feature (281)..(281): n is a, c, t, g, unknown, or other
  misc_feature (352)..(352): n is a, c, t, g, unknown, or other
aaagctggagctccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcnagactatcaccctcgaagtggagtcttctgacaccattgacnatgtcaaggctaagatccaggaccagggaggggatccctcctgaccagcagcggcttatccttcgccggcnagcagctttgaggacggacgcacaccttggtgactaccacattccggagggagtcaaccctcccccttggtgctgcgcccttaagggagggatggccaacttttgtcagacccttgactgggaagaacatcacccctgaggagggggggccccacacaccctttgacaatggcaggggaaaaatcccggacaagggggggttccccacctggacacgaaagggttcaactttgccggggaaaaaattgggggggggggaagagcccttgtgggtaaaacaaatcccgaaaggggagaccccccccctttgggggtgcggcctataaggggggg

SEQ ID NO: 33480 - protein, 38 aa, Zea mays
  misc_feature: Ceres CLONE 1411343-F
  misc_feature (11)..(11): Xaa is any aa, unknown, or other
  misc_feature (25)..(25): Xaa is any aa, unknown, or other
MQIFVKTLTGXTITLEVESSDTIDXVKAKIQDQGGDPS

SEQ ID NO: 33481 - DNA, 662 bp, Zea mays
  misc_feature: Ceres CLONE 1411344-F
  misc_feature: Pfam Name: Amidase Pfam Description: Amidase
ggagctccccgcggtggcggccgctctagaactagtggatcccccgggctgcaggaattcgcacgagaccattacctagaacatcctaatcgaaaaatatgactggggtactatgcgactctgggactgttgaagttgcttctcctcttacatcatcagttgactaggctatactacctcgccactatgtgtcccacatttgctgtctccagaaaacagtgatatcctgggatcacgtatgataggaaagcatgcacagtggccttaatgatgtttctggccatgatcatatcggccacatgtgacgatgcacttatgcttgtctgcacggctttccgatgtcgaatacaagagataccattaccagagccttgaatagatgtgtactgctcatgctgcctcaattgcctgacaatcattctgtgacttggatcctcattacactgcatgaacagaaactgaactctaccttgtgtactccaacaagctcggcactcttctgcttctttcactgcaactgattatgcggcttctcggaggataaggaggacgataatgcattatcacatgaaagctttcgagaacgtcaatgacttagctgctcctacgactggcattactgctacagaatacctcacagtgctctgaactcacgacagtac

SEQ ID NO: 33482 - DNA, 659 bp, Zea mays
  misc_feature: Ceres CLONE 1411346-F
  misc_feature: Translation starting site: 172
  misc_feature: SWISSPROT Homolog: EC 1.11.1.6 Catalase
  misc_feature (274)..(274): n is a, c, t, g, unknown, or other
  misc_feature (308)..(308): n is a, c, t, g, unknown, or other
  misc_feature (404)..(404): n is a, c, t, g, unknown, or other
  misc_feature (420)..(420): n is a, c, t, g, unknown, or other
  misc_feature (455)..(455): n is a, c, t, g, unknown, or other
  misc_feature (462)..(462): n is a, c, t, g, unknown, or other
  misc_feature (502)..(502): n is a, c, t, g, unknown, or other
  misc_feature (503)..(503): n is a, c, t, g, unknown, or other
  misc_feature (531)..(531): n is a, c, t, g, unknown, or other
  misc_feature (532)..(532): n is a, c, t, g, unknown, or other
  misc_feature (636)..(636): n is a, c, t, g, unknown, or other
aaagctggagctccccgcggtggcggccgctctagaactagtggatcccccgggctgcaggaattcgcacgagaccattacctagaacatcctaatcgaaaagtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgggnggcctcgcggtcccatcctgctggaggactaccnacctgatcgagaaggtggcgcacttcgcgcgcgagcgcatcccggaagcgcgtggtgcacgcgcgcggggcctccgccaaggctttcttcgaggcnaccaccgacgtgacgntcgctgacgtgcgccgacttcctggggccgcccgncgtgcgnaacgccccgtgatcgtggccttcctcgacgggatcccccnngagcgggggtcccccggagacgatccgnnacccgcgggggttcccccccgtgaagttctaccacccgcgagggcaactggggacctgctgggcaacaaccttccccgtcttcttcatccgcgacggctcaggnttcccccgacgtgatccacgcgt

SEQ ID NO: 33483 - DNA, 595 bp, Zea mays
  misc_feature: Ceres CLONE 1411352-F
  misc_feature: Encodes the peptide sequence at SEQ ID NO. 33484
  misc_feature (451)..(451): n is a, c, t, g, unknown, or other
  misc_feature (452)..(452): n is a, c, t, g, unknown, or other
  misc_feature (470)..(470): n is a, c, t, g, unknown, or other
  misc_feature (494)..(494): n is a, c, t, g, unknown, or other
  misc_feature (523)..(523): n is a, c, t, g, unknown, or other
tccccgcggtggcggccgctctagaactagtggatcccccgggctgcaggaattcgcacgagaccattacctagaacatcctaatcgaaaaaaatcaacaaactactacaaagccacttcctgctctcgctccgccgccgccgcctccctccccagtcgatcaccaaacctcagtccaaactccaaacccccgccgcatcagaaaaaaaaccctaggccatggacgccgcggcgctggagtcgctcatcctggacctccacgccatcgaggtgtgaagctgggctccttcacgctcaagtccggcatcaaatcgcccatctacctcgacctccgcgcgctcgtctcccacccgcgcctgctctccgccgtcgcctcgctccttcacgcgctcccggccacgcgcccctacggcctcgtctgcggcgtcccctacacccgcgctcccatcgnncgccgtctctccgtcaanccgctcatccccatgctcatgcgncgtaaggaggtcaaggccaacggcaccgncaggtccatcgagggcttccttcaggccccggggaaaccggtcctcataattggaggaacctcgtccccggg

SEQ ID NO: 33484 - protein, 37 aa, Zea mays
  misc_feature: Ceres CLONE 1411352-F
  misc_feature (14)..(14): Xaa is any aa, unknown, or other
MLMRRKEVKANGTXRSIEGFLQAPGKPVLIIGGTSSP

SEQ ID NO: 33485 - DNA, 615 bp, Zea mays
  misc_feature: Ceres CLONE 1411353-F
cgctctagaactagtggatcccccgggctgcaggaattcgcacgagaccattacctagaacatcctaatcgaaaagccgcaacccctctctcattttcttcctcgtctacacctccttctctcctcctcgatacattcgagcacgcccggacgcggtcagaagggagaaagcagcaagcggcgccgggttccccctcccttcgtcgcccccgatcgacgccgatcggggccgactgctcgtgggggacgccgaccgaagcccgggcggcgctgcttcaatatacggaagcagtttctagttttcttcagttcgccgctgcagtttctagtttccagcggttcccaccagttgtctaataacttattgttgttgtacgtgaggttgcttttgtcgtatttgccaggttgcttttgttgtatttgccaggttgacacaccttgggggtgaaatcattgctattttttggggcatgacttggtttttattgaaatcaattggctgccaaggttcactaaatctttgatggaacataataggatcaccatgctggtcttctcagagactggccaggttggttctagttctaggaaccctgtcatggatcagaagaatta

SEQ ID NO: 33486 - DNA, 831 bp, Zea mays
  misc_feature: Ceres CLONE 1411354-F
  misc_feature: Encodes the peptide sequence at SEQ ID NO. 33487
  misc_feature (14)..(14): n is a, c, t, g, unknown, or other
tttatattattttntttttttacacaaccaaaaaatccactcccacctaccaacggtggggctccaccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggtacggagtggtcgaacgggaccgcaaggaggaccctgcggtggggcaagcaggccgtgtgagtggcagtaggggaggggacaccccggcgaaaaagggaatgcgaagagcaagcggatgacgagccgcaccccccctagctgaggccgggaggggagaaggaatacatgaaggcgggggaacggcctacgcgctacgccgctccggggggggggggcgagggtcggtggtgggccaagggggagcagggggcggagagacagggcgaaaaggcgcgggggggggagccgccgccgacgctccctcgcccgccttcccgcctcctctcgtccggcagcacggtgccggcccccctcatcgggggggcggttgtcggttcaccgcgggacgggttttggcggtgcgtgtcaggcgtggcagcgcggggagcggcgacacacaccccacacggacagcgccaccccccccactacgg

SEQ ID NO: 33487 - protein, 53 aa, Zea mays
  misc_feature: Ceres CLONE 1411354-F
MGKGSVGASWWAFLLLAGVLLVVAATAGAEVRSGRTGPQGGPCGGASRPCEWQ

SEQ ID NO: 33488 - DNA, 604 bp, Zea mays
  misc_feature: Ceres CLONE 1411357-F
  misc_feature: Encodes the peptide sequence at SEQ ID NO. 33489
  misc_feature (505)..(505): n is a, c, t, g, unknown, or other
  misc_feature (507)..(507): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
aaagctggagctccccgcggtggcggccgctctagaactagtggatcccccgggctgcaggaattcgcacgagaccattacctagaacatcctaatcgaaaacgctagggttttagcccggtaccccgaatcccgctcctccgccgcctcgcgtccgcccttcctcttggcgcgctccgatccaagagatggcggtgccgctgctgacaaagaagatcgtgaagaagcgggtcaagcagttcaagaggccccatctcgaccgctataagtgccttaagccaagctggcgcaggccaaagggtattgactcccgtgttaggaggaagttcaagggatgcaccttgatgcccaacattggttatgggctctgacaaatcaacccaggaactacccttcccaaaaaagtccaaaaaaatttttgggggggcaacaagggcctcccaaaatgggaggggtttcccttctgggggtgacacaaaaaaaacaccactcctgttgggggggngnttttttcccccccccacctttttttccccaaaaaaaaannnnacgatttttttttctcaacccccccccccccctctattttggtccccaacaaaac

SEQ ID NO: 33489 - protein, 60 aa, Zea mays
  misc_feature: Ceres CLONE 1411357-F
  misc_feature (14)..(61): Pfam Name: Ribosomal_L32e Pfam Description: Ribosomal protein L32
MAVPLLTKKIVKKRVKQFKRPHLDRYKCLKPSWRRPKGIDSRVRRKFKGCTLMPNIGYGL

SEQ ID NO: 33490 - DNA, 818 bp, Zea mays
  misc_feature: Ceres CLONE 1411361-F
  misc_feature: Encodes the peptide sequence at SEQ ID NO. 33491
  misc_feature (7)..(7): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
ttttaanttggggggnnnnttatggggggggggtggggaccgacgcctcaaagtggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcatcagcggtgtcttcggtatgtgaaaaccccatccttcaaccctacaggatccaacaggcaatcgcaggtggcatcttacctttatcacccctgttcctcccaacaatcatcagccctattaaaacaaggtacctttggggggaatttaattgcgacaaaaacttcagggggacaacaaactaacaacaactttgggggtaagaaaacccttgttggcctaatcctccaggaaaagggaggtttttctttccttttaacacaaaataaggggtccttgggaactctggcgttctctatttgtgggaaaacaaacggcattgcccctttcagccggagtacccggggtggccaaaccccgcggagaatttcttcttcttttccaccccaatggggaaccaattgagaacccccccggcggtatttttaaaagacgggggacagataattataacttttctccccgggggttttttgggggagggaccccc

SEQ ID NO: 33491 - protein, 43 aa, Zea mays
  misc_feature: Ceres CLONE 1411361-F
  misc_feature (2)..(2): Xaa is any aa, unknown, or other
  misc_feature (6)..(6): Xaa is any aa, unknown, or other
FXLGGXLWGGGGDRRLKVELPAVAAALELVDPPGCRNSHETIT

SEQ ID NO: 33492 - DNA, 818 bp, Zea mays; identical to SEQ ID NO: 33490
  misc_feature: Ceres CLONE 1411361-F2
  misc_feature (7)..(7): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other

SEQ ID NO: 33493 - DNA, 619 bp, Zea mays
  misc_feature: Ceres CLONE 1411364-F
  misc_feature: Encodes the peptide sequence at SEQ ID NO. 33494
  misc_feature (362)..(362): n is a, c, t, g, unknown, or other
  misc_feature (512)..(512): n is a, c, t, g, unknown, or other
cgctctagaactagtggatcccccgggctgcaggaattcgcacgagaccattacctagaacatcctaatcgaaaaacagaaccctgcaactgcaagctaaggagagtgtgatcaccaacagctagtgctagtcccccttccttccatccatccatggcatgcgtcagcaccttccagagctgccccattgccagaagagcaaagatcaacacgaggtccaggggctgcagcagtagcgtggcgaaggggtcatcaccaccagccttccagttccagtgcagggcgtcgactttcgcggcggacaccagcctccggctcgagctggacgagaaccccgaggcgatcatcctcgggggcgtggncccgggaactgctccctcctcagctacgacgacctccgcgcctacctcgagtcgcaggagacggcggcccaggcagacggtcagcagcgcggcgtggcgctcctgagcgagacctgtccacaccccgtgctggtggccacagcagacagnaccctggagggacgtcgaggccactttcgagggccgtggtcggggccttccgggtcgtcgacagcggctcaaaaaggggggcgggggtgatcctccaagaaacgacc

SEQ ID NO: 33494 - protein, 104 aa, Zea mays
  misc_feature: Ceres CLONE 1411364-F
  misc_feature (70)..(70): Xaa is any aa, unknown, or other
MACVSTFQSCPIARRAKINTRSRGCSSSVAKGSSPPAFQFQCRASTFAADTSLRLELDENPEAIILGGVXPGTAPSSATTTSAPTSSRRRRRPRQTVSSAAWRS

SEQ ID NO: 33495 - DNA, 680 bp, Zea mays
  misc_feature: Ceres CLONE 1411367-F
  misc_feature (435)..(435): n is a, c, t, g, unknown, or other
  misc_feature (557)..(557): n is a, c, t, g, unknown, or other
  misc_feature (680)..(680): n is a, c, t, g, unknown, or other
tggagctccccgcggtggcggccgctctagaactagtggatcccccgggctgcaggaattcgcacgagaccattacctagaacatcctaatcgaaaaaccaaacaaaccgcgtccgcgtcgagtctctagtctctactctctcggctgtcctgtccggcgcggctctcgcgtctccaacctacccatgctgcagctcctccaactccaaagctcacaccaccccgcgacgggcgacgctaattaagtagagctgcaacacctgggttggaggctagagcttgcaaacaccaccagcgaaaacgtcgtggccagccatcccggtgtcgtcccgcgttctacagcctctgcatcccgcgttctaagccaccgcttgttgtcgccgtcctagactcctagatccgtcagcttaacgagctccattccttcgcggcagncccatcccggtgtctcagcggcggcgggcggcggcgtcgagctcttgcttttctggtgggaggagcccatggcgatgcctggcggggcgtggggctcttggtcctcttctctctgcggccgntagtggctgagctcgccctgccgcgaacggtcttttcctgtccgatggcgtcttcagtcgagcgcgattctaacggggaggagcttgctgcagccaaagatagttgcctgtgaaactttgagn

SEQ ID NO: 33496 - DNA, 670 bp, Zea mays
  misc_feature: Ceres CLONE 1411368-F
  misc_feature: Encodes the peptide sequence at SEQ ID NO. 33497
  misc_feature (428)..(428): n is a, c, t, g, unknown, or other
  misc_feature (429)..(429): n is a, c, t, g, unknown, or other
  misc_feature (432)..(432): n is a, c, t, g, unknown, or other
  misc_feature (464)..(464): n is a, c, t, g, unknown, or other
aagctggagctccccgcggtggcggccgctctagaactagtggatcccccgggctgcaggaattcgcacgagaccattacctagaacatcctaatcgaaaaatctacctcactcgtagctcaggcatcaacggcaggagctctgggcagcgtgcgcacgtggggtacctagctcgctctgctagcctaccatggctgatcaccaccggggcgcgacgggaggtggcggtggctacggcgacctccagcgcggtggcggcatgcacggcgaggcgcagcagcagcagaagcagggcgccatgatgacggcgctcaaggccgcgacggccgcgaccttcggcgggtcgatgctggtgctgtccggactgatcctggccggcaccgtgatcgcgctcacggtggccacccccgtgctggaatctcacgggnnttnggggggccgcgggcccccatctcactggagtncatggccgccacgaattcgtcacctcctgctgccctcgagagatgctgccgatgtccgtggttctgctggcatggaccagtgacctagaagtctgatcacacgacgtgttgccgacgatctgtacaacactaagggggattgtgccgcttgaggaccgtattaatcgagggatgttgcaattgccgaatagtcaatgacttaccgg

SEQ ID NO: 33497 - protein, 118 aa, Zea mays
  misc_feature: Ceres CLONE 1411368-F
  misc_feature (80)..(80): Xaa is any aa, unknown, or other
  misc_feature (81)..(81): Xaa is any aa, unknown, or other
  misc_feature (92)..(92): Xaa is any aa, unknown, or other
MADHHRGATGGGGGYGDLQRGGGMHGEAQQQQKQGAMMTALKAATAATFGGSMLVLSGLILAGTVIALTVATPVLESHGXXGGRGPPSHWSXWPPRIRHLLLPSRDAADVRGSAGMDQ

SEQ ID NO: 33498 - DNA, 712 bp, Zea mays
  misc_feature: Ceres CLONE 1411373-F
  misc_feature (394)..(394): n is a, c, t, g, unknown, or other
  misc_feature (453)..(453): n is a, c, t, g, unknown, or other
  misc_feature (455)..(455): n is a, c, t, g, unknown, or other
  misc_feature (456)..(456): n is a, c, t, g, unknown, or other
  misc_feature (474)..(474): n is a, c, t, g, unknown, or other
  misc_feature (486)..(486): n is a, c, t, g, unknown, or other
  misc_feature (588)..(588): n is a, c, t, g, unknown, or other
  misc_feature (589)..(589): n is a, c, t, g, unknown, or other
  misc_feature (591)..(591): n is a, c, t, g, unknown, or other
  misc_feature (594)..(594): n is a, c, t, g, unknown, or other
  misc_feature (595)..(595): n is a, c, t, g, unknown, or other
  misc_feature (599)..(599): n is a, c, t, g, unknown, or other
  misc_feature (601)..(601): n is a, c, t, g, unknown, or other
  misc_feature (635)..(635): n is a, c, t, g, unknown, or other
  misc_feature (636)..(636): n is a, c, t, g, unknown, or other
aaagctggagctccccgcggtggcggccgctctagaactagtggatcccccgggctgcaggaattcgcacgagaccattacctagaacatcctaatcgaaaaatccaggcagcacagctccctccccactcgaggctccgagctttattttttcttgttttgttttgttttcttggtaggagtaacaatagtttctggcagccttcttcctcctcgctctctacccgaggagagaggagaggagagaaatccggaggcaaagcttcagggtttgtataaagggattctagatctaatcgactaaccagagagaaaaaaaaacaaaaaataacgcgagaaagcatgagccacttcgccgccgccgccgtgaaagccccccctcgccgtggccggncccgccgccggcgacgccaagagcccgctcttctgccccaagccgcggcgccccgcggngnnccctgcggtgccaccagngcggcgacgccnggcatggatctgctcgacctcctcctgcaaagcaccagtgttttagggtgatgaacagtgacacactgcacgctatatcttgggggggaaaagaagaaaagnnanacnnaacngnaggggggggggtggaaaggggaacccgttggcgnnccataaaaatggtctggcaggtgccgcaatcttagcccgttccttctcccctatttcctatttctttggttagggg

SEQ ID NO: 33499 - DNA, 633 bp, Zea mays
  misc_feature: Ceres CLONE 1411379-F
  misc_feature: Encodes the peptide sequence at SEQ ID NO. 33500
  misc_feature (513)..(513): n is a, c, t, g, unknown, or other
  misc_feature (580)..(580): n is a, c, t, g, unknown, or other
  misc_feature (596)..(596): n is a, c, t, g, unknown, or other
  misc_feature (632)..(632): n is a, c, t, g, unknown, or other
tggagctccccgcggtggcggccgctctagaactagtggatcccccgggctgcaggaattcgtacgagaccattacctagaacatcctaatcgaaaaagaatcgattccccctcctccgtcgctgtccggccgaccgcggagagcggagtcgatcgggggcgacaacgatggtggttagcgtggccgcgaccgggcccggcacggacgccgagccggtgagctccaccttcttcgcgtcccgctacgtccgcgacccactcccacggtaccggatgccggagcggtcgatcccgcgggaggcggcgcagcagatcatcagcgacgagctcatgctggacggcaacccgcgcctgaacctggcgtccttcgtcaccacgtggatggagcccgagtgcgacaagctcatcatggactccatcaacaagaactacgtcgacatggacgagtaccccgtcaccactgagctccagaaccgctgcgtaaacatgatagctcacctgttcaacgcgcgnatcaaggaggacaacaaggctattggggtcgaaaacagtgggatcctcggagcggcaattggttgcnaaggtctgggcgttcnagagggaatggcagaaacagggggaaggagcagggna

SEQ ID NO: 33500 - protein, 154 aa, Zea mays
  misc_feature: Ceres CLONE 1411379-F
  misc_feature: SWISSPROT Homolog: EC 4.1.1.15 Glutamate decarboxylase
  misc_feature (138)..(138): Xaa is any aa, unknown, or other
  misc_feature (143)..(143): Xaa is any aa, unknown, or other
MVVSVAATGPGTDAEPVSSTFFASRYVRDPLPRYRMPERSIPREAAQQIISDELMLDGNPRLNLASFVTTWMEPECDKLIMDSINKNYVDMDEYPVTTELQNRCVNMIAHLFNARIKEDNKAIGVENSGILGAAIGCXGLGVXEGMAETGGRSR

SEQ ID NO: 33501 - DNA, 721 bp, Zea mays
  misc_feature: Ceres CLONE 1411384-F
  misc_feature: Encodes the peptide sequence at SEQ ID NO. 33502
  misc_feature (304)..(304): n is a, c, t, g, unknown, or other
  misc_feature (344)..(344): n is a, c, t, g, unknown, or other
tccccgcggtggcggccgctctataactagtggatcccccgggctgcaggaattcgcacgagaccattacctagaacatcctaatcgaaaactttcgtcaactccacttctcttctccgcgtcacctcctcttcgccgccgccgacgcttcaccgggcagccagccatggatgaggagtacgacgtgatcgtactaggcacggggctcaaggagtgcatcctcagcggtctcctctctgtggacggcctcaaggttttgcatatggacagaaatgactactatggaggagattccacctcgctncaccttaatcagctctggaagaggtttagaggggaagacnagcccccagcacatctaggtgccagcagagactaacatgtggacatggtgcccaagtttatgatggcaaatgggacatgggtccaaccctcatccaacacgacgtgacaaagtacttgtcatcaaagctggtgatggagctaggttttcagtaaaggaaaatttacaaggcccctgccacgaatatgaggccctgaaaccccctttgaggggctttttcagaaacggaaagcagggaatttttctctttttggccaaaatacaaggaatcgggcccgaggacccctcggggtggggcctttaagggggggcccctaaaaattttttccaaaaattggtttaaggggggaaacacggggttttttgggaaaaacccct

SEQ ID NO: 33502 - protein, 70 aa, Zea mays
  misc_feature: Ceres CLONE 1411384-F
  misc_feature (60)..(60): Xaa is any aa, unknown, or other
MDEEYDVIVLGTGLKECILSGLLSVDGLKVLHMDRNDYYGGDSTSLHLNQLWKRFRGEDXPPAHLGASRD

SEQ ID NO: 33503 - DNA, 735 bp, Zea mays
  misc_feature: Ceres CLONE 1411391-F
  misc_feature: Encodes the peptide sequence at SEQ ID NO. 33504
  misc_feature (731)..(731): n is a, c, t, g, unknown, or other
aagctggagctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatctaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcaccggcatgctcatccagctgacctacgtggcgctcttcatcctctgctccgcgggggcggtgcgccgcagggtcgtgctcctgttcgccgccgaggtcgccttcgtcgtcgccttggccgcgctggtgctcaccctggcgcacacgcacgagcgcaggtccatgctcgtcggcatcgtctccgtcttctttcgcaccggcatgtacgctgcgccgctctcggtcatgaaattggtgatccagacaaagagcgtgggatacatgcccctgntcct

SEQ ID NO: 33504 - protein, 167 aa, Zea mays
  misc_feature: Ceres CLONE 1411391-F
  misc_feature (9)..(98): Pfam Name: MtN3_slv Pfam Description: MtN3/saliva family
MVSADTIRTAIGVIGNGTALVLFLSPVPTFVGIWKKRAVEQYSPIPYVATLLNCMMWVLYGLPLVHPHSMLVVTINGTGMLIQLTYVALFILCSAGAVRRRVVLLFAAEVAFVVALAALVLTLAHTHERRSMLVGIVSVFFRTGMYAAPLSVMKLVIQTKSVGYMPL

SEQ ID NO: 33505 - DNA, 729 bp, Zea mays
  misc_feature: Ceres CLONE 1411401-F
  misc_feature: Encodes the peptide sequence at SEQ ID NO. 33506
tccccgcggtggcggccgctctattactagtggatcccccgggctgcaggaattcgcacgagaccattacctagaacatcctaatcgaaaaatcgatcgtcaatgcttttttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctacttcctggtgttcgccatcctggccggcgtggtgggcgcggcgtccaagctggcgggcgtgcaccacgtgcgcgcctggcgccacgacagcctgagcaccaaacgcgcgtcgtcgctcatcggctgggccatcacggcgctcgccctcgggctggccctgcaggagattcaccatcggcggacacccgcggctggcgccctgcccctgctggaaagactttcgtcatcatccatcgccttca

SEQ ID NO: 33506 - protein, 132 aa, Zea mays
  misc_feature: Ceres CLONE 1411401-F
  misc_feature (14)..(128): Pfam Name: AWPM-19 Pfam Description: AWPM-19-like family
MAGIGRNMVAPLLVLNLIMYIIVIGFASWNLNHFINGQTNYPGVAGNGATFYFLVFAILAGVVGAASKLAGVHHVRAWRHDSLSTKRASSLIGWAITALALGLALQEIHHRRTPAAGALPLLERLSSSSIAF

SEQ ID NO: 33507 - DNA, 674 bp, Zea mays
  misc_feature: Ceres CLONE 1411402-F
  misc_feature: Encodes the peptide sequence at SEQ ID NO. 33508
  misc_feature (237)..(237): n is a, c, t, g, unknown, or other
  misc_feature (307)..(307): n is a, c, t, g, unknown, or other
  misc_feature (430)..(430): n is a, c, t, g, unknown, or other
  misc_feature (516)..(516): n is a, c, t, g, unknown, or other
  misc_feature (642)..(642): n is a, c, t, g, unknown, or other
  misc_feature (643)..(643): n is a, c, t, g, unknown, or other
tggagctccccgcggtggcggccgctctagaactagtggatcccccgggctgcaggaattcgcacgagaccattacctagaacatcctaatcgaaaaacctggccgctccatctcgcgtccaacaatcaattcggcgtcgctctcgtctcatcagtcatcactccgcgactgcgagcgagcgagcgaggcccttccgcgccacgcgcaatggacgctgctctgctcgtgaccgtccncgtcccccgcggtggcggcgctcctcgtcctcggagccgcgtccgcctcgccgccgcgcgccttcttcgntgttcggggactccctcgtggacaacggcaacaacaactacctcatgaccacggcgcgggccgacgcgccgccctacggggatcgacttccccacgcacctgcccaaggggggcgggtctccnacggggctcaacatcccccgacatcatcagcgagcacctcggctcccagccccgcgctgccgtacctcagccccgacctccgcggngaccagctggctcgtcggcgcccacttcgcgttccggcgggggcggcattctcaacgacaccgggataaagggtcgtgaccatccatcggatcggggcaggagttgcaccacttccaggataccannagaggttgggcggcgttcgtcgggacgaccc

SEQ ID NO: 33508 - protein, 77 aa, Zea mays
  misc_feature: Ceres CLONE 1411402-F
  misc_feature (27)..(27): Xaa is any aa, unknown, or other
MTTARADAPPYGDRLPHAPAQGGRVSXGAQHPPTSSASTSAPSPALPYLSPDLRGDQLARRRPLRVPAGAAFSTTPG

SEQ ID NO: 33509 - DNA, 640 bp, Zea mays
  misc_feature: Ceres CLONE 1411405-F
  misc_feature: Encodes the peptide sequence at SEQ ID NO. 33510
  misc_feature (332)..(332): n is a, c, t, g, unknown, or other
  misc_feature (425)..(425): n is a, c, t, g, unknown, or other
  misc_feature (446)..(446): n is a, c, t, g, unknown, or other
aaagctggagctccccgcggtggcggccgctctagaactagtggatcccccgggctgcaggaattcgcacgagaccattacctagaacatcctaatcgaaaaaatgcggcgcctccactttgcgatgcccgcgtcctcgctcccctccccatcctcctcatctaccgtgctctccattccccacccgctcccaccgccgctcgcagatgccgcccaaggtggtcgccgtcgccgcgggcgaggcccacacactcgccctcacgggtgacgggcaggtgtactcctggggcagggggccgttcggtcgcctcgggaacggccgcgaggacgancagctggtccccaccgcggtggcgccccgcgtctctgccagcgggacaccgcgggccaggttcctccccgtcgcggttggtgcctaccacagncttgcgctggaacgatgaggntcactctggtcatggggttaccatctctatggccaacttgggtatggggaccagattccctttttccatgtttcgttgagcaattccagggattaaggtcccctgaaacctcggaatggtgaagaccgaaccccccgtgtccgcactgggttggaagttgtcttcggcccagctggggggatgatggcccttgc

SEQ ID NO: 33510 - protein, 78 aa, Zea mays
  misc_feature: Ceres CLONE 1411405-F
  misc_feature (21)..(76): Pfam Name: RCC1 Pfam Description: Regulator of chromosome condensation (RCC1)
  misc_feature: SWISSPROT Homolog: EC 2.7.11.1 Non-specific serine/threonine protein kinase
  misc_feature (42)..(42): Xaa is any aa, unknown, or other
  misc_feature (73)..(73): Xaa is any aa, unknown, or other
MPPKVVAVAAGEAHTLALTGDGQVYSWGRGPFGRLGNGREDXQLVPTAVAPRVSASGTPRARFLPVAVGAYHXLALER

SEQ ID NO: 33511 - DNA, 790 bp, Zea mays
  misc_feature: Ceres CLONE 1411406-F
  misc_feature: Encodes the peptide sequence at SEQ ID NO. 33512
  misc_feature (8)..(8): n is a, c, t, g, unknown, or other
accccctnccccaccccccccccaccaattgggattgggggagttcatcgagctggtgctcaccgcggtggcgggcgctctagaatagtggatcccccgggctgcaggaattcgcacgagaccattacctagaacatcctaatcgaaaactttcctctccgatccggatctccccacccgctccggcgagccatcgccgcgtcgcctccacgcgaccgactacttctcatatcaatctatctatccggcttacccgccgccgcacgcaccaaggttgcgttcaccatattacctgtttgcttatcttctcccgaggccagcaaaccctagccgccgccacccatggacatagaggccgacggacgattcggcaacaaacgagtgcacaatcgcctaggcccgggggtccggcggcgctccaccatcgaccaacggaaagggctgcaactaactggcgtgccgggccggtgcaaccgctttccggggcccttcctccacagggagctccccgaggctgccggccggcccaaggagcccccactggacccggggcggaaggtatggcggcaaccccaacccccgtaggaccagggaggtgggcccaccacaactagaagggggggaaagggggccagggagggggcgcagcgggaaattgcggaggcccacgaagaccggccggaaaagggccccgtggagaggtacttttcctccgccgcggaacccgaaaagggggaacttcatggcggcgagagggggcggccccctaatcgccgaagcgggtgtagcg

SEQ ID NO: 33512 - protein, 80 aa, Zea mays
  misc_feature: Ceres CLONE 1411406-F
MDIEADGRFGNKRVHNRLGPGVRRRSTIDQRKGLQLTGVPGRCNRFPGPFLHRELPEAAGRPKEPPLDPGRKVWRQPQPP

SEQ ID NO: 33513 - DNA, 752 bp, Zea mays
  misc_feature: Ceres CLONE 1411409-R
  misc_feature: Translation starting site: 263
  misc_feature (30)..(30): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
gggggtacctcgccccccgcccctcctttnttttttnnnataaaaatttttccacgaatgggtacgggccccccctcgaggtcgacggtatcgataagcttttttttttttttttttaacaaaagtaatactactgtttaactagatgaaacttttgcccggcaagcacatacatacactacacacgactaggtaatgacacacatgctaacaacaggcatctatacgtaccgatcgacacgacgacacacacataatagacatgcacgacgaaatggtacatgcatgcgcagacgacgacaacaagaacattttaattagtacgaacacacacactctaaataggtacggtgacaagatgagagagagaaatagacacgtacgtacgggcccctgcatgcaccctgctgcagatgcacacacagacacgaacagctagcaatgcccgccgcctccccgcttggattggcttggctagcacactgctagcagtccggcggcgtggctaggacgcacttgtccggaaactccatggcgcgcttggggtcgaagatgtagacacccatccacggcgagttcttgtaaacacacaggcacttgaaggtccccccccccgccaagcgcgttggaagctagaactgcaaaaggcaccggaccggacgggatcccttcctcttttggacccgccgcagagtcttggtgatctaccataaaaactgccctccggtagcctaattgaaactgcaacactc

SEQ ID NO: 33514 - DNA, 774 bp, Zea mays
  misc_feature: Ceres CLONE 1411409-F
  misc_feature: Encodes the peptide sequence at SEQ ID NO. 33515
gctctacaactagtggatcccccgggctgcaggaattcgcacgagaccattacctagaacatcctaatcgaaaaatagcgaagcagcatcgagtacagtcggctaggtaatctggtggtacgacgacatggcggccaccaacagcaagtcgtcatcgtcctcgagctcggcgcagcgggcagctgccgcactgctcgtggacgccgccgtggcggagtccgtcctggtggtgggcgcggcgtagtggtgcgacatgaccagcgatcagttcatgtcgtgccagcccgcggcggccaagacgacggacccgccggccgcgccgtcgcaggcgagctgcaacgcactggcgagagaggacctcaagtgcctgtgcgtctactacaactcgacgtgtatgagcgtctacaacatcgtaccccaggcgcgacatgagagctaccggcccagtaggggactcgaccaagccgggcgactgctaggatcgttgctatgcaactcaatccgaggcatgaaagggccccggaatatggcagcttgacgttgtccgggttgggaaatttgcagcaaaggggaagggaagaggccagtccggaaaacgggccttttctccccccacaaatttgcccccgggagctattaaaagaggtggggcggccacaatctaaataaaaaaggcctatgtcaggccccaaaccttggatatgagcgaggcaaacatgagtgggtgtgccaacagagataaaaactggtggggtgggcgaggcggtcgcacaa

SEQ ID NO: 33515 - protein, 38 aa, Zea mays
  misc_feature: Ceres CLONE 1411409-F
MAATNSKSSSSSSSAQRAAAALLVDAAVAESVLVVGAA

SEQ ID NO: 33516 - DNA, 675 bp, Zea mays
  misc_feature: Ceres CLONE 1411417-F
  misc_feature: Encodes the peptide sequence at SEQ ID NO. 33517
ggccgctctagaactagtggatcccccgggctgcaggaattcgcacgagaccattacctagaacatcctaatcgaaaaaagatccgatctccctctctctccccaatcctccccgcctccccgcctccccctaccaaatcagcaccacccaaggcgcatccgagccacggccgcgcaatgccgccctctgtcgatgcaatgccggcccccggagacgccgcgggcggcggcgacgtgcgcatgatctcctccaaggagctccgctctcacgcgtccgccgacgacctctggatctccatctccggcgacgtgtacgacgtcacgccctggctcccccaccacccgggcggcgacctcccgcttctcaccctggtggggcaggacgccaccgacgccttcgccgcctaccacccgccctcggcgcgcccgctcctccgccgcttcttcgttggccgcctctccgactacgccgtctcccccgcgtccgccgactaccgccgtctcctcgcgcagctatcctccgcgggcctcatacaacgcgtcggccccacccccaaggcccagctcgtcctgatggccggcctcttctacggcgagctctacctcgtcctcgcctgcgccagcgcctgggcgcacctccctcccggagggtctcctcgggttcagctggatcca

SEQ ID NO: 33517 - protein, 166 aa, Zea mays
  misc_feature: Ceres CLONE 1411417-F
  misc_feature (22)..(95): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MPPSVDAMPAPGDAAGGGDVRMISSKELRSHASADDLWISISGDVYDVTPWLPHHPGGDLPLLTLVGQDATDAFAAYHPPSARPLLRRFFVGRLSDYAVSPASADYRRLLAQLSSAGLIQRVGPTPKAQLVLMAGLFYGELYLVLACASAWAHLPPGGSPRVQLDP

SEQ ID NO: 33518 - DNA, 728 bp, Zea mays
  misc_feature: Ceres CLONE 1411424-F
  misc_feature (242)..(242): n is a, c, t, g, unknown, or other
  misc_feature (353)..(353): n is a, c, t, g, unknown, or other
  misc_feature (424)..(424): n is a, c, t, g, unknown, or other
  misc_feature (434)..(434): n is a, c, t, g, unknown, or other
  misc_feature (453)..(453): n is a, c, t, g, unknown, or other
  misc_feature (454)..(454): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (494)..(494): n is a, c, t, g, unknown, or other
  misc_feature (508)..(508): n is a, c, t, g, unknown, or other
  misc_feature (535)..(535): n is a, c, t, g, unknown, or other
  misc_feature (551)..(551): n is a, c, t, g, unknown, or other
  misc_feature (552)..(552): n is a, c, t, g, unknown, or other
  misc_feature (555)..(555): n is a, c, t, g, unknown, or other
  misc_feature (556)..(556): n is a, c, t, g, unknown, or other
  misc_feature (561)..(561): n is a, c, t, g, unknown, or other
  misc_feature (565)..(565): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (601)..(601): n is a, c, t, g, unknown, or other
  misc_feature (602)..(602): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (622)..(622): n is a, c, t, g, unknown, or other
  misc_feature (623)..(623): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (635)..(635): n is a, c, t, g, unknown, or other
  misc_feature (636)..(636): n is a, c, t, g, unknown, or other
  misc_feature (639)..(639): n is a, c, t, g, unknown, or other
  misc_feature (643)..(643): n is a, c, t, g, unknown, or other
  misc_feature (645)..(645): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (686)..(686): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (728)..(728): n is a, c, t, g, unknown, or other
aagctggagctccccgcggtggcggccgctctagaactagtggatcccccgggctgcaggaattcgcacgagaccattacctagaacatcctaatcgaaaaagtgcccttctgtctcctatctccccggagtccccgctgcccagcccggtctcactttccagtctccgagactccgagtctcgctcgcaccccgtcccctgcagcctgtgctctgggttggagggaggtgagctgcgaggnagcgcggagggggcgaggagatggaggcagattcggcgaggaagagacttgcattgctggccctgcttctcctggcggcgcccgtccgcccggcctcggcgggtccgggtngaggatggcctgctcagcaatggtgactttgagacagcaccaagtgggggtttttgaaaaatctgcttctnttgctgaggntgcatccggcaatcctggnntggacgatcaacggcacgnnntgaactccatttcagcagncccaccaccaaggntggcattgatcgtggattggtccgcanggcggaccatgcagtnnagnntaagnagtngatggttnnnnnnnnnnnnnnngnnnaannnnaggnnaggttnnnaggnnnnnnatnncnnnnnnnncgnnacncggntntgnnnnnctnnnnnnnccnnnnnnnntnnnntggnnnntgngggnnnccnnnnnnnnnnnttggnnnnnnnnnnnnnnnnaan

SEQ ID NO: 33519 - DNA, 659 bp, Zea mays
  misc_feature: Ceres CLONE 1411427-F
  misc_feature: Encodes the peptide sequence at SEQ ID NO. 33520
  misc_feature (25)..(25): n is a, c, t, g, unknown, or other
aaagctggagctccccgcggtggcnggccgctctagaactagtggatcccccgggctgcaggaattcgcacgagaccattacctagaacatcctaatcgaaaactttttgctcggctgacaccaggtagccgcccctcctctatccaccccttcacttgcttggtcttccactcacccctctctcgttattcacccggtctcctctcctgcaaagaggtacgtaactgcactttcctgctcagtcttttgatcggtttcagtgatgcactgatgctgtagagtttcgtttctgttagtactctaatcaacggacaacggtttctgttagtattcttgggttcatggctgtctgcagattgtcgcccttgctctgcctgctctattcggcctcagttcattctgtcgtaaacctcacctcgtaactgaaataagccatatgcgccgcgcgtcgaagcttagtgtctgatcgatacgctatccctacaattttctgagctgttgaactcctgcgcccgtctcctcgtcgaggacaggaagatgagctcgctacacgccacacgagcggagcttggcctggttgtcctgtacctgaacaaagccgaggcccgggacaagatctgcagggcgatccagtacggctccaagttcgtaagcaacg

SEQ ID NO: 33520 - protein, 40 aa, Zea mays; identical to SEQ ID NO: 26625
  misc_feature: Ceres CLONE 1411427-F

SEQ ID NO: 33521 - DNA, 667 bp, Zea mays
  misc_feature: Ceres CLONE 1411428-F
  misc_feature: Encodes the peptide sequence at SEQ ID NO. 33522
  misc_feature (134)..(134): n is a, c, t, g, unknown, or other
  misc_feature (145)..(145): n is a, c, t, g, unknown, or other
  misc_feature (146)..(146): n is a, c, t, g, unknown, or other
  misc_feature (155)..(155): n is a, c, t, g, unknown, or other
  misc_feature (156)..(156): n is a, c, t, g, unknown, or other
  misc_feature (365)..(365): n is a, c, t, g, unknown, or other
  misc_feature (366)..(366): n is a, c, t, g, unknown, or other
aactggagtccccgcggtggcggccgctctagaactagtggatcccccgggctgcaggaattcgcacgagaccattacctagaacatcctaatcgaaaaaagcaaaaccctaagaaacccaccctccctccagntctcctcgacnnccccgccgnnccgccgccgccatcacaacccagagcaccccctccccaccccaccctgtcccgatggctgcggacgccgccgctgcggcgatgtccgcgacttccctctgcgacgatctcgagcccgccaccgtgcgcacccgcatccgcgatgtcctgggcgcaggtgccgcgcgtgccggggaccgcgtcgtggtcggtgggtgggtccggacgggnncggagcaggggaagggctcttttcgcttcctggagctcagcgacgggtcctgcgctgccacgcttcaaggcatcgttggacgcgccgtggacccgctagcggggcctcaccggcacggggaactccgtcctcgtcgagggcgggatcaaaggaaccgcccgaggggaccaagcaaaacgtcaaggctgaaggtcaaccccctggtttaagggccggaaagttaaatgcccccctttaacccgtttgccaaggggaaggggcaaactcccgcccccaaaaaactccggggaagccgttactt

SEQ ID NO: 33522 - protein, 121 aa, Zea mays
  misc_feature: Ceres CLONE 1411428-F
  misc_feature: SWISSPROT Homolog: EC 6.1.1.22 Asparagine--tRNA ligase
  misc_feature (53)..(53): Xaa is any aa, unknown, or other
MAADAAAAAMSATSLCDDLEPATVRTRIRDVLGAGAARAGDRVVVGGWVRTGXEQGKGSFRFLELSDGSCAATLQGIVGRAVDPLAGPHRHGELRPRRGRDQRNRPRGPSKTSRLKVNPLV

SEQ ID NO: 33523 - DNA, 646 bp, Zea mays
  misc_feature: Ceres CLONE 1411430-F
  misc_feature: Encodes the peptide sequence at SEQ ID NO. 33524
  misc_feature (437)..(437): n is a, c, t, g, unknown, or other
  misc_feature (438)..(438): n is a, c, t, g, unknown, or other
  misc_feature (518)..(518): n is a, c, t, g, unknown, or other
  misc_feature (602)..(602): n is a, c, t, g, unknown, or other
agagctggagctccccgcggtggcggccgctctagaactagtggatcccccgggctgcaggaattcgcacgagaccattacctagaacatcctaatcgaaaagccaactcgcacgcagcagtacgacgtctctcctctgggtctggggccgagacacctagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtatacatctccgtggcgnngctcaaggtgcgcagcatcgagatggtggcgcgctccgtgctcccccaggtctacgcgggcgacgtgcacccggagagcntggagggtgttcagctccttcggcaggcgctacgtcgtcacggccagccccagggtcatggtcgagcccttttcgcaggccttncctagcgccgacaaggtcgtcgggacccgagctggaggtccgca

SEQ ID NO: 33524 - protein, 141 aa, Zea mays
  misc_feature: Ceres CLONE 1411430-F
  misc_feature: SWISSPROT Homolog: EC 2.3.1.15 Glycerol-3-phosphate O-acyltransferase
  misc_feature (87)..(87): Xaa is any aa, unknown, or other
  misc_feature (114)..(114): Xaa is any aa, unknown, or other
MVASPRFKPIEECCSEGRSEQTVAADLDGTLLISRSAFPYYLLVALEAGSVLRAALLLLSVPFVYVTYAFFSESLAISTLVYISVAXLKVRSIEMVARSVLPQVYAGDVHPESXEGVQLLRQALRRHGQPQGHGRALFAGL

SEQ ID NO: 33525 - DNA, 771 bp, Zea mays
  misc_feature: Ceres CLONE 1411435-F
  misc_feature: Encodes the peptide sequence at SEQ ID NO. 33526
  misc_feature (36)..(36): n is a, c, t, g, unknown, or other
  misc_feature (37)..(37): n is a, c, t, g, unknown, or other
  misc_feature (542)..(542): n is a, c, t, g, unknown, or other
  misc_feature (583)..(583): n is a, c, t, g, unknown, or other
  misc_feature (648)..(648): n is a, c, t, g, unknown, or other
  misc_feature (649)..(649): n is a, c, t, g, unknown, or other
  misc_feature (670)..(670): n is a, c, t, g, unknown, or other
  misc_feature (690)..(690): n is a, c, t, g, unknown, or other
  misc_feature (691)..(691): n is a, c, t, g, unknown, or other
  misc_feature (700)..(700): n is a, c, t, g, unknown, or other
  misc_feature (740)..(740): n is a, c, t, g, unknown, or other
  misc_feature (741)..(741): n is a, c, t, g, unknown, or other
cacacaaaccaagcaaccaacaaaggcaccccaccnnggccccccaaaaagctggagctccccgcgggggcggccgctcttttactaaggatcccccgggctgcaggatttcgcacgagaccattacctagaacatcctaatcgaaaaacatcgacccaggcatttcctcaccctcgtgcaccacacagtccgccgctcctttagtagcttgtgatttgtacgccgacgagatcactgggcgggtggaggacgacgacacatggggaagggtagtgtgggtgcatcatggtgggcgtgcctcctgctcgccggcgtgctgctggtcgtagcagccacggccggggcggaggacggagtggtcctaacgggaccgcaaggaggacctgcggtggtgcaagcaggcgtgtgagtggcagtacggaaaggacaccccgcggaagagggaatgcgagagcgagtgctcggagcggcaccatcaagctgacgcgggcgaggacggcgacagcgtcgtggacgcctacgtctcccgctccgggagggncgagagccggcgccagtgcctgcgggcgagaggagggccanccccgggaaacccacgaatgcaggaagcggggccgacgccgcggactgggcggccacagggagtnngagcacggccgcgggccgcgntagcgcgtgcaatcgccggnnaaaggtggnaaccgccaccaccgacggggaatggtggggaagagggcgnntctgacctgaaggaacctgcaaagagccgc

SEQ ID NO: 33526 - protein, 49 aa, Zea mays
  misc_feature: Ceres CLONE 1411435-F
MGKGSVGASWWACLLLAGVLLVVAATAGAEDGVVLTGPQGGPAVVQAGV

SEQ ID NO: 33527 - DNA, 803 bp, Zea mays
  misc_feature: Ceres CLONE 1411437-F
  misc_feature: Translation starting site: 238
  misc_feature: SWISSPROT Homolog: EC 1.4.1.2 Glutamate dehydrogenase
aacaccacacacacataagagataggccgcctggccacacaaccccacacccaaaccggcaactcaccggggagcgggaccgctctatgccaaaggagcccccgggctgcaggaattcccacgagaccattacctagaacatcctaatcgaaactctcgaaacccgagttttttgccccattctcagccgccgccaatcccttcccgtgatccgcaaccgctgagcgagaagaagagatggccggcaaaggcgatggcccggctatcggcatcgatctcggcacgacgtactcttgcgacggagtgtggcagcacgaccgcggccagatcattgccaacgaccagggtaaccgcaccacggcctcgtacgtcgccttcaccgactccgagcgcctcatcggagatgcggtttataatcaggccgccaagacccccatcaacaccgtctttgatgccaagcgtctcatcggcaggaggatcagagatgcgtctgtccagagtgatatcaagtcgtggccctccaaggccattcctgaggctggtgacaagccaatgactgtaggccagcaaaagaggagacgcaaagcaactttgaaaccgaagagaactcctctaaggaccaaaacaagaagccgggaaaaagggggaagacataccttggcgaagcaccatccagaaaagcctggggaccacagacccccggcccaacattaagatggacctcaccaaagggaaggtccccaaaaagggaaagcaggacggagaaattcgctgggctcactaaaagggcgctgggaaaatag

SEQ ID NO: 33528 - DNA, 748 bp, Zea mays
  misc_feature: Ceres CLONE 1411438-F
  misc_feature: Encodes the peptide sequence at SEQ ID NO. 33529
  misc_feature (480)..(480): n is a, c, t, g, unknown, or other
  misc_feature (502)..(502): n is a, c, t, g, unknown, or other
  misc_feature (521)..(521): n is a, c, t, g, unknown, or other
  misc_feature (554)..(554): n is a, c, t, g, unknown, or other
aaagctggagctccccgcggtggcggccgctctagaactagtggatcccccgggctgcaggaattcgcacgagaccattacctagaacatcctaatcgaaaaacaccaacaaaccaaacaccatccgccacgaccacgactccacgagagagcggaggaggagggggagcaatggcagagccgggccagcagttgctgcggtcgttcgtggaggtggcagcgggctcgcacttccctatccagaacctgcccttcggggtcttccgccggcgggggtcgccaccgcaggctccgctccccccggtggccatcggggacttcgcgctcgacctcgccaccgtcgccgacgcgggtctcttcgacgggcccgcgctctccggctccccgtgcttccacccagagacgctcaacatgtttcttggggatgggccgaccggcgtggagggaggcgcgcgccacgctacaaaaaatcctctcagncgacgagccagttctgcgtgancacgaagccctgaggaatnaatggcttattcaatgagtgatatcgagatggntctacccatcacggttggagggtacccagatttcttttgtctggggcccatggaagaattggcgattcctttccggggggccgaaactccggtatccccattgggttttattttccaaagggaaaaagggcccggatttttcttttgtggggttggaacccgttaatttaggcccagggaaggggtttcccagg

SEQ ID NO: 33529 - protein, 109 aa, Zea mays
  misc_feature: Ceres CLONE 1411438-F
  misc_feature (11)..(107): Pfam Name: DUF1969 Pfam Description: Domain of unknown function (DUF1969)
  misc_feature: SWISSPROT Homolog: EC 3.7.1.2 Fumarylacetoacetase
  misc_feature (103)..(103): Xaa is any aa, unknown, or other
MAEPGQQLLRSFVEVAAGSHFPIQNLPFGVFRRRGSPPQAPLPPVAIGDFALDLATVADAGLFDGPALSGSPCFHPETLNMFLGDGPTGVEGGARHATKNPLXRRASSA

SEQ ID NO: 33530 - DNA, 642 bp, Zea mays
  misc_feature: Ceres CLONE 1411440-F
  misc_feature (280)..(280): n is a, c, t, g, unknown, or other
  misc_feature (397)..(397): n is a, c, t, g, unknown, or other
  misc_feature (558)..(558): n is a, c, t, g, unknown, or other
aagctggagctccccgcggtggcggccgctctagaatagtggatcccccgggctgcaggaattcgcacgagaccattacctagaacatcctaatcgaaaagagtaatttctcgtcttgtttcggctagggagcggggtggcttctccggccaaggctttcacagttttgtgtttgttgaatggtttgcaatggagattgaagacacacagattcactttcaatagaggaaccatcacaggctcccaccagatattattgaggggatacttctcaggcttncggtaaactctctaatggagctgcgtcaagtctgcaagcaatgggtgaacatggtcagcgtgccccgctttatcaaagaacatgcctatcatgcacccaagcacctcctcctttacnttgctaagttgaatatatctgcatcgctccatccaaagactgccaaaccatgtcttgcaacaatcattaatgaaaagtggtctccattgacatgggcctcatcgcatatggaccctgatgatcacctcttgcatcatgcaacgggttgctttgcttctacnagacatacacactaaagatatctaaccctggcacaggtcaatgcctgcatctcttgaacctgacgggatattggtggacgactt

SEQ ID NO: 33531 - DNA, 648 bp, Zea mays
  misc_feature: Ceres CLONE 1411443-F
  misc_feature: Encodes the peptide sequence at SEQ ID NO. 33532
  misc_feature (261)..(261): n is a, c, t, g, unknown, or other
  misc_feature (264)..(264): n is a, c, t, g, unknown, or other
  misc_feature (265)..(265): n is a, c, t, g, unknown, or other
  misc_feature (270)..(270): n is a, c, t, g, unknown, or other
  misc_feature (271)..(271): n is a, c, t, g, unknown, or other
  misc_feature (286)..(286): n is a, c, t, g, unknown, or other
  misc_feature (287)..(287): n is a, c, t, g, unknown, or other
  misc_feature (368)..(368): n is a, c, t, g, unknown, or other
  misc_feature (407)..(407): n is a, c, t, g, unknown, or other
aaagctggagctccccgcggtggcggccgctctagaactagtggatcccccgggctgcaggaattcgcacgagaccattacctagaacatcctaatcgaaaactctcatccgaattcccaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttctttgcggncgnngcccnnactcgcccctctctnnctcagggggatcggatacgccacaggctgcgcgatggtgctgtgggtcttcggctacggctccctcatctggaaccccggnttcgacttcgacgaacaaatcctcgggttcatcaggggntacaagggaacttttaactcccctggcattgacccccgaagcccacccggagcatccggggagggacctggacccgttgaacccaaaaaccaggccttatgctggggaaatggcaatttgggccaaagggggggccccaaaaaaaggtttaaaggcatacccctcccttggaaaaaaaaaaaagggggggtccaccccccaaaaaatccctttgggtttttccaagggggggagaaaccct

SEQ ID NO: 33532 - protein, 109 aa, Zea mays
  misc_feature: Ceres CLONE 1411443-F
MVLWVFGYGSLIWNPGFDFDEQILGFIRGYKGTFNSPGIDPRSPPGASGEGPGPVEPKNQALCWGNGNLGQRGGPKKRFKGIPLPWKKKKGGVHPPKNPFGFFQGGEKP

SEQ ID NO: 33533 - DNA, 598 bp, Zea mays
  misc_feature: Ceres CLONE 1411444-F
  misc_feature (393)..(393): n is a, c, t, g, unknown, or other
aagctggagctccccgcggtggcggccgctctagaactagtggatcccccgggctgcaggaattcgcacgagaccattacctagaacatcctaatcgaaaaaaccatattattgagaccaacaagcaacatagaaagtggaatacagtagcaacaatagagcaacaatggcggccaagatattttccatccttatgctccttgctctttctgcatgtgttgctaacgcgaccatttttcctcaatactcacaagctcctatagctgcccttcttcccccataccttccatcaatgaccgcttcagtatgtgaaaacccagcccttcaaccctacaggctccaacaagcaatcgcaacaagcaacttacctttatcacccctggtcttttcacnatcgccagccctatctttggtgcagtcattggaacaacccattcaggaaccaaaggtggcagcaacccggggtaccaggggtcccagcaagaagctctgggaaaacttttccccctatctccaaaaaaaaatattttttcccattttaacccaatgggtaaaacacggagaaccccctgggtgggtttttttttttttaaaaaaa

SEQ ID NO: 33534 - DNA, 644 bp, Zea mays
  misc_feature: Ceres CLONE 1411451-F
  misc_feature: Translation starting site: 303
  misc_feature (581)..(581): n is a, c, t, g, unknown, or other
aagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggncttgtagctgtccagcgccgcgtccacctcggcgtccgcggctcctagccgggccgccctgag

SEQ ID NO: 33535 - DNA, 640 bp, Zea mays
  misc_feature: Ceres CLONE 1411453-F
  misc_feature: Encodes the peptide sequence at SEQ ID NO. 33536
  misc_feature (391)..(391): n is a, c, t, g, unknown, or other
  misc_feature (401)..(401): n is a, c, t, g, unknown, or other
  misc_feature (604)..(604): n is a, c, t, g, unknown, or other
aaagctggagctccccgcggtggcggccgctctagaactagtggatcccccgggctgcaggaattcgcacgagaccattacctagaacatactaatcgaaaaatccgttgatcccatcggcttccccttcctcttcctcgatccccttcctcccccgatcccatccaattccacttccacaccccgggcctcgccgccgacgccgacgccgacgccgccggccatgtccaagtacggcaccattcccacctcctcctccgcgggcggagggcccgtgcccctcggcggcgcctccccgctcgatttcatctcccgcgccaaggctcggggcgcctcggcgctggcgacgcgccggccctggcgcgagctcgtggacgtccacgccgtcggnctgcccccgnaagctcgcgacgcgtacctcggcgtgggcgccaccctcgcccacttcgccatggaactacgccaatcggcggtcctaggcggcggctttccttctcctccttttggaaccccgtctcccccaatcggttttcccgttggaatgttcgcttgggtcggccttaaatttccccgggaggagccccctcgccctttcggggggggngttccccaaaggttacctccccccggggtcggcggg

SEQ ID NO: 33536 - protein, 139 aa, Zea mays
  misc_feature: Ceres CLONE 1411453-F
  misc_feature (60)..(60): Xaa is any aa, unknown, or other
MSKYGTIPTSSSAGGGPVPLGGASPLDFISRAKARGASALATRRPWRELVDVHAVGLPPXARDAYLGVGATLAHFAMELRQSAVLGGGFPSPPFGTPSPPIGFPVGMFAWVGLKFPREEPPRPFGGGVPQRLPPPGVGG

SEQ ID NO: 33537 - DNA, 652 bp, Zea mays
  misc_feature: Ceres CLONE 1411454-F
  misc_feature: Encodes the peptide sequence at SEQ ID NO. 33538
  misc_feature (348)..(348): n is a, c, t, g, unknown, or other
  misc_feature (403)..(403): n is a, c, t, g, unknown, or other
  misc_feature (404)..(404): n is a, c, t, g, unknown, or other
  misc_feature (585)..(585): n is a, c, t, g, unknown, or other
  misc_feature (586)..(586): n is a, c, t, g, unknown, or other
aaagctggagctccccgcggtggcggccgctctagaactagtggatcccccgggctgcaggaattcgcacgagaccattacctagaacatcctaatccaaaagaaataaaggactatctcagcgatttccgaaccctccccacccccacacccacccgatccaaccgagtcccggcggcgatggcggcggcggcgacgaacgccgatgtggaggtggtcgacttcgacctcgatgacgacgacctcatggacgaggacgccgggccggatccagcaccgccccccgcctcccgcctccgtccaaccatcgggggcgacgacgcgccgcgtaggaccaagggccgcggncttccgcgaggaccctaactcctccgcgacccgcgactcgcggtttttggcgcgnngggacgcgccgacctcgactcgcttggcggccctggacccattccagtgtacgtctacccttctcttttcaatttttttctcaaagatttgcttgaaccgattattattttctttttgcaacgtagtactgaggctgaggcagtaatactttccgttttgggtgactggatggctatgtannttagtatttgtgctgcctagactattgccttctcctggtgaattgcgggaaatgggggtattccac

SEQ ID NO: 33538 - protein, 61 aa, Zea mays
  misc_feature: Ceres CLONE 1411454-F
MAAAATNADVEVVDFDLDDDDLMDEDAGPDPAPPPASRLRPTIGGDDAPRRTKGRGLPRGP

SEQ ID NO: 33539 - DNA, 723 bp, Zea mays
  misc_feature: Ceres CLONE 1411456-F
  misc_feature: Encodes the peptide sequence at SEQ ID NO. 33540
cgctcatacacaaaggatcccccgggctgcaggattccccacgagaccattacctagaacatcctaatcgaaaactaccgagttttccttcttcacctccccgccccacccgtcgccgaatcggagtcccgctcgcgtccacccttgccagagctcaagagctacctcctggtccggttggacagatcccttcgggcgctgcgtccaccgggattcaggcaaagtggtgtaacataagatgcaagggggaagaggtgggaggcagggtttgttcggttttggggacccttttgttggtttcggcggctttggacagccaggcaacataatgtccggtttctttggtggcgcaaatccctttgatgaccctttcttcacaaacccctttggtggcatgatgcaacctagtttctcaacccctttcagcggcatgatgcaacctagcttcatgaacccctttggtagcatgatgcaacctagcttgcttggatcaagtatgtttgcagcccatggcaatctcaatggaggcacttttggaagccagacacatctcaatcaagggatgagcaatggcaggggtttcattcagcaagcctctgaatcgagcagggctagagggccaattaatcaggagttgtcttcagattgccgaggataaccgcgaggatggttaagaaagattgccagaaggaatgctaactttagggaagcctcccagggaaa

SEQ ID NO: 33540 - protein, 139 aa, Zea mays
  misc_feature: Ceres CLONE 1411456-F
MQGGRGGRQGLFGFGDPFVGFGGFGQPGNIMSGFFGGANPFDDPFFTNPFGGMMQPSFSTPFSGMMQPSFMNPFGSMMQPSLLGSSMFAAHGNLNGGTFGSQTHLNQGMSNGRGFIQQASESSRARGPINQELSSDCRG

SEQ ID NO: 33541 - DNA, 637 bp, Zea mays
  misc_feature: Ceres CLONE 1411457-F
  misc_feature: Encodes the peptide sequence at SEQ ID NO. 33542
  misc_feature (258)..(258): n is a, c, t, g, unknown, or other
  misc_feature (358)..(358): n is a, c, t, g, unknown, or other
  misc_feature (414)..(414): n is a, c, t, g, unknown, or other
  misc_feature (435)..(435): n is a, c, t, g, unknown, or other
  misc_feature (439)..(439): n is a, c, t, g, unknown, or other
  misc_feature (440)..(440): n is a, c, t, g, unknown, or other
aagctggagctccccgcggtggcggccgctctagaactagtggatcccccgggctgcaggaattcgcacgagaccattacctagaacatcctaaaaaaaaaaatatctcgccgttcccatggacatcgacctcttccccgacatcgaccttgacgccctcctcgcctccttctccggcgaccccgccgccgtctccggcctcatcatcccgtccccgcctccgccggcgccggcgacggcgcacgatgcggaggcggngtcgccggagtcggtgacctcccggacgaacccgctcggggaggtggcgctctcggagatcgaagttccctggatgcaggaggggaaggcgaaactgggncggggaggtcgatgggatcagcgtggaccagttcttcgacgcgctgtacgacggcnaggaggcgaaaggtgagcggnaggnncgggcaagcgcggatgtggactccggcagggacgatgtgctggaagtcgtgacgccagaggcgggaacggggaagggggatggcaatgatcccatcagaaagaaaaagaggaggcaatgaggaacagagatccgccatgaatccagggaaaggaaaaaagtctacctaaaggacttggagacaagagcagcacttgg

SEQ ID NO: 33542 - protein, 103 aa, Zea mays
  misc_feature: Ceres CLONE 1411457-F
  misc_feature (47)..(47): Xaa is any aa, unknown, or other
  misc_feature (99)..(99): Xaa is any aa, unknown, or other
MDIDLFPDIDLDALLASFSGDPAAVSGLIIPSPPPPAPATAHDAEAXSPESVTSRTNPLGEVALSEIEVPWMQEGKAKLGRGGRWDQRGPVLRRAVRRXGGER

SEQ ID NO: 33543 - DNA, 663 bp, Zea mays
  misc_feature: Ceres CLONE 1411459-F
  misc_feature: Encodes the peptide sequence at SEQ ID NO. 33544
  misc_feature (448)..(448): n is a, c, t, g, unknown, or other
  misc_feature (507)..(507): n is a, c, t, g, unknown, or other
  misc_feature (530)..(530): n is a, c, t, g, unknown, or other
  misc_feature (539)..(539): n is a, c, t, g, unknown, or other
  misc_feature (578)..(578): n is a, c, t, g, unknown, or other
  misc_feature (603)..(603): n is a, c, t, g, unknown, or other
  misc_feature (635)..(635): n is a, c, t, g, unknown, or other
  misc_feature (663)..(663): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtgacgccgctcctggtgctcaacctcatcatgtacatcatcgtcatcggcttcgcgagctggaacctgaaccacttcatncacgggcagaccaactaccccggcgtggccggcaacggcgcgacgttctacttcctggntgtcgccatcctgcccggcgtgntgggcgcgncgtccaagctggcgggcgtgcaccacgtgcacgcctggncgcacgacagcctggccaccaacgncgcgtcgtcgctcatcgcctggggcatcacgncgctcgccttcgggctggcctgcaagan

SEQ ID NO: 33544 - protein, 106 aa, Zea mays
  misc_feature: Ceres CLONE 1411459-F
  misc_feature (14)..(106): Pfam Name: AWPM-19 Pfam Description: AWPM-19-like family
  misc_feature (35)..(35): Xaa is any aa, unknown, or other
  misc_feature (55)..(55): Xaa is any aa, unknown, or other
  misc_feature (63)..(63): Xaa is any aa, unknown, or other
  misc_feature (66)..(66): Xaa is any aa, unknown, or other
  misc_feature (79)..(79): Xaa is any aa, unknown, or other
  misc_feature (87)..(87): Xaa is any aa, unknown, or other
  misc_feature (98)..(98): Xaa is any aa, unknown, or other
MAGIGRNMVTPLLVLNLIMYIIVIGFASWNLNHFXHGQTNYPGVAGNGATFYFLXVAILPGVXGAXSKLAGVHHVHAWXHDSLATNXASSLIAWGITXLAFGLACK

SEQ ID NO: 33545 - DNA, 633 bp, Zea mays
  misc_feature: Ceres CLONE 1411460-F
  misc_feature: Encodes the peptide sequence at SEQ ID NO. 33546
  misc_feature (414)..(414): n is a, c, t, g, unknown, or other
  misc_feature (513)..(513): n is a, c, t, g, unknown, or other
  misc_feature (514)..(514): n is a, c, t, g, unknown, or other
aaagctggagctccccgcggtggcggccgctctagaactagtggatcccccgggctgcaggaattcgcacgagaccattacctagaacatcctaatcgaaaactctctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttnggtgtaatctgcctggcggatcagctcctgcggcagctgctcctgcggatgaggctgaggacgatgatgaccttgatctttttggtgatgaaactgganngagaacaagaggcagctgatgagcggtgccgccgctgcccaagccctcttcttaaaagaaaagaaggggggaaatccctccgtcccttatggaatggccaaacccatggggaccgatgg

SEQ ID NO: 33546 - protein, 112 aa, Zea mays
  misc_feature: Ceres CLONE 1411460-F
  misc_feature (74)..(74): Xaa is any aa, unknown, or other
  misc_feature (107)..(107): Xaa is any aa, unknown, or other
MAVFSDLHTADGLKSLEAHLAGKTYVSGDSITKDDIKVFAAVPSKPGAEFPNAARWYETVSAAVASRFPGKAVXCNLPGGSAPAAAAPADEAEDDDDLDLFGDETGXRTRGS

SEQ ID NO: 33547 - DNA, 667 bp, Zea mays
  misc_feature: Ceres CLONE 1411461-F
  misc_feature (667)..(667): n is a, c, t, g, unknown, or other
aagctggagctccccgcggtggcggccgctctataactagtggatcccccgggctgcaggaattcgcacgagaccattacctagaacatcctaatcgaaaaaatgaccattgcgtgatagatcgcaccggtctcggtctccgtgtctcactctcaagttgcagcagccagtcatttcgttggcaaccagggcagaaataaatatccgtggataagagctgcgctgtgtgctgctgagatatcaagaacggtagggtggaagacaaggccccgttctcgattaccccaagccaaagagtcagaggtagagagagagagagagtcgtattggtcgtcaccctgtcgaaggttttcggtgtctcctgagccacagctgctgctgctggtggaacccatgaagatggaggccgtgaagttccacggcggtgccggtcgcccaacggccaagagggatcgcggattctcctgcgcctggcgtctccatccctgggcgagaaaatggcttccaggtcatcccccaacttcgccggtggccaacaaacctgggggaactaccccaagggaccgccctgaaccagggggagacaaaagcccccggccgacggggctccaccaattggaagggggaaggaggcgcctttcccgcccgcctcggaggccggcttttn

SEQ ID NO: 33548 - DNA, 601 bp, Zea mays
  misc_feature: Ceres CLONE 1411462-F
  misc_feature: Encodes the peptide sequence at SEQ ID NO. 33549
  misc_feature (369)..(369): n is a, c, t, g, unknown, or other
tggagctccccgcggtggcggccgctctagaactagtggatcccccgggctgcaggaattcgcacgagaccattacctagaacattctaatcgaaaaatcgctgcgtccaccttctgtagtccagttgtagccgcttgccgatggcgcggccggcggcgaaggcgcgggtgccgaagcacttggtggcgctcgccgtcgtcgccatcctcggcctcgtactcgtcgctgactacctctgggcttcgtcctccgcgtcgtcctcggccgtctggtcctccaggcttaatctccacaccggacccgccggttcgacgccgcccgtcgcgaagaagattaaggaggacaagaaatctgtaggttcgactggncataatgcagctgttgcggacttgccagctccagaactgaaatgggaggagatggctgaagcacctgtggcccgtttggatggcgctgctatacagattaagaatctcttatatgtatttgctgggtatggcaccattaaacatgtgcattctcatggtgatatatacaatttctcgataatactggggggtggaagattgacatgcccgaagacatgcacatcactttttg

SEQ ID NO: 33549 - protein, 153 aa, Zea mays
  misc_feature: Ceres CLONE 1411462-F
MARPAAKARVPKHLVALAVVAILGLVLVADYLWASSSASSSAVWSSRLNLHTGPAGSTPPVAKKIKEDKKSVGSTGHNAAVADLPAPELKWEEMAEAPVARLDGAAIQIKNLLYVFAGYGTIKHVHSHGDIYNFSIILGGGRLTCPKTCTSLF

SEQ ID NO: 33550 - DNA, 645 bp, Zea mays
  misc_feature: Ceres CLONE 1411467-F
  misc_feature (184)..(184): n is a, c, t, g, unknown, or other
  misc_feature (262)..(262): n is a, c, t, g, unknown, or other
  misc_feature (399)..(399): n is a, c, t, g, unknown, or other
ccccagagctggagctccccgcggtggcggccgctctagaactagtggatcccccgggctgcaggaattcgcacgagaccattacctagaacatcctaatcgaaaaacactacatcccacctacctcctcgcatcaggcaggcgggcctcgcgtttataagccacccttcctctcctccacggncctcgccctgcaaagcacagacacaaaccacgagcgcgaggcacgacctacatcgaatcggccacgaaccaccatggnggcctcacgcgcgctcctccccagcccgcaggtgagccctgcgagcgcgcggttcccgctggccgcggccgcggcgccatcgctcacgctcgcgatgggccgcggaacccgccccgagggggggggccaattctttnaccgattttaacaacaccccgcgcccaagcccccccccgaacgcaagcccaacccccccctcccccccccccacgcgcccgaggggctttaaagcccaagcccaacaggcgctgaaacccgaaaaccacaccaccccctccccccgaacccacaaaaataccccacaaaccgaccaagataccaccgcacgcaacccacggcaacaatacactccgtattgcggccttgcctggctcccacgtgcg

SEQ ID NO: 33551 - DNA, 628 bp, Zea mays
  misc_feature: Ceres CLONE 1411471-F
  misc_feature: Encodes the peptide sequence at SEQ ID NO. 33552
  misc_feature (413)..(413): n is a, c, t, g, unknown, or other
  misc_feature (534)..(534): n is a, c, t, g, unknown, or other
ggagctccccgcggtggcggccgctctagaactagtggatcccccgggctgcaggaattcgcacgagaccattacctagaacatcctaatcgaaaaaaccgcagcagggcgttgggcgagtgagtgagtcagtgaggctgggatagcagcagcagcatcagtgcgccgcactcaacttctcttcttgccgtgcggtgcggcgcggcgcgactaggcaccgcacggccgcaagcaatgccgcgccggcagaggacgcgcagcaacgaggagctcaaggcggaggacttcgtcgactcggtgctcaacttccatgacgaggaggaggatgttcaacaggataaacaggagggcgtcggagacggtcaggcggcgtcggagttcaagtccaagaacctgcgagccgagcgtaagcngagcggtaagctcaaccgtaacatcctcgcgctcaggtacgtggtgcccgacatctccaagatgagcaaggagccaccctctcgaacgctagtcgactcatcgagaagctccagaccatgntcattgagatggagggccagatcagacgattccccgggaaaaagcctgggaaaaaccaagaaaagggcggcgcgggccccaaaacccttccccg

SEQ ID NO: 33552 - protein, 131 aa, Zea mays
  misc_feature: Ceres CLONE 1411471-F
  misc_feature (60)..(60): Xaa is any aa, unknown, or other
  misc_feature (100)..(100): Xaa is any aa, unknown, or other
MPRRQRTRSNEELKAEDFVDSVLNFHDEEEDVQQDKQEGVGDGQAASEFKSKNLRAERKXSGKLNRNILALRYVVPDISKMSKEPPSRTLVDSSRSSRPXSLRWRARSDDSPGKSLGKTKKRAARAPKPFP

SEQ ID NO: 33553 - DNA, 673 bp, Zea mays
  misc_feature: Ceres CLONE 1411472-F
  misc_feature: Encodes the peptide sequence at SEQ ID NO. 33554
atagctggagctccccgcggtggcggccgctctagtactagtggatcccccgggctgcaggaattcgcacgagaccattacctagaacatcctaatcgaaaagtcgcgccgccgctcccctcccaacccactagctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggacggctactctggcgtggaggtgcgcgtcacgccgatgcgcacggagatcatcatccgcgccacgcgcacgcagaacgtgctcggcgagaagggccgtaggatcagggagctcacctccgtcgtccagaagaggttcaacttccctgagaatggcgttgagctttatgccgagaaggtcgtcaaccgtgggctctgtgccatcgcgcaggccgagtccctccgttacaagctcctcggtgggcttgcccgtcccgcagggcttgctaacgggggtccttcgttatggtattggaaaagggggcccaaggttggaagggatcctaatggaaagtcagggcccaaaaacccgccctgaaattcagggaggtaccgg

SEQ ID NO: 33554 - protein, 149 aa, Zea mays
  misc_feature: Ceres CLONE 1411472-F
  misc_feature (45)..(102): Pfam Name: KH_2 Pfam Description: KH domain
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLARPAGLANGGPSLWYWKRGPKVGRDPNGKSGPKNPP

SEQ ID NO: 33555 - DNA, 731 bp, Zea mays
  misc_feature: Ceres CLONE 1411478-F
  misc_feature (20)..(20): n is a, c, t, g, unknown, or other
  misc_feature (94)..(94): n is a, c, t, g, unknown, or other
  misc_feature (95)..(95): n is a, c, t, g, unknown, or other
  misc_feature (97)..(97): n is a, c, t, g, unknown, or other
  misc_feature (513)..(513): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (673)..(673): n is a, c, t, g, unknown, or other
  misc_feature (678)..(678): n is a, c, t, g, unknown, or other
  misc_feature (679)..(679): n is a, c, t, g, unknown, or other
  misc_feature (685)..(685): n is a, c, t, g, unknown, or other
  misc_feature (686)..(686): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (699)..(699): n is a, c, t, g, unknown, or other
  misc_feature (714)..(714): n is a, c, t, g, unknown, or other
  misc_feature (723)..(723): n is a, c, t, g, unknown, or other
  misc_feature (725)..(725): n is a, c, t, g, unknown, or other
ttggggtttggtttcccccncccccccccgtccgcccgttctgggcccccgagggttcccaccggcgccgaagaacccgccccccggaagggannanaatgatgggtcctccccgcggtggcggccgctctagaactagtggatcccccgggctgcaggaattcgcacgagaccattacctagaacatcctaatcgaaaaacagaaccctgcaactgcaagctaaggagagtgtgatcaccaacagctagtgctagtcccccttccttccatccatccatggcatgcgtcagcaccttccagagctgccccattgccagaagagcaaagatcaacacgaggtccaggggctgcagcagtagcgtggcgaaggggtcatcaccaccagccttccagttccagtgcagggcgtcgactttcgcgggggacaccagccctccggctcgagctggacgagaaccccgagggcgatcatctcgggggcgtggccccgggaactggctccctcctcagnctacgacgacctccgcgccctacctcgagtcgcagggagacggccggccccaggcagaacggtcagcagccgcggcggtgccgctccctgaggcgagacccatgtccaccccccggggctggtgggccacagcaagacccagacccctggcgcgnnnttnattgnngcgccnncccctggnnnagnagaaaagggccgggnagatgtcgncncttgtg

SEQ ID NO: 33556 - DNA, 654 bp, Zea mays
  misc_feature: Ceres CLONE 1411479-F
  misc_feature (263)..(263): n is a, c, t, g, unknown, or other
  misc_feature (294)..(294): n is a, c, t, g, unknown, or other
  misc_feature (298)..(298): n is a, c, t, g, unknown, or other
aaagctggagctccccgcggtggcggccgctctagaactagtggatcccccgggctgcaggaattcgcacgagaccattacctagaacatcctaatcgaaaaaaaaaaccctatcccagtaaacgccgcggctccttccgctaccaccttcatccatcctggcgtcggtgtcttgccctgccccagcgccgccgctccttcccccaccccgaagcgccgcctcttctgcctccgtcgacggtggtggtgctcctgatccccgnccgttggaacctgggccataagggaaaagcnaaanaaaggaaaggggaagccccaaggcgcccagaaaaaatttcaccttcccccgggttggcaattttttgaatttccaaccccaatgaaaggggcaaaggccttttccccccaaaaaaaacccccccccccgcccccccatttgggggggggctttattacccccgggggggggatccccccccccccttttggtttgaccccccccccccccccccaaaaaaaccccccccggtggagaaaccccccccccgccggtgggggggggacaaaattttttgtgaccccccccccccggagcgtttttttaaaaaccccccccccccccacaaaaaggggggggagacccctccttccccc

SEQ ID NO: 33557 - DNA, 731 bp, Zea mays
  misc_feature: Ceres CLONE 1411480-F
  misc_feature: Encodes the peptide sequence at SEQ ID NO. 33558
gagctccccgcggtggcggccgctctataatagtggatcccccgggctgcaggaattcgcacgagaccattacctagaacatcctaatcgaaaaactccaccctccctccctctctctctctctctccacctccaccaccagcacccaccatcccggctcgaagaccgcttccctccctccgctccacccccgcaaccctctcccgccgcgcacgcgccaccttccattcctccgctccccgcttcctcccaatcttaaccacccgccgcgccccctcccgccacccggcttcctctccccctcttcttcctccctcaaaccagacgctcgccccccatttccccatctcttcttcttcttccccatccagaggaggaaggaagaagaataagcaggaggcctctcccccccagcccagccaccccgtagcgacgacggagggcggaagaggatgagcgcgtccaggttcataaagtgcgtcacggtcggggacggcgccgtcggcaagacctgcatgctcatttcctacacctccaacaccttccccaccgactatgttccgacggtgtttgacaacttcagtgctaacgttgtggttgatggtaacactgtcaacctcggcctctgggacactgcaggtcaagaggattacaacagactgagaccactgagctatcgtggagctgatgtttttcctctggctttctcactgatcagaaagccagctatg

SEQ ID NO: 33558 - protein, 93 aa, Zea mays
  misc_feature: Ceres CLONE 1411480-F
  misc_feature (8)..(90): Pfam Name: Ras Pfam Description: Ras family
MSASRFIKCVTVGDGAVGKTCMLISYTSNTFPTDYVPTVFDNFSANVVVDGNTVNLGLWDTAGQEDYNRLRPLSYRGADVFPLAFSLIRKPAM

SEQ ID NO: 33559 - DNA, 684 bp, Zea mays
  misc_feature: Ceres CLONE 1411483-F
  misc_feature: Translation starting site: 217
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (467)..(467): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (518)..(518): n is a, c, t, g, unknown, or other
  misc_feature (556)..(556): n is a, c, t, g, unknown, or other
aagctggagctccccgcggtggcggccgctctataactagtggatcccccgggctgcaggaattcgcacgagaccattacctagaacatcctaatcgaaaaaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttggtgaccttgaaccactgtcatcgatgaggtgaggactggnnnactacgncagnnntcttcacctgagcagctcatcagtggggaggaggatgcaggccancaacttttggccgggggtcactacaccatggggaaagnaaaatggttgaaccaatggccttggaacccaacaggaaaaatttggccaaaaaagtggcggggggttccccgggggttccccctcccttttcaaagacctttggggggagaaaaaaaaacatccctcc

SEQ ID NO: 33560 - DNA, 655 bp, Zea mays
  misc_feature: Ceres CLONE 1411492-F
  misc_feature: Encodes the peptide sequence at SEQ ID NO. 33561
  misc_feature (461)..(461): n is a, c, t, g, unknown, or other
  misc_feature (462)..(462): n is a, c, t, g, unknown, or other
  misc_feature (483)..(483): n is a, c, t, g, unknown, or other
  misc_feature (568)..(568): n is a, c, t, g, unknown, or other
  misc_feature (599)..(599): n is a, c, t, g, unknown, or other
  misc_feature (615)..(615): n is a, c, t, g, unknown, or other
  misc_feature (624)..(624): n is a, c, t, g, unknown, or other
aaagctggagctccccgcggtggcggccgctctagaactagtggatcccccgggctgcaggaattcgcacgagaccattacctagaacatcctaatcgaaaaatgtaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcgnnacgcccgtgatcgtgcgcttnctcgacggtgatcaacgagcggggttcccccggagacgatcgcgaacccgcgcggggttcccgccgtgaaagttctacacccgcngagggcaactgggggacctgctggggcaacnaactttccccgtcttncttcatccngcgacggcatcaaggttccccccgaacgtga

SEQ ID NO: 33561 - protein, 106 aa, Zea mays
  misc_feature: Ceres CLONE 1411492-F
  misc_feature (18)..(106): Pfam Name: Catalase Pfam Description: Catalase
  misc_feature: SWISSPROT Homolog: EC 1.11.1.6 Catalase
  misc_feature (97)..(97): Xaa is any aa, unknown, or other
  misc_feature (104)..(104): Xaa is any aa, unknown, or other
MDPTKFRPSSSHDTTVTTTNAGAPVWNDNEALTVGPRGPILLEDYHLIEKVAHFARERIPERVVHARGASAKGFFECTHDVTSLTCADFLRAPGVRXARDRALXRR

SEQ ID NO: 33562 - DNA, 637 bp, Zea mays
  misc_feature: Ceres CLONE 1411493-F
  misc_feature (212)..(212): n is a, c, t, g, unknown, or other
  misc_feature (471)..(471): n is a, c, t, g, unknown, or other
  misc_feature (502)..(502): n is a, c, t, g, unknown, or other
  misc_feature (503)..(503): n is a, c, t, g, unknown, or other
  misc_feature (577)..(577): n is a, c, t, g, unknown, or other
  misc_feature (589)..(589): n is a, c, t, g, unknown, or other
  misc_feature (590)..(590): n is a, c, t, g, unknown, or other
aaagctggagctccccgcggtggcggccgctctagaactagtggatcccccgggctgcaggaattcgcacgagaccattacctagaacatcctaatcgaaaacctcgcgcgcacgttctgccgcgcgcatacgcccgcatcccgcagccgcggcagcgccgcagccgctccttccatcctccgccctccttccatcctccgcggatcccagntctccctcccgcgcccgcccgcagccgcaccgcatcccgcagccggcgtcggcgcaacggctgatgctcaaggggtgtgagtcgctgctacagcggcagtgccggccgcgcaccccccgcgggtacatggagcccacgccgctaccgggtggcggtgaagagcaaggggacagataaagccaaaggcagaagggggaacgtcgacaaggaccccacaaagctgactcccaacactttttttgtcgctggtgctgcggcnaacggtgctggcgagctcctcccgtgctggnnctctgggatgctcccagggcaccgggttcggggaagacgtggagtcaccacacggggggatgccgccgcgctgntttggcttgcanntcctcgatcgattcaagggaaataatggccaggggaagagactggta

SEQ ID NO: 33563 - DNA, 706 bp, Zea mays
  misc_feature: Ceres CLONE 1411494-F
  misc_feature: Encodes the peptide sequence at SEQ ID NO. 33564
tggcggccgctctataactagtggatcccccgggctgcaggaattcgcacgagaccattacctagaacatcctaatcgaaaaattccactgtttctctctcgaaatcggccgtctctctcccgtccggcacttcctccgatcgactagcctgcggcggcgccggcgccggcgaccagcggccatgcgggtggcacccagggtgctcttcctcgtccgcgacgccgcgggctacggcgctgccctcgccgacgcgctccgcccgccgcccgggctaactagggagtcctcgcccttcgagctccccccttggaaagtacgggcctccacggagagaaggcctggccccgaccttcctggagcttttccggattccagcggctcccccaccggtggacccatttgtcggtctggcaaaactataagcccacccctcttgccagggggggggtggaaacggggggccctgggaacgggatttcctcttggaaccttccccccctgggggcgaagtctctaattggcccactcccatccacacgaaaccgtcagaggttttctttctgtgggagcgggaatttcggaaccgcaaagggctccgcaccggggctctctcgagggggcgggggaaaaaaggggggacaaaaaaaggggcattaaaaactcccccccggtggccctatagaggagagacacccccaaaacaca

SEQ ID NO: 33564 - protein, 111 aa, Zea mays
  misc_feature: Ceres CLONE 1411494-F
MRVAPRVLFLVRDAAGYGAALADALRPPPGLTRESSPFELPPWKVRASTERRPGPDLPGAFPDSSGSPTGGPICRSGKTISPPLLPGGGWKRGALGTGFPLGTFPPWGRSL

SEQ ID NO: 33565 - DNA, 625 bp, Zea mays
  misc_feature: Ceres CLONE 1411497-F
  misc_feature (222)..(222): n is a, c, t, g, unknown, or other
  misc_feature (223)..(223): n is a, c, t, g, unknown, or other
aagctggagctcaccgcggtggcggccgctctagactagtggatccccgggctgcaggattcgcacgagaccattacctagaacatcctaatcgaaaaccgtcgatctcgtcggggacgccactacctctcgccgcccggtgcaaccatccgcctccgactcctgcgacccagcctcggttaccgaggatacggatcgagtaccgtgatgtcggtgtcgcgnnaactaggaccagcacggcgctgccggccgatgagccttaaacatcccggcataattttccctggctcgaaaccccctgaaatctcttgcgagccgtgcgccaatacttgcagcaccccccccctcccccgaacagcaaccctcctatcgggggggccgcccccctcccctattctctcccccccccccgacccccctcccccccgcgcaacctccgcccccgactcttttttttcttgccaccccccccctctccctcctgcagccgctcccgcctccagccgccccctcgcccactcccccgccccccgtccttgccccccaccccgctccccccgccactcacgcactctcgccacctcagtcccccctcctacccccctcctccccttctccccctcct

SEQ ID NO: 33566 - DNA, 709 bp, Zea mays
  misc_feature: Ceres CLONE 1411502-F
  misc_feature: Encodes the peptide sequence at SEQ ID NO. 33567
  misc_feature (603)..(603): n is a, c, t, g, unknown, or other
  misc_feature (604)..(604): n is a, c, t, g, unknown, or other
aagctggagctccccgcggtggcggccgctctattactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctgggaaacctttctccctactctcagcaacaacaatttcttccattcaaccaactgtctacattgaaccgtgctgcttatttgcagcaacaactattaacatttagccaggtagnntactgcctactctcaggaaccacaacttctttcattttaaccaattggccgcacctgaaccccgctgcttattttgcagcaggaaatactactaaccatttaggc

SEQ ID NO: 33567 - protein, 180 aa, Zea mays
  misc_feature: Ceres CLONE 1411502-F
  misc_feature (145)..(145): Xaa is any aa, unknown, or other
MATKIFSLLMLLALSACVANATIFPQCSQAPIASLLPPYLPSMIASVCENPALQPYRLQQAIAASNIPLSPLFQQSPALSLVQSLVQTIRAQQLQQLVLPVINQVALGNLSPYSQQQQFLPFNQLSTLNRAAYLQQQLLTFSQVXYCLLSGTTTSFILTNWPHLNPAAYFAAGNTTNHLG

SEQ ID NO: 33568 - DNA, 644 bp, Zea mays
  misc_feature: Ceres CLONE 1411511-F
  misc_feature: Encodes the peptide sequence at SEQ ID NO. 33569
  misc_feature (385)..(385): n is a, c, t, g, unknown, or other
  misc_feature (406)..(406): n is a, c, t, g, unknown, or other
aagctggagctccccgcggtggcggccgctctagaactagtggatcccccgggctgcaggaattcgcacgagaccattacctagaacatcctaatcgaaaaactgcgatgtggtcctctcctcctatcacctgacctccacacacacacacagacagacaggcacgcgcaagcaaaaattcattcatatatgcacgctcgttcgttgtcgatctcccccatcactgcacggcgcggcgcaacaagagcgagggattggagctcagctagtcgtctaatcagctagtaggtacgtgtagctaggctgcgctgcaccagctgccgtgcatgcagtgcatggcgcaggagggctctgaggcctccgtcgccagctccccgccgcccangcccgccgccgtcgggctccntcctggtggcgcgacatgcagcacccggctgcctacggcgcgtggcctccgtcccccgcgggcgaggtggccgcccccgggtatcgatggcgccggcagcgacgcagcagcagcagcagcacggcgggcgggcggacgaacgtcctccgacggtctctcggcctccaacgccaccgtagcgtcttcaccaccacttccgggtccggctcagctggacttcggggtgggaatttggggg

SEQ ID NO: 33569 - protein, 106 aa, Zea mays
  misc_feature: Ceres CLONE 1411511-F
  misc_feature (20)..(20): Xaa is any aa, unknown, or other
  misc_feature (27)..(27): Xaa is any aa, unknown, or other
MQCMAQEGSEASVASSPPPXPAAVGLXPGGATCSTRLPTARGLRPPRARWPPPGIDGAGSDAAAAAARRAGGRTSSDGLSASNATVASSPPLPGPAQLDFGVGIWG

SEQ ID NO: 33570 - DNA, 688 bp, Zea mays
  misc_feature: Ceres CLONE 1411515-F
  misc_feature: Encodes the peptide sequence at SEQ ID NO. 33571
  misc_feature (298)..(298): n is a, c, t, g, unknown, or other
  misc_feature (309)..(309): n is a, c, t, g, unknown, or other
  misc_feature (329)..(329): n is a, c, t, g, unknown, or other
  misc_feature (358)..(358): n is a, c, t, g, unknown, or other
  misc_feature (359)..(359): n is a, c, t, g, unknown, or other
  misc_feature (393)..(393): n is a, c, t, g, unknown, or other
  misc_feature (454)..(454): n is a, c, t, g, unknown, or other
  misc_feature (455)..(455): n is a, c, t, g, unknown, or other
  misc_feature (464)..(464): n is a, c, t, g, unknown, or other
  misc_feature (476)..(476): n is a, c, t, g, unknown, or other
  misc_feature (514)..(514): n is a, c, t, g, unknown, or other
  misc_feature (570)..(570): n is a, c, t, g, unknown, or other
  misc_feature (644)..(644): n is a, c, t, g, unknown, or other
aaagctggagctccccgcggtggcggccgctctagaactagtggatcccccgggctgcaggaattcgcacgagaccattacctagaacatcctaatcgaaaactctgctaacgccgctcgcgcatcctattgccctcgcgccaccgtcgccgccgctgcagcgagccaccgccctgccgtcgcctgaggtagacaccaagccaccgccatggggcgtatgcacagccgcgggaagggtatctcttcatcggcgctgccgtacaagaggactcctccgatctggctcaagacagtaccnaccgaggtggnaggagatgattaccaaggcntgcgaagaaaggccagatgccgtcccaannaaatggtggttcctgctcccgtggacagcacggncatccccgcttggtcaggaagcgtgactggggtagccaagatccctccgcatcctcagggnnccaatgggntgggcggcgganaatcctcccggagggatactctactttcctcattaaanaaaggggcgggggccgattaaggaagcatcctggaagaggaaacagggaagggacnaggactcccaaattcagaactcatttcctgggtggagagcaaggatcccaccgcccttggcccggctactaacnagcgggtaccaagaagctcccaccccccacctgggaaagtacgg

SEQ ID NO: 33571 - protein, 108 aa, Zea mays
  misc_feature: Ceres CLONE 1411515-F
  misc_feature (1)..(41): Pfam Name: Ribosomal_S13_N Pfam Description: Ribosomal S13/S15 N-terminal domain
  misc_feature (34)..(34): Xaa is any aa, unknown, or other
  misc_feature (41)..(41): Xaa is any aa, unknown, or other
  misc_feature (50)..(50): Xaa is any aa, unknown, or other
  misc_feature (51)..(51): Xaa is any aa, unknown, or other
  misc_feature (62)..(62): Xaa is any aa, unknown, or other
  misc_feature (83)..(83): Xaa is any aa, unknown, or other
  misc_feature (86)..(86): Xaa is any aa, unknown, or other
  misc_feature (90)..(90): Xaa is any aa, unknown, or other
  misc_feature (102)..(102): Xaa is any aa, unknown, or other
MGRMHSRGKGISSSALPYKRTPPIWLKTVPTEVXGDDYQGXRRKARCRPXXMVVPAPVDSTXIPAWSGSVTGVAKIPPHPQGXNGXGGGXSSRRDTLLSSLXKGAGAD

SEQ ID NO: 33572 - DNA, 735 bp, Zea mays
  misc_feature: Ceres CLONE 1411526-F
  misc_feature (20)..(20): n is a, c, t, g, unknown, or other
ccggctggagctcaccgcgntggcggccgctctagatcagtggatcccccgggctgcaggaatttcacgagaccattacctagaaatcctaatcgaaaaaccgacccagtatccccgacaaagtcaatgcgatgcgcctcctccttgctctatcgactatcgtagccgattccccgctgcatgtaactaacactaagtcccttgtctgtatagtacccgcattaccatataactagcaaggaatggccgctctcacttcccgtcttcgttgtttggcgccctcctcgcgaccctccccacacgtgcaccaatatgttcccaccccttcctcgcgttctcaccctcaccctcgtattgttccccctttattctttctttttttccaatcagactctacccccgttctttgcctctttttcccacttttgaccgcgccccccgccatcgtttccgcctaactccctatcatcgttcccacgcccctctttttacttctcacacagctgataccacatcgacacatccccctacctttccccctcccccccccctcttcttctcttcctgccctttcccatacgctccctctttgccctccgtgtgtcccccccccacaatatctctcccttctcccacctccccctcctccccacagttgtttgtcgcctcctccacccctcacctcctctttccctatccactacccctctctgtcttctcttccctaccgattcg

SEQ ID NO: 33573 - DNA, 607 bp, Zea mays
  misc_feature: Ceres CLONE 1411527-F
  misc_feature: Encodes the peptide sequence at SEQ ID NO. 33574
  misc_feature (47)..(47): n is a, c, t, g, unknown, or other
  misc_feature (74)..(74): n is a, c, t, g, unknown, or other
aaagctggagctcaccgcggtggcggccgctctagaactagtggatnccccgggctgcaggaattcgcacgagnacattacctagaacatcctaatcgaaaaacgcgaagcaaggaaaaaagaaaaatggcgcagctggtggagacgtacgcgtgctcgccggccacggaacgcggccgtggaatcctcctggccggggaccccaagacagacacgatcgcctactgcaccggccgcagcgttatcatccgccgcctcgatgcgcctctcgacgcttgggcctaccccgaccacgcctaccccacgaccgtcgcccgcttctcccccaacggcgagtgggtcgcctccgccgacgcctccggctgcgcccgcggctggggccgccccgctgaccccgctctcttggcccaccctcccttcccccttgcccgcgtcgcccgtccccggttgccccccccactccctcccccctcccgctcccccgccccgcccccatgtttagcgctcctccccccctccccccccctcacctcttcccctcccccccgctaccactcgcgcccgcccttccccatccccctccgccttcttctttcccccccccctc

SEQ ID NO: 33574 - protein, 160 aa, Zea mays
  misc_feature: Ceres CLONE 1411527-F
MAQLVETYACSPATERGRGILLAGDPKTDTIAYCTGRSVIIRRLDAPLDAWAYPDHAYPTTVARFSPNGEWVASADASGCARGWGRPADPALLAHPPFPLARVARPRLPPPLPPPSRSPAPPPCLALLPPSPPLTSSPPPRYHSRPPFPIPLRLLLSPPP

SEQ ID NO: 33575 - DNA, 649 bp, Zea mays
  misc_feature: Ceres CLONE 1411544-F
  misc_feature: Translation starting site: 262
  misc_feature (283)..(283): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
aaagctggagctccccgcggtggcggccgctctagaactagtggatcccccgggctgcaggaattcgcacgagaccattacctagaacatcctaatcgaaaaacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagncgggtcgaggtacggcggaaccgctcnnnaggtggcgggttgggacgcggaggaggggcggcggcggcgcgaggacaataatgggtggagatccgcaagaaagccgccgtgaggagagcctcctcaagagggcgccgtgaggggctccaagcccaggtccctgccccctccctccgtgggtcgagaagaagcttgaaagcctctcagctatgggttaagtggggtttattcggatgataataaccttcagcttgaggccaccacacagttccgcaaattgtctctaatagagaggagtccccccatcgaagaattatcaaaacaggtgtagttccaagatttgtgcagtctctcaccagagaggat

SEQ ID NO: 33576 - DNA, 648 bp, Zea mays
  misc_feature: Ceres CLONE 1411552-F
  misc_feature: Encodes the peptide sequence at SEQ ID NO. 33577
  misc_feature (249)..(249): n is a, c, t, g, unknown, or other
  misc_feature (263)..(263): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (274)..(274): n is a, c, t, g, unknown, or other
  misc_feature (277)..(277): n is a, c, t, g, unknown, or other
  misc_feature (294)..(294): n is a, c, t, g, unknown, or other
  misc_feature (306)..(306): n is a, c, t, g, unknown, or other
  misc_feature (340)..(340): n is a, c, t, g, unknown, or other
  misc_feature (363)..(363): n is a, c, t, g, unknown, or other
  misc_feature (364)..(364): n is a, c, t, g, unknown, or other
aagctggagctccccgcggtggcggccgctctagaactagtggatcccccgggctgcaggaattcgcacgagaccattacctagaacatcctaatcgaaaaacgctcgtggcaccgcactcactccgaatcctgaagcaacaaacaccagaagcgcaccaactccccaaccaccggagaccgcaccccagcaaaggatggcatctgactccacggccgccgtgacggtggacggcagcgcgctgcgggnccgcgcgctggccncnnnnnnnacncgncacatgttcggggtggngggcatccccgncccctccctcgcgtcccgtgccgccgcgggcggngtccgcttcctcggctttccgcnncgagcccccccgcggggaggggggcgccgcctacggcttcctcccgggctccccggggcgccctactcaccgtctccggcccaggatggcgccacggtgttcgggggccttctcccacggcacggccaacccttggccgctcctcaggatccccgaaccccgcggacagggtgaacccggcgggggccgatttccagggatctcgacaaaatcggcgcgccttatggctttccccaaacttcccggtgagggaacaaaccatgttcggacccccccgcgcttgg

SEQ ID NO: 33577 - protein, 113 aa, Zea mays
  misc_feature: Ceres CLONE 1411552-F
  misc_feature (18)..(18): Xaa is any aa, unknown, or other
  misc_feature (23)..(23): Xaa is any aa, unknown, or other
  misc_feature (24)..(24): Xaa is any aa, unknown, or other
  misc_feature (25)..(25): Xaa is any aa, unknown, or other
  misc_feature (33)..(33): Xaa is any aa, unknown, or other
  misc_feature (37)..(37): Xaa is any aa, unknown, or other
  misc_feature (56)..(56): Xaa is any aa, unknown, or other
MASDSTAAVTVDGSALRXRALAXXXTRHMFGVXGIPXPSLASRAAAGGVRFLGFPXRAPPRGGGRRLRLPPGLPGAPYSPSPAQDGATVFGGLLPRHGQPLAAPQDPRTPRTG

SEQ ID NO: 33578 - DNA, 630 bp, Zea mays
  misc_feature: Ceres CLONE 1411556-F
  misc_feature: Encodes the peptide sequence at SEQ ID NO. 33579
  misc_feature (504)..(504): n is a, c, t, g, unknown, or other
  misc_feature (517)..(517): n is a, c, t, g, unknown, or other
ggagctccccgcggtggcggccgctctagaactagtggatcccccgggctgcaggaattcgcacgagaccattacctagaacatcctaatcgaaaaatcacggccacgttcacgcttcccccttctgcaagcaaacctaaccaagcctctgcggctcttcttcgaatccaactcctccccgatccccaaaatcgaacccaagtcgaaaccctaacctcggccttctcgatgtcggccgccacaaccgccccaacccctgcggtggccaccccgatggcgccgcctccgtcgtacccggcctcctccacgatctccgcctccgtggccgcgtcggtcgaggaagaggacgacctctatggccgcctcaagtcgctccagcgccacatggagttcgtcgagatccaggaggagtacgttaaagacgaacagaagaacctcaagcgcgaactcctccgtgcgcaggaggaggtcaggcggatccagtccgtaccgctcgtcatcggncagtttaatggangatggtcgacggcacacgggcattcgtgggttctactaacggcagcaactactaatgttggggatcctcagcaccatcaaccgcgagctgctcagccgtcagaattctgtcgg

SEQ ID NO: 33579 - protein, 134 aa, Zea mays
  misc_feature: Ceres CLONE 1411556-F
  misc_feature (97)..(97): Xaa is any aa, unknown, or other
MSAATTAPTPAVATPMAPPPSYPASSTISASVAASVEEEDDLYGRLKSLQRHMEFVEIQEEYVKDEQKNLKRELLRAQEEVRRIQSVPLVIGQFNGXWSTAHGHSWVLLTAATTNVGDPQHHQPRAAQPSEFCR

SEQ ID NO: 33580 - DNA, 647 bp, Zea mays
  misc_feature: Ceres CLONE 1411557-F
  misc_feature: Encodes the peptide sequence at SEQ ID NO. 33581
  misc_feature (322)..(322): n is a, c, t, g, unknown, or other
aaagctggagctccccgcggtggcggccgctctagaactagtggatcccccgggctgcaggaattcgcacgagaccattacctagaacatcctaatcgaaaaaccaccaagtggacgcagcagctttaaccccccaaagcctcgacgccgcgagcacagctccgccgccaccgcccccttctcatccgcggtctccgccgcctgctgcatctctatcgatctagcgggactggctccttcccgtgctgggtccttcgtcaatcgtcagcgcgcaagatcggcacttgtgtacatctgagcagtttccggtgccctaattcangcgcgggcgttgttgggttttcgataatttttggggttcacctgaaccctcatgacccaggtgaagcccgcccctgggggaaggatgctgaccgtgctgcgggtgcacctcccgtcggagatcccgatcgtcggctgtgagatcacggcggatgtgctcctggcgcgccccgacgggagcgtcttcaccgacgacgtgtctgagaccgcgcccgggaatgggtacttcctgcgctacaagtgtaccgcataagaagggatcgaaaagctgctatctggaaggaaccccccaaaaaacaggaaccttcagggcatagggggttaag

SEQ ID NO: 33581 - protein, 66 aa, Zea mays
  misc_feature: Ceres CLONE 1411557-F
MTQVKPAPGGRMLTVLRVHLPSEIPIVGCEITADVLLARPDGSVFTDDVSETAPGNGYFLRYKCTA

SEQ ID NO: 33582 - DNA, 605 bp, Zea mays
  misc_feature: Ceres CLONE 1411560-F
  misc_feature: Encodes the peptide sequence at SEQ ID NO. 33583
  misc_feature (375)..(375): n is a, c, t, g, unknown, or other
  misc_feature (491)..(491): n is a, c, t, g, unknown, or other
  misc_feature (517)..(517): n is a, c, t, g, unknown, or other
  misc_feature (556)..(556): n is a, c, t, g, unknown, or other
aagctggagctccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggncaagactcccgtgttccctcggatctttggccacgaggctgggagtatcatagagagtgttggagagggtgtgactgacgtagctccgggcgaccatggtctttcctgtgtcactngggagtgcaaggagtgtggccactgngcagtcgcagagaggcacatgtgtgatctgctcaggatncacacggaccgcgttgtgatgatggccgatgggcagtcgcggttttcat

SEQ ID NO: 33583 - protein, 132 aa, Zea mays
  misc_feature: Ceres CLONE 1411560-F
  misc_feature (34)..(124): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (56)..(56): Xaa is any aa, unknown, or other
  misc_feature (95)..(95): Xaa is any aa, unknown, or other
  misc_feature (103)..(103): Xaa is any aa, unknown, or other
  misc_feature (116)..(116): Xaa is any aa, unknown, or other
MATAGKVIKCKAAVAWEAGKPLSIEEVEVAPPQAMEVRVKILFTSLCHTDVYFWEXKTPVFPRIFGHEAGSIIESVGEGVTDVAPGDHGLSCVTXECKECGHXAVAERHMCDLLRXHTDRVVMMADGQSRFS

SEQ ID NO: 33584 - DNA, 638 bp, Zea mays
  misc_feature: Ceres CLONE 1411566-F
  misc_feature: Encodes the peptide sequence at SEQ ID NO. 33585
  misc_feature (503)..(503): n is a, c, t, g, unknown, or other
aaagctggagctccccgcggtggcggccgctctagaactagtggatcccccgggctgcaggaattcgcacgagaccattacctagaacatcctaatcgaaaaaacaatattatctcaaagctaaccaacaatggagttcccaaaggtgttcttccacataaacatcaacggccacgaagcggaaaggatcgtgatggagttgtatacggataagacgccgaagacggctgagaatttcagagctctgtgcactggacagaagggagtggggcgtaagggaaagcccctccacttcaagggatcttccttccaccgagtgatccccagattcatgtgccagggaggtgatttcaccgcgggaaacgggacaggaggtgagtccatctacggtgataagttcgaggacgagaactttgagaggaagcacacgggtcctgacaacctttccatgtcgaacgccggagccaacaccaacggatctcagttcttcatctgcaccgaanaaaccgattgccttgacggtaagcacgtggagctctgtcaggtggtggaaggcttagacgtggtgaatgcgatcgataaggtgcgatcgtcatctggaaagccgtcgaagccggtggttatcgccgattgtggac

SEQ ID NO: 33585 - protein, 169 aa, Zea mays
  misc_feature: Ceres CLONE 1411566-F
  misc_feature (5)..(169): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
  misc_feature (125)..(125): Xaa is any aa, unknown, or other
MEFPKVFFHININGHEAERIVMELYTDKTPKTAENFRALCTGQKGVGRKGKPLHFKGSSFHRVIPRFMCQGGDFTAGNGTGGESIYGDKFEDENFERKHTGPDNLSMSNAGANTNGSQFFICTEXTDCLDGKHVELCQVVEGLDVVNAIDKVRSSSGKPSKPVVIADCG

SEQ ID NO: 33586 - DNA, 623 bp, Zea mays
  misc_feature: Ceres CLONE 1411577-F
  misc_feature: Encodes the peptide sequence at SEQ ID NO. 33587
  misc_feature (586)..(586): n is a, c, t, g, unknown, or other
ggagctccccgcggtggcggccgctctataactagtggatcccccgggctgcaggaattcgcacgagaccattacctagaacatcctaatcgaaaactctctctctcttctcctctcttctctaactctgcctctctgacgcaatgccgatccccaccgccttcaccgcgcggcggcggcggcacgagggcgccgcgctgcgttggtgcgggatcgcggccctggttcttatggcgctcgaggctggtgcggcgcagcagacgtcgccgacggacgtggcgccgatgcgctctgagctcaaggcgcttggcgcgcacaagacgctgggatgggacgtcgccggcgacccctgctcgcccaaccggtgggagggggtgtcatgccactcgtcgggccgcgtcaccgcgatccaggtcggtgcgcgaggtctcacggggaccctgcctccggaggtgggcgacctcaccgagctcacccgcctcgaggatttcgacaacaagctctccggcccgctgcccttgctcccggggctctcctcgcttcaggatttacttgaccgtaacaatagcttcggctccatccccgncgacttcttcataggcctcaccgggctcaccgccgtc

SEQ ID NO: 33587 - protein, 160 aa, Zea mays
  misc_feature: Ceres CLONE 1411577-F
  misc_feature (148)..(148): Xaa is any aa, unknown, or other
MPIPTAFTARRRRHEGAALRWCGIAALVLMALEAGAAQQTSPTDVAPMRSELKALGAHKTLGWDVAGDPCSPNRWEGVSCHSSGRVTAIQVGARGLTGTLPPEVGDLTELTRLEDFDNKLSGPLPLLPGLSSLQDLLDRNNSFGSIPXDFFIGLTGLTAV

SEQ ID NO: 33588 - DNA, 847 bp, Zea mays
  misc_feature: Ceres CLONE 1411580-F
  misc_feature: Encodes the peptide sequence at SEQ ID NO. 33589
  misc_feature (1)..(1): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (429)..(429): n is a, c, t, g, unknown, or other
  misc_feature (433)..(433): n is a, c, t, g, unknown, or other
  misc_feature (504)..(504): n is a, c, t, g, unknown, or other
  misc_feature (675)..(675): n is a, c, t, g, unknown, or other
  misc_feature (685)..(685): n is a, c, t, g, unknown, or other
  misc_feature (698)..(698): n is a, c, t, g, unknown, or other
  misc_feature (732)..(732): n is a, c, t, g, unknown, or other
  misc_feature (735)..(735): n is a, c, t, g, unknown, or other
  misc_feature (751)..(751): n is a, c, t, g, unknown, or other
  misc_feature (752)..(752): n is a, c, t, g, unknown, or other
  misc_feature (769)..(769): n is a, c, t, g, unknown, or other
  misc_feature (794)..(794): n is a, c, t, g, unknown, or other
ncggtgcgggcccctctcttccggcccgcggcggcccgtggctccggcagtgccgtgtgtgggggggggggannnnnccaaactggagctccaccgcggtggcggccgctctattactagtggatcccccgggctgcaggaattcgcacgagaccattacctagaacatcctaatcgaaaaatggtcctccattcaagttccactactccacacctaaacttcccaaccctccattgcacaacctgtcacacagtacgccgtcgcctgtgatttgcgttgtggactgcgagagaaccatagagagagacataaactcggactcctccagaacgagatgatgtcgagggagagaaagaaggcggctggctcttcaggagaagctgaagatcctccgctccatcactcactcccacgctgctgagccaaangtgngataaggaatgcacgggttccggggggccctcgggggggctggaggcgagaagggaggtgcaggcttgagncgaggcacaattgcggagccggcgcgaggaacgccggctgaaaagaagagggggcatgcgtgcctaaatcccacgcgcgggcccgggtgggaaggccctaaaccccgcggcacaacctgcccgccgttcccccgccagaacgcgggggacccccccacacaaaaaatctgnccccgcgggncggaggttagganaccccctgctgcttggagggtcttttccccacgnaancatgggtggcgtcaanncaacgggttccaggggncacacgcggcgaactcgaggagggncgggaatcccactttccgtgccttccaaatgcgcctgaaagacacccaataaa

SEQ ID NO: 33589 - protein, 134 aa, Zea mays
  misc_feature: Ceres CLONE 1411580-F
  misc_feature (21)..(21): Xaa is any aa, unknown, or other
  misc_feature (78)..(78): Xaa is any aa, unknown, or other
  misc_feature (82)..(82): Xaa is any aa, unknown, or other
  misc_feature (86)..(86): Xaa is any aa, unknown, or other
  misc_feature (98)..(98): Xaa is any aa, unknown, or other
  misc_feature (104)..(104): Xaa is any aa, unknown, or other
  misc_feature (110)..(110): Xaa is any aa, unknown, or other
  misc_feature (118)..(118): Xaa is any aa, unknown, or other
MHGFRGALGGAGGEKGGAGLXRGTIAEPARGTPAEKKRGHACLNPTRGPGWEGPKPRGTTCPPFPRQNAGDPPTQKIXPRGXEVRXPPAAWRVFSPRXHGWRQXNGFQGXHAANSRRXGNPTFRAFQMRLKDTQ

SEQ ID NO: 33590 - DNA, 606 bp, Zea mays
  misc_feature: Ceres CLONE 1411592-F
  misc_feature: Translation starting site: 222
  misc_feature: SWISSPROT Homolog: EC 1.1.1.1 Alcohol dehydrogenase
tggagctccccgcggtggcggccgctctagaactagtggatcccccgggctgcaggaattcgcacgagaccattacctagaacatcctaatcgaaaactgaattcttttctactagagctagagccaggcagccagccgacgcccagcggggtaggttgactcttctgtctacagcacctacctcttcacaccaactgccgcccctgctccgagaaccagaatggccgccgccgatgcatcttcgttgcctccgaccgccatcacctgccgagcggcggaggcgtggggaccgggccagccactggtgatggaggaggtggaggtcgccccgccggggcccatggagatccgtgtcaaggtcgtctccacctccggctgccgcagcgacgtcactgcctggcaatccaagctgagagcctgagacaaacgatctctctgatcgaatttgctcatctgtggtctcttccaattccaacatgcaggcgcaacttgatctgttccccagagtcttcggccacgaggcatccggagtagtatagagtgtcggtgaaggtgtgaccgagttccaagtcggtgaccacgttctcactgtcttcattggggag

SEQ ID NO: 33591 - DNA, 651 bp, Zea mays
  misc_feature: Ceres CLONE 1411594-F
  misc_feature: Encodes the peptide sequence at SEQ ID NO. 33592
aaagctggagctccccgcggtggcggccgctctagatctagtggatcccccgggctgcaggaattcgcacgagaccattacctagaacatcctaatcgaaaaacaaatcacaaggatacgccgagacgcgcgtctcgtttctcccttcctcagctgctggccccctgcctgcagccattgccccgctcctcgaggtcaaatggcccctgcccccgctctcaccgccacatccgtcctgaagcgatcccacctacccggcgtccactcgttggccggtcgccagcagccggggcgggaccgcgtctcggtgctttctccagcgatcccgccgccccgcgtttcatggcagcaaggatctggagtggttgctaacaggctcctctgggcgagtgcgagtgtttccttctagaaagataacatcggggagggagtggtgttgacttctcagatagcggtggagaatagagaatatttgttgaacattttgaagagtgacaactccattattacctcatatagtgctggggagtagcatatctcgcgctggggtacccgcccttcgggtcacatgggctcactacccagggaacctatgccaccaggctttgggcggtccttggagggattggctggtcgggggaaagcctccag

SEQ ID NO: 33592 - protein, 69 aa, Zea mays
  misc_feature: Ceres CLONE 1411594-F
MAPAPALTATSVLKRSHLPGVHSLAGRQQPGRDRVSVLSPAIPPPRVSWQQGSGVVANRLLWASASVSF

SEQ ID NO: 33593 - DNA, 633 bp, Zea mays
  misc_feature: Ceres CLONE 1411597-F
  misc_feature: Encodes the peptide sequence at SEQ ID NO. 33594
  misc_feature (490)..(490): n is a, c, t, g, unknown, or other
aagctggagctccccgcggtggcggccgctctataactagtggatcccccgggctgcaggaattcgcacgagaccattacctagaacatcctaatcaaaaaatccagctttgctttgtagttgtagcgctagcagcttaattggtctctgatctgaggtgcactactagctatgtagtcgtgcacgaagaggaaggaatataatggctgagcgccaggtcctccaaggcggtactacgaccggacgcggtctgtggcgtaggtatgcgccgcacgtccagatggtgctggcgcatctgtgctacacgctcatgtacttcatcaccgaggccgccttcaaccagcggctcaacccctacgtctacatcacctaccgccatctgctcgtcggcgtcctcatctggaccttcgcatactacctggagaaggcgctgaggtctaaaatgacgctcatgctgatcattgagatattcgtgctctcacttctcggngtgagcttaactctgaacatgtacttcgcgagcctgaagtacacgtccccaacgttcgtcacttccgtggtgaacaccatcgcctcgatgacgttcgtcatcgccatcatcctcaggtgacaaaagccggaccggacgcgcgg

SEQ ID NO: 33594 - protein, 135 aa, Zea mays
  misc_feature: Ceres CLONE 1411597-F
MAERQVLQGGTTTGRGLWRRYAPHVQMVLAHLCYTLMYFITEAAFNQRLNPYVYITYRHLLVGVLIWTFAYYLEKALRSKMTLMLIIEIFVLSLLGVSLTLNMYFASLKYTSPTFVTSVVNTIASMTFVIAIILR

SEQ ID NO: 33595 - DNA, 626 bp, Zea mays
  misc_feature: Ceres CLONE 1411606-F
  misc_feature: Encodes the peptide sequence at SEQ ID NO. 33596
  misc_feature (585)..(585): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (610)..(610): n is a, c, t, g, unknown, or other
  misc_feature (626)..(626): n is a, c, t, g, unknown, or other
aaagctggagctccccgcggtggcggccgctctagaactagtggatcccccgggctgcaggaattcgcacgagaccattacctagaacatcctaatcaaaaaacggtttgcgtataaataagtagtcagtcgctcatcttgttccttgtgaacatcgcagtgctgtagcctccttcgtcttgagcgagcatggagatgtcagccatggaggaagccctccccaaggcgatggagaggaggaagggaggcctcagaaccattccgttcatcatcttaaacgagatattcgagaaggtggccacgttcgggctgtcggccaacatgatcctgtacctcaccgagcggtatctcatgaccaacgcctttgccaccgtcgtcctctacttctggcatgccttctccaacttcctgcccatcttaggcgccgtgctcgcccacgccccgcctcggccgggttccggggcaatcacccctcgggttccttgggtttaaaccccttttccggaaaaggccccctcgttgggggtttaaaaccgaaatcccctctccggggggagaaaaaaaaaaaaccccccccccgggggnggggggcccccccnnnnnggggagnccccccccaaaaagan

SEQ ID NO: 33596 - protein, 100 aa, Zea mays
  misc_feature: Ceres CLONE 1411606-F
MEMSAMEEALPKAMERRKGGLRTIPFIILNEIFEKVATFGLSANMILYLTERYLMTNAFATVVLYFWHAFSNFLPILGAVLAHAPPRPGSGAITPRVPWV

SEQ ID NO: 33597 - DNA, 619 bp, Zea mays
  misc_feature: Ceres CLONE 1411607-F
  misc_feature: Encodes the peptide sequence at SEQ ID NO. 33598
  misc_feature (210)..(210): n is a, c, t, g, unknown, or other
aaagctggagctccccgcggtggcggccgctctataactagtggatcccccgggctgcaggaattcgcacgagaccattacctagaacatcctaatcgaaaaatatataatggtattacccccgtcgtcaaatgcaccgccacccaaccccatggccgccgccaccggaagaaccatgaagacgatggcgctcgtcgtcgtcctcgccgnccctcctctgctccatctcggtcgccgctgcagccagcggcggcctttcttcgtacgtggtgtacctcggccagcacgcgcacggcgcggcgctgggcacgcacggcgccgaggagctgcaggcgtctggagcgctgacgccgccgaggcgcactgcgacctcctcgccggcgtcttgggcggagacaagcagaaggcgcgggaggcgatcttctactcgtacacgaagcacatcaacggcttcgcagccaacctggacgccgccaccgccgccgagattgcggggaaacccggcgtgatctctgtgttccccaaccagggcccgcaagctgcacacgaccccggtcatggaagttcctcggccctgggcggggcccggcgggcggtccccccgggcgggggggtggga

SEQ ID NO: 33598 - protein, 156 aa, Zea mays
  misc_feature: Ceres CLONE 1411607-F
  misc_feature (82)..(131): Pfam Name: Subtilisin_N Pfam Description: Subtilisin N-terminal Region
  misc_feature (20)..(20): Xaa is any aa, unknown, or other
MAAATGRTMKTMALVVVLAXPPLLHLGRRCSQRRPFFVRGVPRPARARRGAGHARRRGAAGVWSADAAEAHCDLLAGVLGGDKQKAREAIFYSYTKHINGFAANLDAATAAEIAGKPGVISVFPNQGPQAAHDPGHGSSSALGGARRAVPPGGGVG

SEQ ID NO: 33599 - DNA, 747 bp, Zea mays
  misc_feature: Ceres CLONE 1411612-F
  misc_feature: Encodes the peptide sequence at SEQ ID NO. 33600
aagctggagctccccgcggtggcggccgctctagaactagtggatcccccgggctgcaggaattcgcacgagaccattacctagaacatcctaatcgaaaagcgattggtgattccatttctaccccgagacctcgagtcgtccgcccctgaaccctcagccttctccgtcccgcctcggcactcgacggccgacggcacacaccgcgtagtctcgagacaggaaccggaggaacgaggatggaggatgactcgtcgctgaccaagactatgaagggtgcggtgacaggactcgccgcgaggaccatctggggcaccgtcgtctccacctggtacgacctgccccgagtgtagcgacacgtcacgctacctggccatatccggacgctcgagatgtgcgtgacatacggagtacatcttctgctacatctgagtgactctacatcggtgactagcatatcgtgcatagccagtcgcatgaagcgcgactaccgcgacggtggacgacccgatcgttttgttggctggaagcctctggctgcggctaccgtaggaatgaagattctttccagccctccatccgaagggtcctggccggggtttcaaattccggctgggcttggaaatgggcggcaaaaccatcctaaggtgacaaccggcaaagaagaacattgccaaaccaatcgggaaaaaaacttgggaattggattccaaagtccggcgttcattaaaaaaattttttggcccc

SEQ ID NO: 33600 - protein, 37 aa, Zea mays
  misc_feature: Ceres CLONE 1411612-F
MEDDSSLTKTMKGAVTGLAARTIWGTVVSTWYDLPRV

SEQ ID NO: 33601 - DNA, 725 bp, Zea mays
  misc_feature: Ceres CLONE 1411614-F
  misc_feature: Encodes the peptide sequence at SEQ ID NO. 33602
aagctggagctcaccgcggtggcggccgctctagaactagtggatcccccgggctgcaggaattcgcacgagaccattacctagaacatcctaatcgaaaaatacaacggtgtatgcggactccctacgccatcgttctcatccgacgtcgtcgtccactacaccgccacggtcgtcctcggtcgcgaccgcgatccttcgttgtcatccagcggcacggtttacggtttgaggactcctccatcgtgtccttgcctcttctccatcatctccttgcctcatctctcctctgagttctccctctggtcacggtcttggttgctctgttgcttttcattcaaatcgtcgtgcatccagatctggtgtctatttttgggccaaatgcttatttcttgcagaaaccatgcatcaagatctagagtgttctgagcacaaaagttgtacaggtatgacctattgatcaggaaagttgtaccagacacgttcgtcgtcacgaacatcgtcaagccgtgtgcctactgcactggccggtgagcatctgcaagacgtgtgactggtgcccctgaccagaactatgcgtctctgttctcacatgatgattagatgggatctgatcaccgcgtctctgaagacctgatcaccgggagctcttcatatgtaagaaggcatgcaacatcaatgcttggacaagagtttatggcgtgtacacatgattatgacattgg

SEQ ID NO: 33602 - protein, 40 aa, Zea mays
  misc_feature: Ceres CLONE 1411614-F
MGSDHRVSEDLITGSSSYVRRHATSMLGQEFMACTHDYDI

SEQ ID NO: 33603 - DNA, 676 bp, Zea mays
  misc_feature: Ceres CLONE 1411620-F
  misc_feature: Encodes the peptide sequence at SEQ ID NO. 33604
  misc_feature (359)..(359): n is a, c, t, g, unknown, or other
  misc_feature (415)..(415): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (477)..(477): n is a, c, t, g, unknown, or other
  misc_feature (478)..(478): n is a, c, t, g, unknown, or other
  misc_feature (546)..(546): n is a, c, t, g, unknown, or other
tccccgcggtggcggccgctctagaactagtggatcccccgggctgcaggaattcgcacgagaccattacctagaacatcctaatcgaaaaacacacgcgggcgcgctagctagtgagagtcggagatgtcgtcgccgcggccacacttcctcgtgctcaccttccctttccagggccacatcgccccggctctccgcctcgccaggcagctgctcgcggcggcgcccgacgcgctcgtgaccttctccaccaccgaggtcgcgcacaggcgcatgttcccggcaaagcccaacgacggcgccaaggactccgacgaagacggccgcctcgagttcctcccgttctccgacggcacggnaggccgggtacgtccggagcgccgacctgggctcgttcaacgcctacatgacgtcntttccacgccgcgggggcgcgcagcgccgcggagatcgtgaccgttcnnngggggggcgggnnccgccccgtgtcccccgcgtcgtgtacacgctgctccttcccgtggggcggccgaccgtcgcgcgggnaccggcgggatccccgtccgcgcttctactgggctccagccgggtcttccgggggtcgccctcctaccaccacctaatttcgacggccaagcccggcgtcgttccccagaccacttacacaaacccggcg

SEQ ID NO: 33604 - protein, 109 aa, Zea mays
  misc_feature: Ceres CLONE 1411620-F
  misc_feature (78)..(78): Xaa is any aa, unknown, or other
  misc_feature (97)..(97): Xaa is any aa, unknown, or other
MSSPRPHFLVLTFPFQGHIAPALRLARQLLAAAPDALVTFSTTEVAHRRMFPAKPNDGAKDSDEDGRLEFLPFSDGTXGRVRPERRPGLVQRLHDVXSTPRGRAAPRRS

SEQ ID NO: 33605 - DNA, 615 bp, Zea mays
  misc_feature: Ceres CLONE 1411622-R
  misc_feature (85)..(85): n is a, c, t, g, unknown, or other
  misc_feature (109)..(109): n is a, c, t, g, unknown, or other
  misc_feature (110)..(110): n is a, c, t, g, unknown, or other
  misc_feature (131)..(131): n is a, c, t, g, unknown, or other
  misc_feature (132)..(132): n is a, c, t, g, unknown, or other
  misc_feature (238)..(238): n is a, c, t, g, unknown, or other
  misc_feature (297)..(297): n is a, c, t, g, unknown, or other
  misc_feature (362)..(362): n is a, c, t, g, unknown, or other
caattgggtaccgggccccccctcgaggtcgacggtatcgataagcttttttttttttttttttcgaaatgtctgaaactcgtancacgaagcaacgtattatcactgnngaagccgcacagtgggctagnnacccggcagggccctaggaatacatatttcattgctggcctgaaatcaacctttcatgctaaaacccctcggatgaagggctcaccgggcagcgaacccgtgtcangcgggtgcagccctgggggccaaatcaagaaatatgcccggaaagcaggcctccccggncccttgaaaaacccgccggcgccccggttaaatggcccaaaattgaacaaccctgcccggattgnccccccggggttcacccgttaagggccacccccccccccaacccatatggccccccgccaatgggccttttccttccaagtcgtgggggttcccctgggcccccccccaaaggggtaaatttaaacccctgaaataaaaaccccgggtggcgacaccccccccggggaaaggccccccttttcgccccccgttttttttccccccgggggggaaaaaagaacccctttgggggcgggggtacacccccttata

SEQ ID NO: 33606 - DNA, 627 bp, Zea mays
  misc_feature: Ceres CLONE 1411626-F
  misc_feature: Encodes the peptide sequence at SEQ ID NO. 33607
aagctggagctccccgcggtggcggccgctctagaactagtggatcccccgggctgcaggaattcgcacgagaccattacctagaacatcctaatcgaaaagcgtcgtcaacgcttcttccttcccgcggtctcctcttcgcctctcgtatccggcggccatggcgaggaaccccggctgcaccgtcttcataggtaacttggatgacaaggttcctgagagggttctatatgaaattcttattcaggtaggtcgtgttgtagacctacacatacctcgtgacaaggaaactagccgaccaaaaggttatgcttttgctgagtatgaaacagaggagattgcccagtatgccattaagctattttctggccttgttcgacttcataataaaacacttagatttgcgatctctgggcaagacaaaccctcattaaatggcaatattcctgtaactcctagtttgaactctgtaccacagccaaagcctcctcatcaacatatgagggtctagtgatatcccttttgccaacacatacagcaatgaattggcaagaaggggctgggaatggaattcccccaaaatcttttcattggaacttttaccccccaaggccccgcccaaggggg

SEQ ID NO: 33607 - protein, 116 aa, Zea mays
  misc_feature: Ceres CLONE 1411626-F
  misc_feature (9)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MARNPGCTVFIGNLDDKVPERVLYEILIQVGRVVDLHIPRDKETSRPKGYAFAEYETEEIAQYAIKLFSGLVRLHNKTLRFAISGQDKPSLNGNIPVTPSLNSVPQPKPPHQHMRV

SEQ ID NO: 33608 - DNA, 673 bp, Zea mays
  misc_feature: Ceres CLONE 1411627-F
  misc_feature: Encodes the peptide sequence at SEQ ID NO. 33609
aaagctggagctccccgcggtggcggccgctctagaactagtggatcccccgggctgcaggaattcgcacgagaccattacatagaacatcctaatcgaaaaacttcattccggtttccggatagcttacctcccatcgacggtcggtgagccgttggtgagtggcgagacagcgggtgcgctgggcaagaacaggcgacgaagaagatgagcacgctggacacgcggacgctcaaggacgagctgacgagcatggacaggaagtgcctcgtggacctcggccacccgctgctcaaccgcgtcgccgacagcttcatccgcgccgctggggtcggggcggccagggccgtctccagggaggcctacgtcgtcaccgtcgaagggctttcaggagactcgtccgggctagacgccgacggcggcaagcggagccatttctccagcatcagaagtgacgacggccagaggtcgctcgacgcagtggtaaaaacggccggcaaggaggccttccagtggggttagtggtgtgattagtctgttcagatctaacagtacgttggaggtccacaagtagtataaccctgtttctctcgacctcgacatgcagggttggcagccggagtctactcagggctcacgtacgcgctgcgggaggccaggggatgccacgact

SEQ ID NO: 33609 - protein, 104 aa, Zea mays
  misc_feature: Ceres CLONE 1411627-F
MSTLDTRTLKDELTSMDRKCLVDLGHPLLNRVADSFIRAAGVGAARAVSREAYVVTVEGLSGDSSGLDADGGKRSHFSSIRSDDGQRSLDAVVKTAGKEAFQWG

SEQ ID NO: 33610 - DNA, 712 bp, Zea mays
  misc_feature: Ceres CLONE 1411628-F
  misc_feature: Encodes the peptide sequence at SEQ ID NO. 33611
  misc_feature (1)..(1): n is a, c, t, g, unknown, or other
  misc_feature (27)..(27): n is a, c, t, g, unknown, or other
ngggtcccaacagaggatcccccgggntggatttacaacacgagaccattacctagaacatcctaatcgaaaaaaaaggcttacctttggctccgctgagagcgggatctcttcttcctcccccagagaccctgccctcttccgccgacagggaggaagcacgcggtgaacagcaacacgtccctgcctttccttttgactccggggatccctctcctccttgcctgccgaggaacccactatgttcctactacttcccctccgacctctcgatccctctccccgatcccttgaccacccgagcatcaagtgacggtgaggaaacgcggaggtgcgctccaggaccgatggataaggtgagagcgccggcgacgctcctggcgctcgccatgcttctcggctgctccagcatcgctgccgtcacggcggaagagaccgaggggatcgaaggaagcgctggagacgtgttagaagataaccctgttggaaggctcacggtcatggtctatgatctcaccggcaaatacgacaagaagctgctgaagaaggatcctaggtgactgaaccacggttctgccggcgagatcatcatgcacagagatctagtagacgagagctgaccgaaccataagacgtgatgcatgaaactggtactacccggccgaatccacgagctgagaacgcaccctcagagctccaacgatggcttaca

SEQ ID NO: 33611 - protein, 70 aa, Zea mays
  misc_feature: Ceres CLONE 1411628-F
MDKVRAPATLLALAMLLGCSSIAAVTAEETEGIEGSAGDVLEDNPVGRLTVMVYDLTGKYDKKLLKKDPR

SEQ ID NO: 33612 - DNA, 658 bp, Zea mays
  misc_feature: Ceres CLONE 1411631-F
  misc_feature: Translation starting site: 157
  misc_feature (568)..(568): n is a, c, t, g, unknown, or other
tccccgcggtggcggccgctctagaactagtggatcccccgggctgcaggaattcgcacgagaccattacctagaacatcctaatcgaaaacctcactctgtctcttcctcagtcccggcatcagcgctcaaaccctaacacgccacgcgatcccgatgcgcaggggtctgggcagcgaggcatcgttgcgccggcggcgcgggccggcgcggctttgggtggcagtggcggcgctggtggtcggcaccgtgtgcctcttctcctcctcttcggtcggcctgttgggcgcctcttacagggtccaggatgttgatgtaaataagttgtggagaactgcagattcaaatggttggagagcatcttctgcaccacgcacctactggcctcccccaccaactgaatctgagagcaatggctacttgcgcgtccggtgcaatggtggcttgaaccaacaacgtagtgcaatatgtaatggctgttgttgctgcacggatcatgaatgctacactggtgctgccagaattagacacaaattcattctggcatgatgaaagtggctttgtaggnaattttatgatgttccccacttcatcaagaccgggaaatatgacgtccggaattgttatgagcattcctgaaatcactacaaatggaaag

SEQ ID NO: 33613 - DNA, 614 bp, Zea mays
  misc_feature: Ceres CLONE 1411633-F
  misc_feature: Encodes the peptide sequence at SEQ ID NO. 33614
tccccgcggtggcggccgctctagaactagtggatcccccgggctgcaggaattcgcacgagaccattacctagaacatcctaatcgaaaaaggtacacatcatctcttccaaatcccaccagcaaatccccaattcctccgagttcgagcgaccatgtcggggcgtggcaagggcgggaagggtctgggcaaaggcggcgccaagcgtcaccgcaaggttctccgcgacaacatccagggcatcacgaagccggcgatccggaggctggcgaggaggggcggcgtgaagcgcatctcggggctcatctacgaggagacccgcggcgtgctcaagatcttcctcgagaacgtcatccgcgacgccgtaacctacacggagcacgcccgccgcaaagacgtcaccggccatggaaggccgtttaagccctcaagggccaggggcgcgccccccctaaggaattcccgggggttgaaaaaggcttccccccccccttggggggcccggggaaaaaaaattttttggggcggcgggggcaaaaaaaaaaaaaagaagtattctttgtgtggggggggggtgtgtctttttaaaaatattactcaaaaaaaaatatat

SEQ ID NO: 33614 - protein, 153 aa, Zea mays
  misc_feature: Ceres CLONE 1411633-F
  misc_feature (25)..(87): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKDVTGHGRPFKPSRARGAPPLRNSRGLKKASPPPWGARGKKIFWGGGGKKKKKKYSLCGGGVCLFKNITQKKIY

SEQ ID NO: 33615 - DNA, 655 bp, Zea mays
  misc_feature: Ceres CLONE 1411635-F
  misc_feature: Encodes the peptide sequence at SEQ ID NO. 33616
gctctagaactagtggatcccccggctggaggaattcgcacgagaccattacctaaaacatcctaatcgaaaactctcattccagaggactccgcgtcgtcaggcccgcttcgcgtgcgacgccggcatatagggtttcgccggagccggcgatggacccaccccccgtgagccccgatcgctgggggcccagtcagggctctggcgtcgggccctccggcctccgccgatatggcctcaatttctccgcctccagcctcctccaggcccccatcgcggccctccttgagtactccggcgtagtccagtccggccctgccctggcggtgcaccacccgtccgcgaggccctcgtcgccgttgtcggcgtcggaggtcgatggtcttctctccgctgccgccgctggggacggggaggtttcgatccggattaagggcggtccaggcgacacggaggccacgggcgtgacgtatgcggcgacctcgtccgaggatttgatcgaggcgaccgacagctctgaggttgaccatggctccgctgcggccaggggggcaggggttacggatggggagccaaaggggggggggcccggcccccccccaaaatggggggggggaaggctctccccagggttaaaaggggaaaaaaatggggg

SEQ ID NO: 33616 - protein, 167 aa, Zea mays
  misc_feature: Ceres CLONE 1411635-F
MDPPPVSPDRWGPSQGSGVGPSGLRRYGLNFSASSLLQAPIAALLEYSGVVQSGPALAVHHPSARPSSPLSASEVDGLLSAAAAGDGEVSIRIKGGPGDTEATGVTYAATSSEDLIEATDSSEVDHGSAAARGAGVTDGEPKGGGPGPPPKWGGGRLSPGLKGEKNG

SEQ ID NO: 33617 - DNA, 667 bp, Zea mays
  misc_feature: Ceres CLONE 1411637-F
  misc_feature: Encodes the peptide sequence at SEQ ID NO. 33618
caatagctggagctccccgcggtggcggccgctctagaactagtggatcccccgggctgcaggaattcgcacgagaccattacctagaacatcctaatcgaaaaatcttcaaaaactacccacggcccgtctcctcgacctccccgaaaccccacttctcggatcgagactagggttagggtttcgtcactcccgccccgattcgaaccaatccgcctaggcccccgccgcgccatggccgccggttccattgtggtggacttcccctccatgggcgccgccctctgcttccccaacctcgaatcactcctccgagactccgcctcgggtttcctctccgccgtctccgccgccccggcccccggtgccgccgacctcaccaaattccaccgcgtcttctcgcgcgtcctcagcacctactcagacccgccgctcgaggtcgactggttcttctccgcgctctccttccacgatcgacctgacgacctccgttcactgcttcagctcctctccggcttcgccgattcctcgcctggggtcgccaagccgatcgccctcctctcccccgtcgcctacgagctttttcacttagatcatcccgcgcatggacaacgaggcccgtcccggaggatgtcctcagattcttcatcatccggctgtagggccc

SEQ ID NO: 33618 - protein, 144 aa, Zea mays
  misc_feature: Ceres CLONE 1411637-F
MAAGSIVVDFPSMGAALCFPNLESLLRDSASGFLSAVSAAPAPGAADLTKFHRVFSRVLSTYSDPPLEVDWFFSALSFHDRPDDLRSLLQLLSGFADSSPGVAKPIALLSPVAYELFHLDHPAHGQRGPSRRMSSDSSSSGCRA

SEQ ID NO: 33619 - DNA, 681 bp, Zea mays
  misc_feature: Ceres CLONE 1411640-F
  misc_feature: Encodes the peptide sequence at SEQ ID NO. 33620
  misc_feature (364)..(364): n is a, c, t, g, unknown, or other
cgcggtggcggccgctctataactagtggatcccccgggctgcaggaattcgcacgagaccattacctagaacatcctaatcgaaaaaaattagggtttctttccgcttgctttccagtttgcggcatcagtcggtggcgcctgcgatggagtctctgttcggccaatcgcagcggaggaggagggcgggcggcagcggcttcgaatcgctcaagcgtctgggtcacatctcacccgctgtgcagtcccacctcaaacatgtgtacctcaccctatgctccgcgctggccttctctgcactcggcgcgtacctccacatcctcctcaacgtcggaggcgccctcacgaccgtgggatgcgtggnctccatcgcctttctcatctccctgcccgcttcacgggaccaggagagaaaccgcttggcgctgctcatgtctgccgcgctctctcaaggggcgtccgtgggcccgttcgccaaccttggtattggcttggaattcaaggatttcccggccctggggtccgtcgggaccccaagtggtttttgcatggctttcctggggcttgccctcttcgccaggggagaggaaaccggggcccccggggggacgtgttttttcggggccccccctttttttcggggggggggggtttggcactcacacttttgccccccacggg

SEQ ID NO: 33620 - protein, 178 aa, Zea mays
  misc_feature: Ceres CLONE 1411640-F
  misc_feature (73)..(73): Xaa is any aa, unknown, or other
MESLFGQSQRRRRAGGSGFESLKRLGHISPAVQSHLKHVYLTLCSALAFSALGAYLHILLNVGGALTTVGCVXSIAFLISLPASRDQERNRLALLMSAALSQGASVGPFANLGIGLEFKDFPALGSVGTPSGFCMAFLGLALFARGEETGAPGGTCFFGAPPFFRGGGVWHSHFCPPR

SEQ ID NO: 33621 - DNA, 823 bp, Zea mays
  misc_feature: Ceres CLONE 1411641-R
ggggttacgattgggtaccgggccccccctcgaggtcgacggtatcgatattttttctttttttttttatgcttcaccagccttaacaaaccgaccctttaccctctttcgcacatctgctctagccttacgagaagcgtacctgattttcttgtcgaactttcttctcattttcttctccttgtatcgtgtgagtgcactgtctctactacctccagcaattgagccctcggggccaggaggctgccaaggaggctcacccataagaagcaatgatgataccacacaatcttggttgtctcccgcactactctcaccagtcaaaccagcaaaggaaagagacagactagacctagcctgcctcaaaggggtacaaacactggaatcacctttcactccagggttcgacatcccagagtcggcagataccgcattgctatttgcaggttgcttcagcttggactgctgaaaagcatgagacaagaatcctataataatcatataataaaacacaaaaacgcaacgtctaatttgtccaaaccagatacgctgactacaggataacaccaaatggtttacagatctggtgacatgagggatgaaaacgtaacggatatttcccgttatctgtccatcctgaaaattcaaaatcctatatgtatagtccttatctgaatctgaacatttaatatccgatcgtaatcaaatctggatacaaaaacagatttctgatatgtataaataaatatcactctaatatatccctatccgggttctgagattccggaaaaaaaatgagataccatatgggaaaatgggagtg

SEQ ID NO: 33622 - DNA, 581 bp, Zea mays
  misc_feature: Ceres CLONE 1411648-R
  misc_feature (195)..(195): n is a, c, t, g, unknown, or other
  misc_feature (199)..(199): n is a, c, t, g, unknown, or other
  misc_feature (202)..(202): n is a, c, t, g, unknown, or other
  misc_feature (203)..(203): n is a, c, t, g, unknown, or other
  misc_feature (238)..(238): n is a, c, t, g, unknown, or other
  misc_feature (239)..(239): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (253)..(253): n is a, c, t, g, unknown, or other
cgattgggtaccgggccccccctcgaggtcgacggtatcgataagcttttttttttttttttttgctcaggcctcaacaagactgacgctatagctattgcaggtaaataccaacatagggcgacacaacatgcgtgtccacattattcatatagagaaataagacaccacatatcaaagcaagctaaataaggntttnccnnccccacggtctccagaaatagggaaacgaaatacnnagctannntcacgntcctttttggggtatggttttgccccactgggcattcaccggaaagccaccccttaaaaaaaaacttgaaaaacgggtggccaaccgttttaaagggggaaattggcttcctgtgggggaaaaaccaccaccgggcgagttttattcttccccacccaccgttggttaccaatttggcccttttgggccgggggtaaaggaaaaccccggggggtcccgggggaaaggccaccccccctggggggggcggggggtttcccccccctttattttcgggggggggggtgggggtgtatacccccccgcaaaaagagggggcccgccctcc

SEQ ID NO: 33623 - DNA, 694 bp, Zea mays
  misc_feature: Ceres CLONE 1411650-F
  misc_feature: Translation starting site: 157
  misc_feature (424)..(424): n is a, c, t, g, unknown, or other
  misc_feature (456)..(456): n is a, c, t, g, unknown, or other
  misc_feature (534)..(534): n is a, c, t, g, unknown, or other
  misc_feature (535)..(535): n is a, c, t, g, unknown, or other
  misc_feature (537)..(537): n is a, c, t, g, unknown, or other
  misc_feature (541)..(541): n is a, c, t, g, unknown, or other
  misc_feature (562)..(562): n is a, c, t, g, unknown, or other
  misc_feature (566)..(566): n is a, c, t, g, unknown, or other
  misc_feature (638)..(638): n is a, c, t, g, unknown, or other
  misc_feature (639)..(639): n is a, c, t, g, unknown, or other
  misc_feature (694)..(694): n is a, c, t, g, unknown, or other
aaagctggagctccccgcggtggcggccgctctagaactagtggatcccccgggctgcaggaattcgcacgagaccattacctagaacatcctaatcgaaaaaattcctgtctgtgcgcgcgcgcgcgtggcgccggccgagcggccgttgacccgatgaccggcgcggcggccgtcgatcccccggtgcctcggccgcggcggctcacggtcctcccgctcatcgcgctcatcttctacgacgtctcgggaggccccttcgcatcgaggactcggtccgcacgggcggcggcgcgctgctcccgatccttggcttcatcgtcctcccagtcctctggtcgctcccggaggcgctggtcacggccgagctcgcatcggctttccccaccaacgccgggtacgtgggcctgggtgtccgccgccnttcggccccgccgtgggcgttcctcgtcgggnttctccaagtggggcgtcggggacgctcgacaacgcgctctaacccggtgctgttcctcgatacctcccgcttccggnngngggnctggcgcttgccgccgccggnccgnttcgctggcggtcctcgcgctcacggccgcgctcacctacctcaaactaccgggggctccacatcgtcggcnntctcggcgctggcgctcaccgcgttctcgctctccccgttcctcgcgctcaccgn

SEQ ID NO: 33624 - DNA, 703 bp, Zea mays
  misc_feature: Ceres CLONE 1411652-F
  misc_feature: Encodes the peptide sequence at SEQ ID NO. 33625
tcaccgcggtggcggccgctctagaactagtggatcccccgggctgcaggaattcgcacgagaccattacctagaacatcctaatcgaaaaactctcattcgcaatttccctacgagctcgagctcacggttcacctcagctcaaaagccagcacaggcaaacccccgtcatggcctcctccaagatactgcgcgccgccgtcgtcgtcgtggccgtcgccgtgtcctccttcgccggtgccgtcctcgccgccgaggaccccgcgacgagcccggcctccggcgccgcggacgtctcctcgtcgctcttggccgccgccctctgcccggccgtcgcgctcctcctcggcaacctgcgccactgatgacacctgcctgcctgtccgacgagagccgccgtgtgctgccacgtgatgttattgtcctctgtatgtgtgtgcgcgtgttcctgacctgagcgtgtcttgtaccgccaccccgcgcgtggattggaactctatcgatcgatcggagattcagcgcgattggttctgtagcagcattggatcagacttcagagagaacgtcacccagattttctgatgcttttttttgagcacgaacatcaacatagttcgcctgatgatgattttttaacaaactaaagaccgtgagaaagcaaatgatacaaacttcccaaatgcttatctaaaccgtccacctc

SEQ ID NO: 33625 - protein, 64 aa, Zea mays
  misc_feature: Ceres CLONE 1411652-F
MASSKILRAAVVVVAVAVSSFAGAVLAAEDPATSPASGAADVSSSLLAAALCPAVALLLGNLRH

SEQ ID NO: 33626 - DNA, 788 bp, Zea mays
  misc_feature: Ceres CLONE 1411655-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (48)..(48): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
nnnnnnnnnnnnnnnnnnnnnnnggggnnnggggnnncccaaaaaaanttggaaannnnaacaaaagctggactccaccgcggtgggcggccggctctagaactagtgagatcccccgggtctgcaggaattcgcatcgagaccattacctagaacatcctaatcgaaaactcgttcccctccctctttccacgacaccaaaagaaaccgaaaaccatcgacgcgctccgtccaccctcccgtaccccgaggcctcctcccctacgactcccagcccagcggcaaaacctaaccctagatgggcgtcgtgacatctatggtcgtgggcgcttatactttgtcccgtctgagacgccgtagtaaggatttaaacaaccggggccgttaccaggaccgggggcaaggcagaaactcccgggttccgggcaaaatacaaaccccgacagaccccggttccgcgagagtaatccaaataaggacctcccttcgggggccccccacccaaagcgctggagaaagacaaccccggcctaccgggtgggtcaataactagaagagaaaggcggcgaacccgctaagaaagaaaaaaaagggtgtggggtcattccggaccgattttttacaagcggaagaaaaccctgtggaacgccggcccctccctcaccccgcaggtggcaccgggaaaaatgagctaacacaaaatcggccccttctctttattttatatacacccttctttaccgctataaaatgctagaggcatatacactgcccccgcgcccattaag

SEQ ID NO: 33627 - DNA, 745 bp, Zea mays
  misc_feature: Ceres CLONE 1411665-F
  misc_feature: SWISSPROT Homolog: EC 1.2.1.3 Aldehyde dehydrogenase (NAD(+))
aaagctggagctccccgcggtggcggccgctctagaactagtggatcccccgggctgcaggaattctgaccagaccattaccgataacaacctaacctaaaagacttatcggatgagttcagcagtacccactccacctccttctacaaatacaagtcaaacacatgccccgaccaaatccgctccgcgccttccgcttccctaccccccgcatcagctaccaatgccgactccatggagaggcttcgcgaaggaggagcaccaggtcctcgccgagctcggcctcgcgcagcgcaacccgcgcgcgatcgcatgaggtgcgaggtgcgaatcaagacccaccgtcacctccacgagcccgaccaacaatcaggtcatcgcagaggtcgtgaaggcgtccgtgcacgactacaaggagggcatgcgcgcctgcttcgacgccgctaagacatggatggagattcctgctccatagcgaggagagatcgataggccaatcggtgatgcactgagagcaaagctccatcaccttgggagacttgtgtcacttgagatgatgaaaattctgcctgaagggatctgtgaggctcaggagatcattgacatgagtgattatgctgtgtgactaggtaggcgactagatggatccattatagcatcgtgacgaccaaaccatatgatgatgcaggtgaggactccccttgcatgtgtgggtgtataacgacatttattgtccctgtgctgg

SEQ ID NO: 33628 - DNA, 667 bp, Zea mays
  misc_feature: Ceres CLONE 1411670-F
  misc_feature: Encodes the peptide sequence at SEQ ID NO. 33629
  misc_feature (321)..(321): n is a, c, t, g, unknown, or other
  misc_feature (429)..(429): n is a, c, t, g, unknown, or other
  misc_feature (430)..(430): n is a, c, t, g, unknown, or other
  misc_feature (433)..(433): n is a, c, t, g, unknown, or other
  misc_feature (434)..(434): n is a, c, t, g, unknown, or other
  misc_feature (444)..(444): n is a, c, t, g, unknown, or other
  misc_feature (538)..(538): n is a, c, t, g, unknown, or other
  misc_feature (667)..(667): n is a, c, t, g, unknown, or other
tccccgcggtggcggccgctctagaactagtggatcccccgggctgcaggaattcgcacgagaccattacctagaacatcctaatcgaaaaaagcttttgctttggtttaggtgcttcttttccacccctttactgttccccccacttttgcttgctttgtcacgcacacgaaaagctcctgcctttaccttatctccgcacccgtagtgggatttggtgggagctgcgctgatcgcccctcgcgtttctttgctcaattgggggtcacggtcacggcccgcgggtgctgcgcgtgctcgtgggcggcgggaattcggggntcttgcgcggtcccggtcccctcggcgattgcggacgctctctgcagatcttcgcgtaactccgggagcgccgccggagattgaactgcgggccgcccgacagttggnncgnncgggtcgggncgccgtcgtgcttcctcaacctgaactgggaccagtctatggccgccgaccagctcgacccggcgtcccagctcgatggctccctccccggcgnccaactcgacgcgggccgccgcggttactgacggccgcgtcctccacgggatctctccgcagcagcagtacggaggcactccgctcagctcgccccccaagctcaacctgttccacaaactcgcccccn

SEQ ID NO: 33629 - protein, 49 aa, Zea mays
  misc_feature: Ceres CLONE 1411670-F
  misc_feature (7)..(7): Xaa is any aa, unknown, or other
MAPSPAXNSTRAAAVTDGRVLHGISPQQQYGGTPLSSPPKLNLFHKLAP

SEQ ID NO: 33630 - DNA, 690 bp, Zea mays
  misc_feature: Ceres CLONE 1411673-F
  misc_feature: Encodes the peptide sequence at SEQ ID NO. 33631
  misc_feature (490)..(490): n is a, c, t, g, unknown, or other
  misc_feature (491)..(491): n is a, c, t, g, unknown, or other
  misc_feature (649)..(649): n is a, c, t, g, unknown, or other
aaagctggagctccccgcggtggcggccgctctagaactagtggatcccccgggctgcaggaattcgcacgagaccattacctagaacatcctaatcgaaaaatccgattcactccaatacagattcatcgccttaaacccctctttaaatccattaactacgatctacccttcaattcgagtttctcatctgcaaggcggtctatctgcgattagccttcctccaataaaattcatcttcccagttcgttaaaacaacaaagtaaatttatttaccgacaaatggctgatttcaaagttcttctttctgatttgaagtcaatcgcggttgggaacttatatgctcttactagatgcaaagttgctttgttgatgacatagaagaaaagaagggagggagcagaaggagagtattgttaatggtatcagagagactgtcaaaaatataactctgtccatgtttctcttttgaaaacatgaaaaatatcannattcaggagtttagacaacagtttagacacaacgaaaagttcttcctcggctagaacaaattgatgcagtttgctcttggtccttctgcttgggatgaaatcatcctgccatctttaaagcttccagattcttcatggggagatgactgcttaatacngatatgccaaaggaagaagttggaagcttatttgactctta

SEQ ID NO: 33631 - protein, 45 aa, Zea mays
  misc_feature: Ceres CLONE 1411673-F
  misc_feature (32)..(32): Xaa is any aa, unknown, or other
MQFALGPSAWDEIILPSLKLPDSSWGDDCLIXICQRKKLEAYLTL

SEQ ID NO: 33632 - DNA, 687 bp, Zea mays
  misc_feature: Ceres CLONE 1411679-F
  misc_feature: Translation starting site: 448
  misc_feature: SWISSPROT Homolog: EC 2.7.11.1 Non-specific serine/threonine protein kinase
  misc_feature (406)..(406): n is a, c, t, g, unknown, or other
  misc_feature (638)..(638): n is a, c, t, g, unknown, or other
aaagctggagctccccgcggtggcggccgctctagaactagtggatcccccgggctgcaggaattcgcacgagaccattacctagaacatcctaatcgaaaaaatcgatcagtcgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggccggaacctcgcgtccgngcgagagcgtggccatcaaggtcatcgacaaggagaaggtgatgcgcgtcggcatgatcgaccagatcaagcgcgagatctccgtcatgcgcctcgtccgccaccccaacgtcgtgcagctgcaccgaggtgatggccagcaagagcaagatatactcgcccatggagtacgttcccgggggcggggagctctttcgcccgcgtcggcccgcggcggggttaaaggaggagnccccggaagaaggtatttcccacagttgggggtgggggcccgtcgactt

SEQ ID NO: 33633 - DNA, 704 bp, Zea mays
  misc_feature: Ceres CLONE 1411681-F
  misc_feature: Translation starting site: 443
  misc_feature: SWISSPROT Homolog: EC 1.2.1.3 Aldehyde dehydrogenase (NAD(+))
cgctctgaactagtggatcccccgggctgcaggaattcgcacgagaccattacctagaacatcctaatcgaaaaactgcgcctgcggaggatcttaggaaccagcagcgcaggcttcgattttcgtcgctcgcaataaatttcccgcatggttcggagggccgcgtcctcggtcgtctcccgctgtctcctggcgagggcccctgccggcgcgccgcccgctgccccctctgcgctgcgcaggacagtgcctgcagatgcgatgcacaggctgttgccaggtgtccttcagaggttcagcactgcaacagcagtataggagcccatcacgccgtcagtccatgtgaactacacaaagctcctcattaatgtcaactttgttgattccgcatccggcaagaccttcccaactctggagcctcgaacaggggaggtgattgctcatgtggctgagtggtgacgcagaggacattaaccgtgcagtagctgcggctcgcaaggtttttgatgaagggccatggccgaagatgactgcctatgacaggtcccgtatcctactgcgatttggtgatttgatagataagcactatgactagcttgctgctttgtagacatgctacaacggctagccatatgagcaagcatgccagattgaagtacccatggtggcccgtcttatgcgatactatgctgaatgcgctgata

SEQ ID NO: 33634 - DNA, 626 bp, Zea mays
  misc_feature: Ceres CLONE 1411682-F
  misc_feature: Encodes the peptide sequence at SEQ ID NO. 33635
  misc_feature (208)..(208): n is a, c, t, g, unknown, or other
  misc_feature (209)..(209): n is a, c, t, g, unknown, or other
  misc_feature (217)..(217): n is a, c, t, g, unknown, or other
  misc_feature (323)..(323): n is a, c, t, g, unknown, or other
tcaccgcggtggcggccgctctagaactagtggatcccccgggctgcaggaattcgcacgagaccattacctagaacatcttaatcaaaacaaaaagttcgcgccgccgactcgcctcgcgtcgcctcactagggtttgcagttcccgtcgcgggcgaaggcggcgtcgtctcgtggcggcgccgtctccgtgtgccttcccgctccnnagcatggnctttggagatgggagcccagctacttttacttcacaagtgattgctaatgcatttgtcaaaacatactatcaaactcctcgaaatggcaggaaaggatgcctattnattctattaataaccaaggtattccttggtcgaaagaattctaatgggaaaaatgtttttggtaacccccattggtggaattcaaggggcaccttggggtaaaaaatgggggggactgttttaaaaaaaaccagaactttttttgccagccctccctggggggggggggggggatttttgggggggggggaaatttaaacaaggggtgtggggaaaaaaaaaattaaaaaacaatttttttttcccccccccggaaaaaaggggggtttattgtttttggaaggagggacttcccaatcttcg

SEQ ID NO: 33635 - protein, 70 aa, Zea mays
  misc_feature: Ceres CLONE 1411682-F
  misc_feature (2)..(2): Xaa is any aa, unknown, or other
  misc_feature (37)..(37): Xaa is any aa, unknown, or other
MXFGDGSPATFTSQVIANAFVKTYYQTPRNGRKGCLXILLITKVFLGRKNSNGKNVFGNPHWWNSRGTLG

SEQ ID NO: 33636 - DNA, 698 bp, Zea mays
  misc_feature: Ceres CLONE 1411686-F
  misc_feature: Translation starting site: 232
  misc_feature: SWISSPROT Homolog: EC 1.2.4.1 Pyruvate dehydrogenase (acetyl-transferring)
  misc_feature (527)..(527): n is a, c, t, g, unknown, or other
  misc_feature (528)..(528): n is a, c, t, g, unknown, or other
  misc_feature (608)..(608): n is a, c, t, g, unknown, or other
  misc_feature (610)..(610): n is a, c, t, g, unknown, or other
aaagctggagctccccgcggtggcggccgctctagaactagtggatcccccgggctgcaggaattcgcacgagaccattacctagaacatcctaatcgaaaactccaccagtccaccatcgccacctacgcccaaccaaacccaactccatctcttccgactataaacgcaacccaccaccgctgccgcgaacctctgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcgggacgcggaaggctggtggcgcgtgcagcagttacagcaaaggcggatgtaccatcgagcacgtccgacggccatgaggtcttgctgtttgaagctcttcgtgaggccttgatggaagagatggaattagatccaacagtgtgtgtattttggtgaagatgttggcccattacggtggttcttacagnntgacaaaagggtttggctgatacgtttgaggaaactttcgagttctggacacccctattgcggagaactcgtttattggncnatgggaagttggagcggggaatgaaaaaaggctgaagggccccgtcgttgaaggcatggaaacatggggattcctggctccttgcttt

SEQ ID NO: 33637 - DNA, 689 bp, Zea mays
  misc_feature: Ceres CLONE 1411687-F
  misc_feature: Encodes the peptide sequence at SEQ ID NO. 33638
  misc_feature (346)..(346): n is a, c, t, g, unknown, or other
  misc_feature (411)..(411): n is a, c, t, g, unknown, or other
  misc_feature (476)..(476): n is a, c, t, g, unknown, or other
  misc_feature (481)..(481): n is a, c, t, g, unknown, or other
  misc_feature (494)..(494): n is a, c, t, g, unknown, or other
  misc_feature (522)..(522): n is a, c, t, g, unknown, or other
agagctggagctccccgcggtggcggccgctctacaactagtggatcccccgggctgcaggaattcgcacgagaccattacctagaacatcctaatcgaaaaatcaaccatattattgagaccaacaagcaacatagaaggtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccnacaagcaatcgcagcaggcaacatacctttatcacccttgtttcaacaatcgccagccctatctntggtgcagtcattggtacaaaccatcagggcacagcagctgcagcaactcgtgctacctgtgatncaccnagtagctctggcnaacctttctccctactctcagcaacacnatttcttccattcaccaactgtctactttgaacgtgctgcttatttgcaggacaactataaccatccagcccgttggttctgcctactcttagaacaacaacttcttccatataaccattgggccgacggaccccggttgtttatttgggaaagcaaaacaacaaca

SEQ ID NO: 33638 - protein, 173 aa, Zea mays
  misc_feature: Ceres CLONE 1411687-F
  misc_feature (59)..(59): Xaa is any aa, unknown, or other
  misc_feature (81)..(81): Xaa is any aa, unknown, or other
  misc_feature (102)..(102): Xaa is any aa, unknown, or other
  misc_feature (104)..(104): Xaa is any aa, unknown, or other
  misc_feature (118)..(118): Xaa is any aa, unknown, or other
MATKIFSLLMLLALSACVANATIFPQCSQAPIASLLPPYLPSMIASVCENPALQPYRLXQAIAAGNIPLSPLFQQSPALSXVQSLVQTIRAQQLQQLVLPVXHXVALANLSPYSQQHXFFHSPTVYFERAAYLQDNYNHPARWFCLLLEQQLLPYNHWADGPRLFIWESKTTT

SEQ ID NO: 33639 - DNA, 678 bp, Zea mays
  misc_feature: Ceres CLONE 1411689-F
  misc_feature: Encodes the peptide sequence at SEQ ID NO. 33640
  misc_feature (628)..(628): n is a, c, t, g, unknown, or other
aagctggagctccccgcggtggcggccgctctagaactagtggatcccccgggctgcaggaattcgcacgagaccattacctagaacatcctaatcgaaaaacaccatcatcacactcgaaacccaacagcttccttcctggcgatccaattaacggcttctcttctgagctcagcacgaacaatggccaccatcctcaccgtcgcaagcttcttcgcacttgtgtgcatctctcaacaagcgcgggctgcgaactacacgttcatgaaggacgcggtgcacgcgccgcggacgggcttctacgactacatcatagtcggcggcggcacggcgggctgcccgctggcggccaccctgtcggcccgcgcgcgggtgctgctgctggagcgcgggggctctccgtacgaggacgcgcgcgtcctgaacatggcccacttctcggacgtgctggcggacacgtcggcgtcgtccccgtcgcagcggttcgtgtcggaggacggcgtgatcaactcccgcccgcgcgtgctgggcggcggcagctgcatcaacgccggcttcttcacgcgcgccggcgcgggctacgtcagggccgccggctggaccccaggggaggtgcgggcgcgtacgntgggtggggaggaagaaggtggtcgcgttccggccggcgctggggcccgt

SEQ ID NO: 33640 - protein, 165 aa, Zea mays
  misc_feature: Ceres CLONE 1411689-F
  misc_feature: SWISSPROT Homolog: EC 4.1.2.10 Mandelonitrile lyase
  misc_feature (149)..(149): Xaa is any aa, unknown, or other
MATILTVASFFALVCISQQARAANYTFMKDAVHAPRTGFYDYIIVGGGTAGCPLAATLSARARVLLLERGGSPYEDARVLNMAHFSDVLADTSASSPSQRFVSEDGVINSRPRVLGGGSCINAGFFTRAGAGYVRAAGWTPGEVRARTXGGEEEGGRVPAGAGAR

SEQ ID NO: 33641 - DNA, 664 bp, Zea mays
  misc_feature: Ceres CLONE 1411690-F
  misc_feature: Encodes the peptide sequence at SEQ ID NO. 33642
  misc_feature (592)..(592): n is a, c, t, g, unknown, or other
  misc_feature (621)..(621): n is a, c, t, g, unknown, or other
aaagctggagctccccgcggtggcggccgctctagaactagtggatcccccgggctgcaggaattcgcacgagaccattacctagaacatcctaatcgaaaataccgcctgatccaccgcggtttgcttgccgcgagcatggaaattattagtcattcgacaagtcagagagattttatttcctctcgtcgtctcgtggccgctggtgcccgcgcgtcagatttggcctgctccgctccgcctccgcagtgtgaatttctgagagataggtttctgtgctgcagacagcccggcggcgacgcggtggcagtttgcggcgaggtccggcgtcgcgccggcgttcatgtcgttcaggacggaggcgacgggcgagggctctgaggcgttctcggtctccgagctccggccggccggagacgccttcgacggcatcaagaagcagagctccatgctttcgatctaccagcagaggcagtttggccacaacagcagccaggccacggcacagcagcagtaccctgcagcggcgcacaggcagcgctcgcaggtggcggattacggcgcggcggcaccgcatcgtctccctggtggntggtggtggtggatgcaggctagtgcagnccggtgtcggtgcgccaccctgtgccgtttcatcaggccaccc

SEQ ID NO: 33642 - protein, 107 aa, Zea mays
  misc_feature: Ceres CLONE 1411690-F
  misc_feature (93)..(93): Xaa is any aa, unknown, or other
MSFRTEATGEGSEAFSVSELRPAGDAFDGIKKQSSMLSIYQQRQFGHNSSQATAQQQYPAAAHRQRSQVADYGAAAPHRLPGGWWWWMQASAXRCRCATLCRFIRPP

SEQ ID NO: 33643 - DNA, 678 bp, Zea mays
  misc_feature: Ceres CLONE 1411691-F
  misc_feature: Encodes the peptide sequence at SEQ ID NO. 33644
  misc_feature (524)..(524): n is a, c, t, g, unknown, or other
  misc_feature (525)..(525): n is a, c, t, g, unknown, or other
  misc_feature (538)..(538): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (660)..(660): n is a, c, t, g, unknown, or other
  misc_feature (665)..(665): n is a, c, t, g, unknown, or other
ggagctccccgcggtggcggccgctctagaactagtggatcccccgggctgcaggaattcgcacgagaccattacctagaacatcctaatcaaaaacaacacaacgcttatattacttacaacaaaagataagcccacgaatcagtagatcgaggtcccgcccagtccagcagaagcgcacacggagatgtcccagctgagccctgctggccacatggctgcgacgctcctcctcatcctcctggcctccgcagcagcagcagcggtgtcagctgaccaacaggtctctgcctgccagaatgacatagacgcactgtggcgcagctgcaagcagttcgtccagaaggaggggcccaagatgcctccgtccgaggactgctgcaaaaccatcaaggccttagacgcgcacgcgtcctgcatctgcgactacgtcggctccccggacgccaggaataagctagacctgggacaagggtgttcttcgttaccaaacagtgcggcgtcaccgtccccaagggctgcgnnatcaaagcagganctgaagagcggctgaatctgaatgggagcaagttggctaacatacgcacggcagctacaatacttatagaataaaaataagttggtcaacatcgtgttggtttcaaaannnnnnnnnaaaanaaaanaaaaaaaaaaaaa

SEQ ID NO: 33644 - protein, 121 aa, Zea mays
  misc_feature: Ceres CLONE 1411691-F
  misc_feature (113)..(113): Xaa is any aa, unknown, or other
  misc_feature (117)..(117): Xaa is any aa, unknown, or other
MSQLSPAGHMAATLLLILLASAAAAAVSADQQVSACQNDIDALWRSCKQFVQKEGPKMPPSEDCCKTIKALDAHASCICDYVGSPDARNKLDLGQGCSSLPNSAASPSPRAAXSKQXLKSG

SEQ ID NO: 33645 - DNA, 665 bp, Zea mays
  misc_feature: Ceres CLONE 1411694-F
  misc_feature (430)..(430): n is a, c, t, g, unknown, or other
  misc_feature (584)..(584): n is a, c, t, g, unknown, or other
cgcggtggcggccgctctagaactagtggatcccccgggctgcaggaattcgcacgagaccattacctagaacatcctaaaaaaaaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgccctcttcgcgcccccgatcgcccgattccttcagggccaaagttacagatgttccagtgtttaccaacagagttttctcgtacgtaccgggcaaaatcattgacagttccagatcacggagtttgatgtgtgtcctttggaaacnaatgagtatgtcccctgccatgatggagcctatataagcagcttgaagagcctggatcatcaagggcatgagaatcttggaaagtatttgtcctcatgggaagaagcgggttggttttttggtttggtgccccctccaaatgactacaagatanccaataagatggccaacaagccgagactacgttatggggcgtagtaatgtcaaccattcacattcttgctgagggtcaaag

SEQ ID NO: 33646 - DNA, 672 bp, Zea mays
  misc_feature: Ceres CLONE 1411695-F
  misc_feature (386)..(386): n is a, c, t, g, unknown, or other
  misc_feature (646)..(646): n is a, c, t, g, unknown, or other
aagctggagctccccgcggtggcggccgctctagaactagtggatcccccgggctgcaggaattcgcacgagaccattacctagaacatcctaatcgaaaaattacggctgaagggagtcgctcgccgccgcgttcgaggcgttccctcgtcgcgctcgcgccgtcgaccttcaccgctcgctgtcaggtctgcccgccacgacctcgccggccacactcgcagctcgccctcgctcctacgcctcgccggcgaggccttctgccttttcgcgccctctatctgctgcgatctttggagcatcgttctcttctctcacttgagatccagacccctaaaccctagagctcgccgcttccgctcgctcgctccgcgctggcggcgacnatggaggacgaggagattggagaagaaggtgcagcagtacttgcaggcgcaagggtttccgcctcactgagcttggctcccaggaggagtgcaaccgcctctcccctccccattctccgacgttgcgcttgcacggtctgacaatgatccaggagaatactacgaggggatatagcagattaagaacatggggcatacagttctcttgatcaatataagcacaatttacttcgcgtccttttatccagttttctccatangcttcaatggatctaggtggcagaag

SEQ ID NO: 33647 - DNA, 664 bp, Zea mays
  misc_feature: Ceres CLONE 1411701-F
  misc_feature: Encodes the peptide sequence at SEQ ID NO. 33648
tccccgcggtggcggccgctctagaactagtggatcccccgggctgcaggaattcgcacgagaccattacctagaacatcctaatcgaaaaagtttcgacagtcgtcgtcccctctactctcccggcttccgcagaatcccagcttctctggccctctcactccaaacatcgggctccaggccgtctcccgccaacccaaattcgcttcccgccgctccccattaaacccgcttgaaaggtcgcgccctcgagcagagcaacccctgaccacaaatccgatccgtagccgccgtgcctcgatttcgtctcttcccctctgctcgagtacgagcggctactcccggcggcggcggcggcggcggcgatgagcgcggtgagctcgaccatatcaaggagctgatcaagtggggaacagactacatcctcaaaaccttcaattcatctgctgacacgatagacaggattgtcgctcaggtgggtgtaggtgacacctctaaaggcagcagtcagcctaatgaccattactgctggatgagaccagaggacatcgactacaaaaggccagtcaccgagtgtcactcttgctcagatctagcgtctgaaatggctgctgccctggctgcagcttccatagtgttcaaggacagcaaaacctactccgac

SEQ ID NO: 33648 - protein, 44 aa, Zea mays
  misc_feature: Ceres CLONE 1411701-F
  misc_feature: SWISSPROT Homolog: EC 3.2.1.4 Cellulase
MRPEDIDYKRPVTECHSCSDLASEMAAALAAASIVFKDSKTYSD

SEQ ID NO: 33649 - DNA, 671 bp, Zea mays
  misc_feature: Ceres CLONE 1411712-F
cgcggtggcggccgctctataactagtggatcccccgggctgcaggaattcgacgagaccattacctagaacatcctaatcgaaaaatccatgcggcggagctctcttcgtctcccgttccccctaacgcgtgcgctccttcgccgactgggcgaccgccgccgccggcctcgcccaggtctccgtccggccctacgacaggttccatcgggcccttagccggcgacaagcaccaccaggtgcactttctctattcagagactgattaggagttcgaggagcaaatcaattcgtaccaaatataaccaagcttacatggctaagccaagtgattcatcacatcattgagttgtggacaatagctccaatggatcccaggctaggcgtgaggaagctgggaaacttggtccatcgtggtatttcagtagaagggaaatagaggaaaactctccatccaggagggatggcatcgatttgaagaaagagtctagcattcggaagttatattgcaagtttctacaagagttgggcatggcgcttaaaatgccccaagtgacgattgccacagcaatggtattctgtcatcgtttttaccttcgtcaatcccttgcaaaaaatgatagacgaataatcgctactgttttgtatattcttgggctggaaaagttgaa

SEQ ID NO: 33650 - DNA, 688 bp, Zea mays
  misc_feature: Ceres CLONE 1411713-F
  misc_feature: Encodes the peptide sequence at SEQ ID NO. 33651
  misc_feature (573)..(573): n is a, c, t, g, unknown, or other
  misc_feature (610)..(610): n is a, c, t, g, unknown, or other
  misc_feature (611)..(611): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
caaagctggagctccccgcggtggcggccgctctagaactagtggatcccccgggctgcaggaattcgtacgagaccattacctagaacatcctaatcgaaaaaaccaaacctcacctaatcgcaacgacagcgagaacgtccaaacgagcgcgagtctccggcgataaccaagagcgcgggcacgcaaagcggcgaagcgggaaggaagcagtaacgatggggcttgactattacaagatcctaggcgtcgacaagggcgccaccgatgacgacctcaagaaggcctaccgcaagctcgccatgaaatggcaccccgacaagaaccccaacaacaagaaggaggccgagaacaagttcaagcagatctcggaggcgtacgaggtgctgagcgacccgcagaagcgcgcggtgtacgaccagtacggcgaggagggtctcaaggggcaggtgccgccgccgggcgccgggcggggcgggccccggcggcgcaaccttcttctccaccggcggcgacgggccgacgggtgttccggttcaaccccgcgcaacgcggaggacattcttcgccgangttcttcggcggctccagccccttcggcggtatgggnncggcggtggcatgggcggaccggcattggggggggggggggaaatgcccggcatgcggacggnnnngggacaaggtt

SEQ ID NO: 33651 - protein, 156 aa, Zea mays
  misc_feature: Ceres CLONE 1411713-F
  misc_feature (4)..(67): Pfam Name: DnaJ Pfam Description: DnaJ domain
  misc_feature (119)..(119): Xaa is any aa, unknown, or other
  misc_feature (131)..(131): Xaa is any aa, unknown, or other
  misc_feature (153)..(153): Xaa is any aa, unknown, or other
MGLDYYKILGVDKGATDDDLKKAYRKLAMKWHPDKNPNNKKEAENKFKQISEAYEVLSDPQKRAVYDQYGEEGLKGQVPPPGAGRGGPRRRNLLLHRRRRADGCSGSTPRNAEDILRRXSSAAPAPSAVWXRRWHGRTGIGGGGGNARHADGXGTR

SEQ ID NO: 33652 - DNA, 662 bp, Zea mays
  misc_feature: Ceres CLONE 1411714-F
  misc_feature: Encodes the peptide sequence at SEQ ID NO. 33653
ggagctccccgcggtggcggccgctctagaactagtggatcccccgggctgcaggaattcgcacgagaccattacctagaacatcctaatcaaaaaatcccaaatagttactccactcccctcacccctcccgactcccgggctctctctctctctctctctcggatccgaattgccagcgcaccagtcgagctcgcgggaactcgccggcaccggcgatggcctccgccctactggccggacagggcggggcgcgccaccacggctggggggagacgcgcgccccactcgcgcccatacctcccaaccctaaccccagccagccccacccgcgcgccgacgggtccaagtccaagccgcgggtggcagcctcctcgacggcggccggatacgtgacgttccgaccggcgtccctgggcccgcgcgaggcccgcgcgctccgggaccgcctcgcgggggagctcaaccaggtgcgcgacctcctctcccgcatggacacctggcagtagcaggagccgccgcccgcggaggtccccgacaaggtggatgagccgagcgtgcagaatgtcccccaggtgctgaaggaatagcggagcgtgtgcgtcacagctgccgtctaggtggagcgggaaatactccagttaacacatcggctacgagcg

SEQ ID NO: 33653 - protein, 96 aa, Zea mays
  misc_feature: Ceres CLONE 1411714-F
MASALLAGQGGARHHGWGETRAPLAPIPPNPNPSQPHPRADGSKSKPRVAASSTAAGYVTFRPASLGPREARALRDRLAGELNQVRDLLSRMDTWQ

SEQ ID NO: 33654 - DNA, 677 bp, Zea mays
  misc_feature: Ceres CLONE 1411724-F
  misc_feature: Translation starting site: 228
  misc_feature (435)..(435): n is a, c, t, g, unknown, or other
  misc_feature (521)..(521): n is a, c, t, g, unknown, or other
  misc_feature (522)..(522): n is a, c, t, g, unknown, or other
  misc_feature (606)..(606): n is a, c, t, g, unknown, or other
cgcggtggcggccgctctagaactagtggatcccccgggctgcaggaattcgcacgagaccattacctagaacatcctaatcaaaaaaaacgaaaaactaccaaaaaaattagaaatccccaaatccgcgagatctatcagtatcgagcgatttaccgatccgattgctagggtttagtttcgaaaaagaaactctgaaaaaaaattctggtcgaggggaggagacgatggcagcgcaagtggcggcggtggtggtgccgaatgggagcccgggcgctgtccccgcggtggtgtcgccgggagcggtcggcgtcggactcggcgtggcgcagccgctcccgaccacgtcgctctacgtcgggacctgggaaggggcccgtctcggactcgcagctgtacgagctcttcagcaggcggggcagggtgggtgtccgntgcgcgcttggacaggaacgtcacctcgcgccgctcgctcggatacgcctacgtcaacttcaacaacccccttggatgctgcaggnnaattgggaaggtgctgaacttttgctcctcttaacacaaacctataccgggggggatgtatttccaaacggtgatccaagtagncggaaggggagggaatccggcttacccattttcattaaaggatctttgaccaggatggatagacaataaat

SEQ ID NO: 33655 - DNA, 815 bp, Zea mays
  misc_feature: Ceres CLONE 1411725-R
  misc_feature (1)..(1): n is a, c, t, g, unknown, or other
  misc_feature (2)..(2): n is a, c, t, g, unknown, or other
nnaaaaacccaattgggtccggggccccccctcgaggtcgacggtatcgataagcttttttttttttttttttcctggtctctaaacaccgctgcggagcaatatatggatggatttcactgacactctctgcaagctacctattgtacatatgactgctcactgagctgttgacacaatctgatcaacgaatacatttccatccgttgcacttaacgaaaccccatcatctccaatttgtcaccaatcgattggaatctgaccctaaactgatttgtgatctatgtgcaacaactcattgacgggtggtaccatttttagttaggaacgtttcctagtatttagaaataaagaatcccccctaaggcgcggatcacataccatcaatgccgtcgatcgtagattttgatgcctccacctgagatcatcactgaacctgctataacaatagggtcttggtggataagcaccatggtcaggaccaggtgggtacagcaactctgctcctggccggatgggggaaatgacttgccctggatcaataacaggaaacatacttccactaactgttcttatgattataacaggaattggaaatcttgcttcactagagctcaaatcataacaatattcaaaaagaatcctggagtcagcagcatgacgatttgcttgaacttgcgcatgaaaactctgggttatataagtatacgctgggtctgccaagtatgtgaaagaaatacagtgtcaaaatagtaatgaagtccatgtctgttggtttatttccacagtatcccgcttatagtgatgcctattgc

SEQ ID NO: 33656 - DNA, 666 bp, Zea mays
  misc_feature: Ceres CLONE 1411725-F
  misc_feature: Encodes the peptide sequence at SEQ ID NO. 33657
aaactggagctccccgcggtggcggccgctctagaactagtggatcccccgggctgcaggaattcgcacgagaccattacccaacatcctaaacgaaaaagattacggggccgagccatcgtcatcgagacatcgaccgactccgactccgactccatccacggtctccttccgagatccctcttctcctcccgcccccgcctgaccgcctccctcctcactccggccccttccgcatgtcaatccatgggctgatactcgaagtcagagtcaccgggtgccggaagctgcgctacacggagttcttcacccgccaggacccctacgtcggcgtcaagtacgccaccaccaagctccggactcgcacctggaccgatgggggaagaaacccaactttccatgagaagatccatatacccctcattggagggctccgccagttgaatgttattgtgtggaatagtaatacattaactcatgatgacttcattgtaaggggaatagtatatctgcacaaggtgctgaccaatgggtatgatgactcctcatggacgcttcatacacggcacatgatatctggtgcggaaacgaagctcattatgcatggtgatggctcaccgatgaagaactagatgtatagaagtgtcgccgcatcaagtgcacatc

SEQ ID NO: 33657 - protein, 131 aa, Zea mays
  misc_feature: Ceres CLONE 1411725-F
  misc_feature (8)..(89): Pfam Name: C2 Pfam Description: C2 domain
  misc_feature: SWISSPROT Homolog: EC 3.1.1.4 Phospholipase A(2)
MSIHGLILEVRVTGCRKLRYTEFFTRQDPYVGVKYATTKLRTRTWTDGGRNPTFHEKIHIPLIGGLRQLNVIVWNSNTLTHDDFIVRGIVYLHKVLTNGYDDSSWTLHTRHMISGAETKLIMHGDGSPMKN

SEQ ID NO: 33658 - DNA, 592 bp, Zea mays
  misc_feature: Ceres CLONE 1411729-F
  misc_feature: Encodes the peptide sequence at SEQ ID NO. 33659
  misc_feature (250)..(250): n is a, c, t, g, unknown, or other
  misc_feature (261)..(261): n is a, c, t, g, unknown, or other
  misc_feature (338)..(338): n is a, c, t, g, unknown, or other
aagctggagctccccgcggtggcggccgctctagaactagtggatcccccgggctgcaggaattcgcacgagaccattacctagacatcctaaaaaaaactgaggcgagggagagagagagagagtgagtgagtgagtaatgggcggttcatcaggccttgtggactggagaggacggccggtgaacaccaagaagcatggaggagtgagagcttcaattttcattcatgggcgctggtgctgctcagcnaacgtagcccnacatttggccagtatacctgaatctttgtagctatctgcgcgaggagatgcacatggatgtcgcgagggcgacgacnatggcgaagcatttctttgccgggtgcaaatgtcttcatcccagaggcttcctggtgactctaaatcaagggtttaacctggcctctccttggcccattgaaaaattggataattctggtccggggcaagaaatttcccattcctgacccccaacgggggtccctggaaaaaaaaaaaaaccggggggccccggggggggttaaaaccaggccccgcccccccgggggtttcaccgggacccccccgggggggg

SEQ ID NO: 33659 - protein, 50 aa, Zea mays
  misc_feature: Ceres CLONE 1411729-F
  misc_feature (41)..(41): Xaa is any aa, unknown, or other
MGGSSGLVDWRGRPVNTKKHGGVRASIFIHGRWCCSANVAXHLASIPESL

SEQ ID NO: 33660 - DNA, 683 bp, Zea mays
  misc_feature: Ceres CLONE 1411731-F
  misc_feature: Translation starting site: 193
  misc_feature: SWISSPROT Homolog: EC 1.14.13.68 4-hydroxyphenylacetaldehyde oxime monooxygenase
  misc_feature (369)..(369): n is a, c, t, g, unknown, or other
  misc_feature (470)..(470): n is a, c, t, g, unknown, or other
  misc_feature (485)..(485): n is a, c, t, g, unknown, or other
  misc_feature (509)..(509): n is a, c, t, g, unknown, or other
  misc_feature (578)..(578): n is a, c, t, g, unknown, or other
aaaagctggagctccccgcggtggcggccgctctagaactagtggatcccccgggctgcaggaattcgcacgagaccattacctagaacatcctaatcgaaaaagcaacccagccgcccattgccggcattgctcgcagcgctagcttcttgcgctcatcactcgtctccgaccaagatcagcaaggacggcatggctctcgaagcagcgtacgactacctgcacgtcgccgtcgtccagtgcacgcccacacaagcagcagcagtcctcggcgtcctcctcctcctcgccatccggctagccgcggcggcgaggagctcgtccgcgacgtcccccaaatggaagcagcacaggctgccgccgacgccntccggggaagctccccatcatcgggcacctccacctcatcggctcccacccgcacgtctccttccgcgacctccacgccaagtacggccacacggctgtgnctggtgggaagaagnccgcgccggccaccaactttcggntgcccccgccgcaggccggccgagcccgtgctccgcagcacgaccaccgggctggcgtcccgcccgcgnaacccccgtcgccgacatcatccgctacactttccacggacgtggccttcgcgccgtacggcgagtactggggcacggggggggaaaggtggtcaacacgcacct

SEQ ID NO: 33661 - DNA, 684 bp, Zea mays
  misc_feature: Ceres CLONE 1411734-F
  misc_feature: Translation starting site: 256
  misc_feature (438)..(438): n is a, c, t, g, unknown, or other
  misc_feature (535)..(535): n is a, c, t, g, unknown, or other
  misc_feature (651)..(651): n is a, c, t, g, unknown, or other
cggtggcggccgctctagaactagtggatcccccgggctgcaggaattcgcacgagaccattacctagaacatcctaatcgaaaaatccgatctaaccctaaacccgaatcccaaacggaggagggcactcggcgaggcaggtggcgattctgcgattctcctgtcaccttccgtcgtctccatccccttccatttccggcgagggtcaaagcaggcctcttgctcttgggggtggtttgagagagggagagaacatggccgcggcggcggtgttggtggtgctcacggtgtcagcgctggcgggggcagcggccggcggtgatatcgtccaccacgatgacgaggcacccaagatccctggatgctccaacgattttatcttggtaaaagtgcaaagctgggtcaatggcaaagagggtggcgagtttgttggcggncggtgctcggtttggtccaaaaatcgtctccaaggagaagcacgcaaaccgaactaaactcacgctggcagaccctatggactgctgctctcctcgnaaacataaggttcccctggagatgtttcttttaagtcaaaaaggggaaagtgcaaattcacaaagaaaagcaaagtttgctggaaaggctggctggtgcttctggctatagtaatncataaaccatggtccacgattggggtaccaagt

SEQ ID NO: 33662 - DNA, 648 bp, Zea mays
  misc_feature: Ceres CLONE 1411735-F
  misc_feature: Encodes the peptide sequence at SEQ ID NO. 33663
aaagctggagctcaccgcggtggcggccgctctataactagtggatcccccgggctgcaggaattcgcacgagaccattacctagaacatcctaatcgaaaacacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggttagtggggtttattcggatgataataaccttcagcttgaggccaccacacagttccgcaaattgctctctatagagaggagtccccccatcgaagaagttatcaaaacaggtgtagttccaagatttgtgcagtctctcaccagagaggatttcccccagct

SEQ ID NO: 33663 - protein, 128 aa, Zea mays
  misc_feature: Ceres CLONE 1411735-F
  misc_feature (4)..(92): Pfam Name: IBB Pfam Description: Importin beta binding domain
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPIEEVIKTGVVPRFVQSLTREDFPQ

SEQ ID NO: 33664 - DNA, 665 bp, Zea mays
  misc_feature: Ceres CLONE 1411736-F
  misc_feature: Encodes the peptide sequence at SEQ ID NO. 33665
  misc_feature (423)..(423): n is a, c, t, g, unknown, or other
  misc_feature (542)..(542): n is a, c, t, g, unknown, or other
  misc_feature (543)..(543): n is a, c, t, g, unknown, or other
aaagctggagctccccgcggtggcggccgctctagaactagtggatcccccgggctgcaggaattcgcacgagaccattacctagaacatcctaatcgaaaaaaccgcgccgctctctctctctctctcgcacgagccgcgccggcgccgccaccacgcgcgcgggagacagagaccacagccgcagccaccggcgggcggaatagaatgggtggcgccggggggaggagcaggaggaggtccgtcgcggtggccggcggcggaggagcttgacactgtacggaagaaggtggtggagattagtggaagggatgaacaagaggttatggttgctgcttgcccctacagaatttgccctttgggggctcatattgatcatcagggtggagtagtcacagctatgaccataaattatggagtacntccttggtttcgttccctctaatggttctgaggttttacttcattctggtcagtttgaaggtgctataagattcagagttgatgacttgcaaaagcctattgataaacctgagaactannaactggggaagttatgcaaaaagggtgctgttagtgcactgcagaatagtgggatatgatctaaggaagggatcataggatatatttctgggtgtgaaggtcttggatagtcccagggctca

SEQ ID NO: 33665 - protein, 62 aa, Zea mays
  misc_feature: Ceres CLONE 1411736-F
  misc_feature (4)..(4): Xaa is any aa, unknown, or other
  misc_feature (43)..(43): Xaa is any aa, unknown, or other
  misc_feature (44)..(44): Xaa is any aa, unknown, or other
MEYXLGFVPSNGSEVLLHSGQFEGAIRFRVDDLQKPIDKPENXXLGKLCKKGAVSALQNSGI

SEQ ID NO: 33666 - DNA, 667 bp, Zea mays
  misc_feature: Ceres CLONE 1411737-F
  misc_feature: Encodes the peptide sequence at SEQ ID NO. 33667
  misc_feature (553)..(553): n is a, c, t, g, unknown, or other
  misc_feature (609)..(609): n is a, c, t, g, unknown, or other
aaagctggagctccccgcggtggcggccgctctatcaatagtggatcccccgggctgcaggaattcgcacgagaccattacctagaacatcctaatcgaaaaaatcacgaatcaccaacaccctctcctccaccttccatcccgatcaccgccgccaccgctttcgttccacgtcccgatggcaccggtagatctaacccccaggcagccccggaaggcgtatggcggcgacgccggcgcctactacgagtggagcccagccgacctgcccatgctcggcgtcgcctccatcggcgcagccaagctctccctcgccgccggtgggctctcgctccccagctactccgactcttccaaggtcgcgtacgttcttgaaggcactggcacctgcggcatcgtcctgccggaggcgaccaaggagaaggtgctggccgtgaaggagggcgacgccctcgcgctcccctttcggcggggtcacgtggtggcacaacggccccgccgcgccgacccagctcacggtcctcttcctcgggacacctcaaggccacagggncgggggcagttcaccaactttcagctgacgggcgcgagcggcatcttcacggcttnctccaaccgagttcgtgtcggcgcgcgtgggacctgccggaggcgaagccgcgggggc

SEQ ID NO: 33667 - protein, 163 aa, Zea mays
  misc_feature: Ceres CLONE 1411737-F
  misc_feature (6)..(124): Pfam Name: Cupin_1 Pfam Description: Cupin
  misc_feature (144)..(144): Xaa is any aa, unknown, or other
MAPVDLTPRQPRKAYGGDAGAYYEWSPADLPMLGVASIGAAKLSLAAGGLSLPSYSDSSKVAYVLEGTGTCGIVLPEATKEKVLAVKEGDALALPFRRGHVVAQRPRRADPAHGPLPRDTSRPQGRGQFTNFQLTGASGIFTAXSNRVRVGARGTCRRRSRGG

SEQ ID NO: 33668 - DNA, 692 bp, Zea mays
  misc_feature: Ceres CLONE 1411743-F
  misc_feature: Translation starting site: 436
  misc_feature (550)..(550): n is a, c, t, g, unknown, or other
aaaagctggagctccccgcggtggcggccgctctagaactagtggatcccccgggctgcaggaattcgcacgagaccatttacctagaacattcctaatcgaaaaactacacatctgtcaccgtgaaatctcggctacctccttctgacttctggtacctcgccgccggggacccaactccgatccccaccccaccataccaaagccaccgcggctgcggctgcggctttccgcatcatcaatggtgctgatcactctcgtccgcgactacatcgaccgcatgctccacgacatcccttggcatgaaggtcctcgtcctcgacccccaaaccgttgggatggtgagcgtggtgtacagccagtcggatcttgcttgcggaaggaggtcttccttcgtcgagaccattggacaacgcctccagctccagggagtccatggcgcacctcaaggccgtctacttcctccgaccctccgcttacaacgtccagaagctccgcaggcacctcgccattgccgcgcttcgccgagtaccacctattcttctccggntatatttgaaggtcccgcagattcaaatacttgctgactcgattgaaccaggaggttgtgcagcaaaggtcaggagttctatgccttgattttttgtgccattgacccataccattttcactctcaacatacaaaataaccc

SEQ ID NO: 33669 - DNA, 642 bp, Zea mays
  misc_feature: Ceres CLONE 1411745-F
  misc_feature (472)..(472): n is a, c, t, g, unknown, or other
tccccgcggtggcggccgctctagaactagtggatcccccgggctgcaggaattcgcacgagaccattacctagaacatcctaatcgaaaagattttcttcacccgtccacctcgtcttgcgctcctctgtctcggcgacgactgtgctaccgccgccgccgccgcaagacttcgtcgggcactttgccggcgacgatttcccaccagcccaacaggatcagaggaggtgatggcgaggagtgacagctgcctggcgcgcgtgggtgccggaattgctatcggtggcgcggtcggcggagccgtcggtaaccttcgtccctaaacccctaaacactaggcttgcagcatcaatccgtccgtgcgagccgcttcacccgtcggtgtttttttttttggttggaagtagattagtgtgcgatttcaggaatcttctcgagctagctagtagctacatcccctgctttgtgtggntagctagcggcaaaaggaaaaaaccaggggggcttttggtaaaaattccccaaggggtttgggggagcctctctgggggggaaaaaacaaggcccgagtggatttttttcccccaatttttgggcctaaaggggtggggaatcccccccggggggggggaaaatccccgg

SEQ ID NO: 33670 - DNA, 684 bp, Zea mays
  misc_feature: Ceres CLONE 1411747-F
  misc_feature: Encodes the peptide sequence at SEQ ID NO. 33671
aaagctggagctccccgcggtggcggccgctctagaactagtggatcccccgggctgcaggaattcgcacgagaccattacctagaacatcctaatcaaaacatccagagagagacacggaggacctgggtttggttgcgctgcttgactcgctccgtgttccaagcgccttttgagcattcaggcagatataaaattcctctttttacactacaatccccgctgaatcagcagcagcaactctctccctctccgttcttggtggtccgagacccttggccgtacgctctgcctcactcctccgtctcttgcttcccttgccgccggcggcgcgcggcgccgggcgcgaatcggcggcgggtgcatggtggaggccgccgacgggagccagacaggtaccagacggacgctgactgaggtgagtgggaagcacccgcgggacatgccgcatcgtcgcctgagacatcacgccgtatgtgctcctgcggcgccccgagggaggagtcttctccgacgacggggctgacaccgggcccgtggaagtccacttcatgggctacaagtggtaccgcatacaaagtgatcgaagagctgctatctgcagtgtgacacccgacagaacaagcaacacttcagtgcataggatgtctgacgtcaaaaatacctgtcgctaacagctaccat

SEQ ID NO: 33671 - protein, 40 aa, Zea mays
  misc_feature: Ceres CLONE 1411747-F
MGYKWYRIQSDRRAAICSVTPDRTSNTSVHRMSDVKNTCR

SEQ ID NO: 33672 - DNA, 727 bp, Zea mays
  misc_feature: Ceres CLONE 1411751-F
gctctagaactagtggatcccccgggctgcaggaattcgcacgagaccattacctagaacatcctaatcgaaaaattcctcacaaccacacaaaccgcacctcatccctgttgacccgacggtggcgctcatctcctccccgacggtggcgctcatcttccccccgacggttctccccatcgacctgctggcttcccttcgtcttccccgacactgatcctcaccactcatgtctgctgaagttgccggaggaaacccttatttcctctcatgctacttctggttcatatactgcataaaattccgagatttcacttgatacaagaggaacactacgagttttgtgcaaatacttcctaccatgtgaatcagttgtacactggcgaatttgggaagactcaagtcctctcatctgggttcacaaaacatctgtcagctgattgcttggtctcctgtttcctttgagtcttgccaaccaaacgtgtctctcagcatcagctgtggcctacgaactctttctgtgacttgaccaacatctcttttggtcctgtcaatcttgcaacactcccttccaaagacttgtctagaggctggattgccatgctctctgctggcgctgcatcctcctttagtcttacaagttatctcttgacagcagttgtgatctacgaactcgttctgtgacttcgacaacatctcttttggtactgtcatcgttgcacactcc

SEQ ID NO: 33673 - DNA, 598 bp, Zea mays
  misc_feature: Ceres CLONE 1411752-F
  misc_feature: Encodes the peptide sequence at SEQ ID NO. 33674
  misc_feature (41)..(41): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (375)..(375): n is a, c, t, g, unknown, or other
  misc_feature (377)..(377): n is a, c, t, g, unknown, or other
  misc_feature (378)..(378): n is a, c, t, g, unknown, or other
aaagctggagctccccgcggtggcggccggctctagaactnagtggnnnatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaagctaaacgcgccactcccgcggaagctgctctgctgctcccacagncnnacgcacgagtgccatggcgactgcagcgagttcgacgccggcgggcggaagcctattctggtctggcggtactgaccggccggttgccccggaaaatggcaccggaagttgccccccctggggggttcggggccaaagggggggagattccgggcggtttgcccaaaggtttgagcttggaggaacttgcccgggtttttccccaacccgttggtttccg

SEQ ID NO: 33674 - protein, 41 aa, Zea mays
  misc_feature: Ceres CLONE 1411752-F
MAPEVAPPGGFGAKGGEIPGGLPKGLSLEELARVFPQPVGF

SEQ ID NO: 33675 - DNA, 603 bp, Zea mays
  misc_feature: Ceres CLONE 1411754-F
  misc_feature (353)..(353): n is a, c, t, g, unknown, or other
  misc_feature (354)..(354): n is a, c, t, g, unknown, or other
caaagctggagctccccgcggtggcggccgctctagaactagtggatcccccgggctgcaggaattcgcacgagaccattacctagaacatcctaatcgaaaactagagttttagtgccagcctgccaggccagccaccaacctcctcctcttccgcatcgcatcgagagcggggctgtaccgtgcgagactctactgctcgatcgccatggccgccgcgctcaggtgcccggcatccgccagggtctcgggcctccgccgccgcggggctcgccaaggtgcgccaggcgtccagagtcgtaagcggtgagcggggcccggcagaagccgcggcggccggcgtcgccgtgcgnngcgtcgctgttctcgcccaagcccgcggcggcccagggacgcgcggcccgacccaaggttgcaggaaccttgtacggtggaccaaagatccacgagagggggaaccggggaaaaaagcccccgggggaaatgtgggggcctcctaaggggccaaaaaaaaaagggggaaaaaacccggtgttggggggggagaatccttttcccccctctttttaaaacaaaaaaaaggggggggtgggtttcaccgga

SEQ ID NO: 33676 - DNA, 656 bp, Zea mays
  misc_feature: Ceres CLONE 1411756-F
  misc_feature: Encodes the peptide sequence at SEQ ID NO. 33677
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (486)..(486): n is a, c, t, g, unknown, or other
  misc_feature (649)..(649): n is a, c, t, g, unknown, or other
  misc_feature (656)..(656): n is a, c, t, g, unknown, or other
aaagctggagctccccgcggtggcggccgctctagaactagtggatcccccgggctgcaggaattcgcacgagaccattacctagaacatcctaatcgaaaattctcgtacgtgtgtgttctgttctgttcaccagaaagcaaactacttctttaagtgattccaacagcggaggccggaggccatgggcgcccggcaggcggcggcgttcctgctcggctgcgtcgccgcgctcaccgtcgtcgtgctgctgctgcagcgccgccccgaggagctcaccaccagggcaccactgtgcaaaatcttccgggaagggaaaggnnnaggggcagggccgtcgtcgtcgccgtctcagtccagctcctcctactcaccaccaccagtagataccaatgccactgccgcagccggcgatccacgccttccgccgccgcccaaccatggcgaggacgaagacgaagaagaagaggagttccgcgggctcgngggcggcggtgtcgcgcgcggcgacggcggacgaccggacggtgatcatcacgtgcgtcaaccaggcgtgagcggcgcccggctcgctgctggacctgttcctggagagcttccgcgtgggcgacggcacggcgcccctgctgcgccacctgctcatcgtggncatggan

SEQ ID NO: 33677 - protein, 38 aa, Zea mays
  misc_feature: Ceres CLONE 1411756-F
  misc_feature (16)..(16): Xaa is any aa, unknown, or other
MARTKTKKKRSSAGSXAAVSRAATADDRTVIITCVNQA

SEQ ID NO: 33678 - DNA, 690 bp, Zea mays
  misc_feature: Ceres CLONE 1411758-F
  misc_feature: Encodes the peptide sequence at SEQ ID NO. 33679
  misc_feature (360)..(360): n is a, c, t, g, unknown, or other
  misc_feature (380)..(380): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (554)..(554): n is a, c, t, g, unknown, or other
  misc_feature (583)..(583): n is a, c, t, g, unknown, or other
  misc_feature (632)..(632): n is a, c, t, g, unknown, or other
  misc_feature (633)..(633): n is a, c, t, g, unknown, or other
  misc_feature (642)..(642): n is a, c, t, g, unknown, or other
  misc_feature (643)..(643): n is a, c, t, g, unknown, or other
  misc_feature (672)..(672): n is a, c, t, g, unknown, or other
  misc_feature (673)..(673): n is a, c, t, g, unknown, or other
tccccgcggtggcggccgctctagaactagtggatcccccgggctgcaggaattcgcacgagaccattacctagaacatcctaatcgaaaaacatccgtcttcctcctgtaaccagatctgaacccgcggcgacagaaacaaacgctcgctcgctcgttcgttgtccgttcattgtcttcgccggcgccgagggaccctgagagggcaggcgggcgagatggcgggcggcggcgttgaggacgtgtacggcgaggaccgcgctaccgaggagcagctgatcacgccgtgggccttctccgtcgcaagcggctacaccctgctgcgcgacccgcggcacaacaagggcctgggccttctcnggaggcggagcgcgacgcgncactacctccggggcctgctgccgccggcgctgggcgtcgcaggagctggcaggagaagaagctcatgcagaacctgcgccggtacgagcagccgctgcaccgctactccgccatgatgggacctgcaggagcgcaacgagaggctcttctacaagctcctctcacnnnacgtncgaggagctggctccccgtcgctacacgncccaccggtcgggcgaggaaatgcccagaaagtacggcagcatctacgnncgccccccnncagggggctgtacatcagcctcagggacnnagggaaaaataaccctc

SEQ ID NO: 33679 - protein, 92 aa, Zea mays
  misc_feature: Ceres CLONE 1411758-F
  misc_feature: SWISSPROT Homolog: EC 1.1.1.40 Malate dehydrogenase (oxaloacetate-decarboxylating) (NADP(+))
  misc_feature (48)..(48): Xaa is any aa, unknown, or other
MAGGGVEDVYGEDRATEEQLITPWAFSVASGYTLLRDPRHNKGLGLLXRRSATRHYLRGLLPPALGVAGAGRRRSSCRTCAGTSSRCTATPP

SEQ ID NO: 33680 - DNA, 661 bp, Zea mays
  misc_feature: Ceres CLONE 1411759-F
  misc_feature: Encodes the peptide sequence at SEQ ID NO. 33681
  misc_feature (28)..(28): n is a, c, t, g, unknown, or other
  misc_feature (585)..(585): n is a, c, t, g, unknown, or other
caaagctggagctccccgcggtggcggncgctctttcactagtggatcccccgggctgcaggaattcgcacgagaccattacctagaacatcctaatcaaaaatgccacattgccaccaagccacagttccacctttcgattcatgcacgctcagtcatgggcgccctccggagtttagccatctcctacccggagttcctcgtggccgggctgtgcttcgtctccctctcggccctgcgccacgcgatgcgtgagcggcggcaacgcgcccccctgagctggcctgtggtgggcatgctcccgttcgtgctcgcgaacctcgggcgcctctacgacgccatcaccgacgccctccacgggtccgggtgcacgctcatgttccgcgggccgtggctcgcccgcgcggacttcctgctgacgtgcgacccggcggccgtccagcactgcctggcgtccaaccacgggggctacgacaggggccgagactttgcggagatgttcgacctcctgggcgacgggctgctggttgcggatgcccgcggtcgtgggcgcgccagcggcacgtcgccgccaccgtcttcggnaccccgggcgttccggtccttcgtcctgtgcaccatggcgcgcaaaaagggcgcgggttggtcgttgcggtttcct

SEQ ID NO: 33681 - protein, 168 aa, Zea mays
  misc_feature: Ceres CLONE 1411759-F
  misc_feature (143)..(143): Xaa is any aa, unknown, or other
MGALRSLAISYPEFLVAGLCFVSLSALRHAMRERRQRAPLSWPVVGMLPFVLANLGRLYDAITDALHGSGCTLMFRGPWLARADFLLTCDPAAVQHCLASNHGGYDRGRDFAEMFDLLGDGLLVADARGRGRASGTSPPPSSXPRAFRSFVLCTMARKKGAGWSLRFP

SEQ ID NO: 33682 - DNA, 679 bp, Zea mays
  misc_feature: Ceres CLONE 1411761-F
  misc_feature: Translation starting site: 170
  misc_feature (620)..(620): n is a, c, t, g, unknown, or other
tccccgcggtggcggccgctctagaactagtggatcccccgggctgcaggaattcgcacgagaccattacctagaacatcctaatcaaaaaattaatttccagggatgcacgcaggcaagtttaatttggaggatcaatggtagctagctagagctactagagacatacatggcggatcctctggtgcgagcgcgacccaaaaggaagaaggtcttagcggactacttggtgcgactccgatggattcctgccctcttcgtggcccttccaatatctgcgctgatctacctgagcgtcttcctggggaacacgtggtccgccatgaaatccgagaagcgtcgacagaaggaacaccaggagaacgtagagaggctgagagggtcgtgaagcgtctcaaggagagggatccgaagagggacggcctcgtctgcaccgcgaggaagccatggggtggtcgtgggcatgcgcaacgtggactacaagcgcgccagacgcttcgaggtcgacctctccgcgttgaggaacatcctcgagatcgacgcgggagaggatggtcgcccagggtggagtctctcgtcagcatggcccagataaccaaggctacctgccccatgaactnctcgctcgccgtggcctcctgagttgacgacttttacccggccggtgttctgtaacggg

SEQ ID NO: 33683 - DNA, 722 bp, Zea mays
  misc_feature: Ceres CLONE 1411762-F
  misc_feature: Encodes the peptide sequence at SEQ ID NO. 33684
  misc_feature (692)..(692): n is a, c, t, g, unknown, or other
  misc_feature (693)..(693): n is a, c, t, g, unknown, or other
gctctagaactagtggatcccccgggctgcaggaattcgcacgagaccattacctagaacatcctaatcaaaacactcgggttggttagaagaacccaatgcaagtgtgagtgagctgacggcacggcggacgcgctcgcctctcctctcctctcctctcctcttcttccggctctccctctccgcatgccattccaacgcattaccggtatttttagccgccggaggagacgggtagctgcgtagccactagcgagagagagagggaggggagaaaccatagctcctggccgttctgcctgcccatccaccgcggcgccggccgtccgtctcccgtccacatccctcctcctctcctgcaaggttcctgtgcgtagcgcagaggggtcggagtcggagtcggagtcggagaagatgatgggcgggttcctctccagggtcctcctgttggcttttggctatgcctatcctgcctacgaatgctacaagactgttgaactgaacaaaccagagattgcgcagctcatattttggtgtcagtattggattttagttgccctgttgacagttttggagagattcggagatttcacaatatcatggctaccgttctactcggaagcaaagctgatgttctttgtatacttgtggtaccctaagacaaagggaactacgtatgtttatggaacttnntcttaaccatatatttctcagcatgagaa

SEQ ID NO: 33684 - protein, 94 aa, Zea mays
  misc_feature: Ceres CLONE 1411762-F
  misc_feature (2)..(94): Pfam Name: TB2_DP1_HVA22 Pfam Description: TB2/DP1, HVA22 family
  misc_feature (93)..(93): Xaa is any aa, unknown, or other
MMGGFLSRVLLLAFGYAYPAYECYKTVELNKPEIAQLIFWCQYWILVALLTVLERFGDFTISWLPFYSEAKLMFFVYLWYPKTKGTTYVYGTXS

SEQ ID NO: 33685 - DNA, 646 bp, Zea mays
  misc_feature: Ceres CLONE 1411762-R
caattgggtaccgggccccccctcgaggtcgacggtatcgataagcttttttttttttttttttattttgtatcagctagcgtcagccagccaaacatcacatatatactattatataatatgttcatttatttattcatgcatgcacgcgcacaatataatgaaccaacaggtagtagagcagcagcagcagcagaagctaggtagtactcctatatatgtaggtgtcatgtctttttggcaaagctgctgatgctgggaaccacggtggatggatcacgggcacttgtgctggccgtcgtgggtcttcatgttggcgtagcaggggcagacgtcctcgttgccggaggtgcccggcgggacgcagccgcagcgctggcagcaggtgccgcacgccctcaggcacatcttgggccgccccgacttgctgcaccggtacgagcagctcgcgccgcagtcgatggcttcagcctgtccatggggagaagtagtggtctccacgaggagcagcaggacgacgagcgagagcgagaagagcagcctgctgctcgccttggccatggtggaaggttggcttcttgcctgcttaattccttgcacgagagaggccagagatcgacacgggccggtggtatggttggttact

SEQ ID NO: 33686 - DNA, 698 bp, Zea mays
  misc_feature: Ceres CLONE 1411763-F
  misc_feature: Encodes the peptide sequence at SEQ ID NO. 33687
  misc_feature (583)..(583): n is a, c, t, g, unknown, or other
  misc_feature (606)..(606): n is a, c, t, g, unknown, or other
  misc_feature (607)..(607): n is a, c, t, g, unknown, or other
  misc_feature (619)..(619): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (644)..(644): n is a, c, t, g, unknown, or other
  misc_feature (667)..(667): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (680)..(680): n is a, c, t, g, unknown, or other
aaagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatccctcagctcgtcggcctccaccagcagccgcgacagcgcggncccttgtagctgtccagcgcggnncccacactcggncgtccgcgnnnttcctaagccgggnctgccctggagccggccgcgcgncgnnnaccgtcgnaagctttcggctgggcag

SEQ ID NO: 33687 - protein, 131 aa, Zea mays
  misc_feature: Ceres CLONE 1411763-F
  misc_feature (94)..(94): Xaa is any aa, unknown, or other
  misc_feature (102)..(102): Xaa is any aa, unknown, or other
  misc_feature (106)..(106): Xaa is any aa, unknown, or other
  misc_feature (109)..(109): Xaa is any aa, unknown, or other
  misc_feature (114)..(114): Xaa is any aa, unknown, or other
  misc_feature (122)..(122): Xaa is any aa, unknown, or other
  misc_feature (123)..(123): Xaa is any aa, unknown, or other
  misc_feature (126)..(126): Xaa is any aa, unknown, or other
MLLTSCRQGRGMASLSCARADGVVRSGALPAKLLLCASCCFPTAAPVADGEVQVLACRQHLHRLPRRQDLRRQRPRRRHPSARRPPPAAATARXLVAVQRGXHTRXSAXFLSRXCPGAGRAXXTVXSFRLG

SEQ ID NO: 33688 - DNA, 722 bp, Zea mays
  misc_feature: Ceres CLONE 1411764-F
  misc_feature: Encodes the peptide sequence at SEQ ID NO. 33689
tggagctccccgcggtggcggccgctctataactagtggatcccccgggctgcaggaattcgcacgagaccattacctagaacatcctaatcgaaaagaccttgggtaccatcgcaaaccccgcttttgtttatcattccttctctccagtcttgacttcccctctccctccctctctctctctcttcccggcggggcggccggaaatctccccctaaattcagctggtttcacgggagagctatcggccggtggagaggaaaggacgagtcttgagctggacttcttggcggattggctgctggcattcgcaggaactgtgtgtccgtgctcaggagcggggagatgagctgcttaccgtgctccggttcctcggggaaggaggacaagagcttggcggcgctctcgccgagcccccggtctgcgggcaaggcggcaccagtacgatcaaattcacgtgcttcgagctccaggaaggaagattctgtacctgttcgcagagcaggaaacactgcacatggcccggcacagattttcagtttccgggagttggctgttgccaccaaaaatttcagaagagattgcctgttgggagaaggtggctttggtcgtgtgtataaaggacatatggaaaatgggcaggtcattgctgtgaagcaacttgatagaaatggttttccaggaaatcgtgaattccttgtggaggctctcatgctaagtct

SEQ ID NO: 33689 - protein, 125 aa, Zea mays
  misc_feature: Ceres CLONE 1411764-F
  misc_feature: SWISSPROT Homolog: EC 2.7.11.1 Non-specific serine/threonine protein kinase
MSCLPCSGSSGKEDKSLAALSPSPRSAGKAAPVRSNSRASSSRKEDSVPVRRAGNTAHGPAQIFSFRELAVATKNFRRDCLLGEGGFGRVYKGHMENGQVIAVKQLDRNGFPGNREFLVEALMLS

SEQ ID NO: 33690 - DNA, 736 bp, Zea mays
  misc_feature: Ceres CLONE 1411767-F
  misc_feature: Encodes the peptide sequence at SEQ ID NO. 33691
  misc_feature (736)..(736): n is a, c, t, g, unknown, or other
gcggtggcggccgctcttcaatagtggatcccccgggctgcaggatttcgcacgagaccattacctagaacatcctaatcgaaaaatgaccgactagcccatggtctctctccgctccgacgcgcccgacccaccaccacatccctcatggctgccctcgccgacatcgactcctcggcacttccgccgtccgagtcatccaaaggcaaggacaatatgcacaaggaggactgaggacgaggcgaagggcgcgcagaagatgagcggcatctgctatctcgacggccggcgggccatccgcggcgagctcgactgctgcgcccatttcttttgctttgtctgcatcatggcttggagccgcgtcgagtaccgctgtcccttctgcagggcccgcttccacaccatccgtcgcccgcccgtcgccggccggatccccgacgagcgaatcgtctcgatccaagagtgcaaccaggtacaccatcctcagggcgacgggagcagcatagtgggcggagatccttacgcgaacaccatatgcaccgtttgcagcacctacagcgatgactagctgctgctactctgcgagctctgcgactcaactgcacacacttactgtggcggaatgcccaccaccgcgacagacggggactgtttctggcaacactggggaacgatcagagatgatcaattgagaagccaggctgagaatcaaggcgaatttgacatcagaatgaan

SEQ ID NO: 33691 - protein, 102 aa, Zea mays
  misc_feature: Ceres CLONE 1411767-F
MSGICYLDGRRAIRGELDCCAHFFCFVCIMAWSRVEYRCPFCRARFHTIRRPPVAGRIPDERIVSIQECNQVHHPQGDGSSIVGGDPYANTICTVCSTYSDD

SEQ ID NO: 33692 - DNA, 681 bp, Zea mays
  misc_feature: Ceres CLONE 1411773-F
  misc_feature: Encodes the peptide sequence at SEQ ID NO. 33693
  misc_feature (489)..(489): n is a, c, t, g, unknown, or other
aagctggagctccccgcggtggcggccgctctataactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccggnaggggcgagtgccggcgccagtgcctgcgccgccacgagggccagccgtgggagacccaggagtgcatgaggcggtgccgccgccgcggactggtcgtcgacatggagcaagagtacggtcgcggcagcgagggcgcggataagtgctcgccagaggtgctagcgccaccaccgcgacgtactgttgagaca

SEQ ID NO: 33693 - protein, 156 aa, Zea mays
  misc_feature: Ceres CLONE 1411773-F
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRRHEGQPWETQECMRRCRRRGLVVDMEQEYGRGSEGADKCSPEVLAPPPRRTVET

SEQ ID NO: 33694 - DNA, 659 bp, Zea mays
  misc_feature: Ceres CLONE 1411774-F
  misc_feature: Encodes the peptide sequence at SEQ ID NO. 33695
  misc_feature (343)..(343): n is a, c, t, g, unknown, or other
  misc_feature (465)..(465): n is a, c, t, g, unknown, or other
  misc_feature (467)..(467): n is a, c, t, g, unknown, or other
  misc_feature (468)..(468): n is a, c, t, g, unknown, or other
  misc_feature (553)..(553): n is a, c, t, g, unknown, or other
  misc_feature (563)..(563): n is a, c, t, g, unknown, or other
  misc_feature (566)..(566): n is a, c, t, g, unknown, or other
  misc_feature (634)..(634): n is a, c, t, g, unknown, or other
  misc_feature (640)..(640): n is a, c, t, g, unknown, or other
  misc_feature (646)..(646): n is a, c, t, g, unknown, or other
caaagctggagctccccgcggtggcggccgctctagaactagtggatcccccgggctgcaggaattcgcacgagaccattacctagaacatccgaatcgaaaaatcgcagaaattctccgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaaggccaaggcggagaagcggctacctgcgggcaagtccgccggcaaggaggggnccggacaagaaggggaggaagaaggcgaagaagagcgtggagacctacaagatctacatcttcaaggtctccgttctcccccaattcgccttcacctcgccgcttcctccttgaccgccacngnntgacgtcgtctttccggcgaggtagctcgccggaagacctcacctggacttttccgacgcacccctcacacactcttttaacccntccgaatggncgnctgcttctagctcgtcgacgcccaaatctccgcttgcttcctcgacagccccatcccgctcttctcgntctcgntacggntcctctggctgtt

SEQ ID NO: 33695 - protein, 92 aa, Zea mays
  misc_feature: Ceres CLONE 1411774-F
  misc_feature (52)..(52): Xaa is any aa, unknown, or other
MAPKAEKKPAAKKVAEEEPSEKAAPAEKAPAGKKAKAEKRLPAGKSAGKEGXGQEGEEEGEEERGDLQDLHLQGLRSPPIRLHLAASSLTAT

SEQ ID NO: 33696 - DNA, 724 bp, Zea mays
  misc_feature: Ceres CLONE 1411777-F
  misc_feature: Encodes the peptide sequence at SEQ ID NO. 33697
cgcggtggcggccgctctataactagtggatcccccgggctgcaggaattcgcacgagaccattacctagaacatcctaatcgaaaagaccttgggtaccatcgcaaaccccgcttttgtttatcattccttctctccagtcttgacttcccctctccctccctctctctctctcttcccggcggggcggccggaaatctccccctaaattcagctggtttcacgggagagctatcggccggtggagaggaaaggacgagtcttgagctggacttcttggcggattggctgctggcattcgcaggaactgtgtgtccgtgctcaggagcggggagatgagctgcttaccgtgctccggttcctcggcgaaggaggacaagagcttggcggcgctctcgccgagcccccggtctgcgggcaaggcggcaccagtacgatcaaattcacgtgcttcgagctccaggaaggaagattctgtacctgttcgcagagcatgaaacactgcacatggcccggcacagattttcagtttccgggagttggctgttgccaccaaaaatttcagaagagattgcctgttgcgagaaggtggctatggtcgtgtgtataaaggacatatggaaaatgggcaggtcattgctgtgcagcaacttgatagaaatggttttcgaggaaatcgtgaattccttgtggaggctctcatgctaagtctcttgcaccatca

SEQ ID NO: 33697 - protein, 53 aa, Zea mays
  misc_feature: Ceres CLONE 1411777-F
MSCLPCSGSSAKEDKSLAALSPSPRSAGKAAPVRSNSRASSSRKEDSVPVRRA

SEQ ID NO: 33698 - DNA, 740 bp, Zea mays
  misc_feature: Ceres CLONE 1411778-F
  misc_feature: Encodes the peptide sequence at SEQ ID NO. 33699
  misc_feature (576)..(576): n is a, c, t, g, unknown, or other
tccccgcggtggcggccgctctacaactagtggatcccccgggctgcaggaattcgcacgagaccattacctagaacatcctaatcaaaaaaaagcttgcgcgtttacaatgtcgtggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggaacggccggctgcccgctggccgccacgctgtcggagcgcttccgcgtgctgctgctggagcgcggcgcctcgccctacgacgacgaccgcatcggggacatggaccgcttcgcggacacgctgtcggacacctccccgggctcgcccgcgcagcgcttcgtgtcggaggacggcgtcatcaactcgcgcccgcgggtgctggacggagccagctgcatcaacgccggcttctacacgcgggccagcgacgactacgtgcgaggcgtcatgtgggacctgggcgacgtcaatccgncgtaccggtgcctggaggacgtgatggagttccagcctgagctggagccctggcaagtcgcgctgcacgacggactgctctagacgacgtcgcgccggatacggattcacagtcgacacttctacgggacaaagtcagcgagttcatcgtcgacgacgacgccg

SEQ ID NO: 33699 - protein, 173 aa, Zea mays
  misc_feature: Ceres CLONE 1411778-F
  misc_feature: SWISSPROT Homolog: EC 4.1.2.10 Mandelonitrile lyase
  misc_feature (147)..(147): Xaa is any aa, unknown, or other
MSTLLATSFFFVLLCSSLQVRGVNYTFVKDAALAPSVSYYDYIIVGGGTAGCPLAATLSERFRVLLLERGASPYDDDRIGDMDRFADTLSDTSPGSPAQRFVSEDGVINSRPRVLDGASCINAGFYTRASDDYVRGVMWDLGDVNPXYRCLEDVMEFQPELEPWQVALHDGLL

SEQ ID NO: 33700 - DNA, 674 bp, Zea mays
  misc_feature: Ceres CLONE 1411779-F
  misc_feature: Encodes the peptide sequence at SEQ ID NO. 33701
aaagctggagctccccgcggtggcggccgctctagaactagtggatcccccgggctgcaggaattcgcacgagaccattacctagaacatcctaatcgaaaaaactcgaaccgaagggacgaccgagcggagtctagactcgagagcaacctcgacctcccggatctctctcccacccacgcctcgtcggcgccgtcgtctgctgcagcgatggcctcccccgacctgctcttcaatctgcggaacctcttctacctgggcgcctaccaggcagccatcaacaacagcgacgtcccgggcctcgacgccgacgccgccgctgagcgcgacgccatcgtcttccgctcctacatcgccctcggctcctaccagctggtgatcagcgagatcgactcgtcagccgctacctcgctgcaggccgtgaagctgctcgcgctgtacctcactggagacaaggaaggtgctatctccagtctcaaggaatggttgagtgattcagcaattggaagcaatcctgttctgcggttgattgctgaatctctctccccaaactacccctcgccagcgcccggcgatgtgcccaacgaagcccgatcgccctggccaggccgccgccggctccggcgagaagagctggcgggaggaggccgtggccacctgctcgctgcggctgg

SEQ ID NO: 33701 - protein, 154 aa, Zea mays
  misc_feature: Ceres CLONE 1411779-F
  misc_feature (3)..(153): Pfam Name: Coatomer_E Pfam Description: Coatomer epsilon subunit
MASPDLLFNLRNLFYLGAYQAAINNSDVPGLDADAAAERDAIVFRSYIALGSYQLVISEIDSSAATSLQAVKLLALYLTGDKEGAISSLKEWLSDSAIGSNPVLRLIAESLSPNYPSPAPGDVPNEARSPWPGRRRLRREELAGGGRGHLLAAA

SEQ ID NO: 33702 - DNA, 658 bp, Zea mays
  misc_feature: Ceres CLONE 1411781-F
  misc_feature: Encodes the peptide sequence at SEQ ID NO. 33703
  misc_feature (543)..(543): n is a, c, t, g, unknown, or other
  misc_feature (544)..(544): n is a, c, t, g, unknown, or other
  misc_feature (546)..(546): n is a, c, t, g, unknown, or other
  misc_feature (552)..(552): n is a, c, t, g, unknown, or other
  misc_feature (658)..(658): n is a, c, t, g, unknown, or other
cgcggtggcggccgctctagaactagtggatcccccgggctgcaggaattcgcacgagaccattacctagaacatcctaatcaaaaaacggtttgcgtataaataagtagtcagtcgctcatcttgttccttgtgaacatcgcagtgctgtagcctccttcgtcttgagcgagcatggagatgtcagccatggaggaagccctccccaaggcgatggagaggaggaagggaggcctcagaaccattccgttcatcatcttaaacgagatattcgagaaggtggccacgttcgggctgtcggccaacatgatcctgtacctcaccgagcggtatctcatgaccaacgcctttgccaccgtcgtcctctacttctggcatgccttctccaacttcctgcccatcttaggcgccgtgctcgccgaccccgcctcggccggttccgggtcatcaccctcggctcctgcgttagcctcttcgggatgtgctgctgtggctgacgggatccttccggtgtacaaacaccccggagtggcgccgggcggnncnaaaggntgcgcggtgctgccgtggcagctgccgctcctcttcacgtcgtttcgcgtcattgtcccctcggggtcgggcggcatccggcccggaacgctgggcggttcggggn

SEQ ID NO: 33703 - protein, 161 aa, Zea mays
  misc_feature: Ceres CLONE 1411781-F
  misc_feature (124)..(124): Xaa is any aa, unknown, or other
MEMSAMEEALPKAMERRKGGLRTIPFIILNEIFEKVATFGLSANMILYLTERYLMTNAFATVVLYFWHAFSNFLPILGAVLADPASAGSGSSPSAPALASSGCAAVADGILPVYKHPGVAPGGXKGCAVLPWQLPLLFTSFRVIVPSGSGGIRPGTLGGSG

SEQ ID NO: 33704 - DNA, 715 bp, Zea mays
  misc_feature: Ceres CLONE 1411783-F
  misc_feature (519)..(519): n is a, c, t, g, unknown, or other
tggcggccgctctagaactagtggatcccccgggctgcaggaattcgcacgagaccattacctaaaccatcctaatcgaaaatctccccacgcgtttgcttcttgcagaattgaccccttccgccccggccgtgatcttccccacctctctccgcactgcatgagcttgcgcgagaggtggcagccgagaccgacgactgagagatattgtacgcacgcgacatcctgtgctccgctctgtgactctggtctccgaagagcgccgccaccctatttttttttacaaacatcctaagatagctacttcagtccgacaccgctactagcttcacctcagggatctgtgaagctatgaagactcctctcgagaggaacccgactaagaatcgccactcgagctggaggaacagtcacattagcacatagaactcgaactggatcggctgaaatctctaagaaatgacaagctagtgtaggaacgctccagctgatcaagtaggacgactactacttcactanaaaagccaaactgataccagaggcagccgatgctctcacccagacgaagactctaccgtatgaatcgggtctagccaggggtatgaaatttaaacgaggactggccaagacctccctacaggagggaacacgcgatttcacccaattaaaggccgttttaaactgaaaaattcccccaacggtttctaaaaaaata

SEQ ID NO: 33705 - DNA, 660 bp, Zea mays
  misc_feature: Ceres CLONE 1411784-F
  misc_feature: Encodes the peptide sequence at SEQ ID NO. 33706
  misc_feature (626)..(626): n is a, c, t, g, unknown, or other
aaagctggagctccccgcggtggcggccgctctagaactagtggatcccccgggctgcaggaattcgcacgagaccattacctagaacatcctaatcgaaaaacagactacagagcgtagagcgagtgggtatcggacacttctctggcaattgcagattatctccgaatctgtatgaactgactgccgcggtctattccgtctgaagaccctcctcctacctaattatttttctctgtcgtgacgtgaaatcccagcgcgcagcttcttgatccgttccggctgatcccgtggaccggacttggggttgggggaggccctctgtctccatggatgaggcagcagggctgctgttgcaagaagagggtggaggtggggaccaagaagctctcctccttccacttccacaggatgttggcctttacacaggtgatggatctgttgatgtcaaagggcgccctgcgttaaagggcactacaggcaattggaaagcatgctttttcatcctagggaatgaatgttgtgaaaggctggcctactacggaattgcaaaaaacctagttacttatttgaaagtgaagcttcatctaggcaacctcgaggctgcaagacatgttaccacttgncaagggacatgctatctcactccccttgttggag

SEQ ID NO: 33706 - protein, 110 aa, Zea mays
  misc_feature: Ceres CLONE 1411784-F
  misc_feature (99)..(99): Xaa is any aa, unknown, or other
MDEAAGLLLQEEGGGGDQEALLLPLPQDVGLYTGDGSVDVKGRPALKGTTGNWKACFFILGNECCERLAYYGIAKNLVTYLKVKLHLGNLEAARHVTTXQGTCYLTPLVG

SEQ ID NO: 33707 - DNA, 653 bp, Zea mays
  misc_feature: Ceres CLONE 1411796-F
  misc_feature: Encodes the peptide sequence at SEQ ID NO. 33708
  misc_feature (200)..(200): n is a, c, t, g, unknown, or other
aaagctggagctccccgcggtggcggccgctctagaactagtggatcccccgggctgcaggaattcgcacgagaccattacctagaacatcctaatcgaaaaaacccccctttcccgccacaccatctcctcgccgcttcccgccacctctctcccatggcggcgccgtcggcggccacgcgcaggaaactgcagcgcangttccgcctacgaggcttcaccctcaaggtggacgccctcgaggaggccgccgccttcctcgaccgcttccccgacgccgaggacgacgcgctcgatctcctcctcgacgagctcgacaaggaaccgctgcagtcgtcgatactggaccgggacgcggtcaggcgcgtggtggcgctgcttgtcgaggccgaggaggcgctcgatgtggcgtcgccagcggccacaagcgcaaggtctgcgctgcgggtggtggacgcgttcctcgtgccgcggttccactacgatccaatcaagaaagtattttacgagcacacaggcagattagctgtccatggagaagctggagataaagcttccctttatagggataggtatcaagtgctgctgcagagactgtctcgtgataaatatttctctaagccggcttttgacacagttgcgaccgaacactg

SEQ ID NO: 33708 - protein, 165 aa, Zea mays
  misc_feature: Ceres CLONE 1411796-F
  misc_feature: SWISSPROT Homolog: EC 2.7.7.7 DNA-directed DNA polymerase
  misc_feature (15)..(15): Xaa is any aa, unknown, or other
MAAPSAATRRKLQRXFRLRGFTLKVDALEEAAAFLDRFPDAEDDALDLLLDELDKEPLQSSILDRDAVRRVVALLVEAEEALDVASPAATSARSALRVVDAFLVPRFHYDPIKKVFYEHTGRLAVHGEAGDKASLYRDRYQVLLQRLSRDKYFSKPAFDTVATEH

SEQ ID NO: 33709 - DNA, 656 bp, Zea mays
  misc_feature: Ceres CLONE 1411800-F
  misc_feature: Encodes the peptide sequence at SEQ ID NO. 33710
  misc_feature (656)..(656): n is a, c, t, g, unknown, or other
tacccgcggtggcggccgctctagaactagtggatcccccgggctgcaggaattcgcacgagaccattacctagaacatcctaatcgaaaaaaaaaaatatatccaacactcatttcccacggaccacacgaggcataccacacgcacgcacactcccccactccctctccaccctgcttccgtttccggccggcgatggcgacgaccgccgccgcatccacgtcgctccggacgctgtcaccgtccccacctcgcatcgcgagtttgccccgtcggtggtgttggagaatcccggtgcagtcctccgggcggagcgcattccatgctcaacggcggaggcggagcactttattatgcgctgctgataaagctcctgaagaatccctcaagaagaccattgaagtgcataggcttattgatatgctgagggacgcaaatcctagagagcttgatcaaatagtggctgaaaatgttctggcattcgacgcaggtttctgggctcgactggcaggtagaattgatctctgcaaatcagatgatgataaagcatgatttcacatatgtagaaaattttactttctatggatgctgctaacttctatctcaaataatctaactttgcagatggttgctctctgttgccttctcagaaagn

SEQ ID NO: 33710 - protein, 118 aa, Zea mays
  misc_feature: Ceres CLONE 1411800-F
MATTAAASTSLRTLSPSPPRIASLPRRWCWRIPVQSSGRSAFHAQRRRRSTLLCAADKAPEESLKKTIEVHRLIDMLRDANPRELDQIVAENVLAFDAGFWARLAGRIDLCKSDDDKA

SEQ ID NO: 33711 - DNA, 675 bp, Zea mays
  misc_feature: Ceres CLONE 1411802-F
  misc_feature: Encodes the peptide sequence at SEQ ID NO. 33712
  misc_feature (379)..(379): n is a, c, t, g, unknown, or other
  misc_feature (386)..(386): n is a, c, t, g, unknown, or other
  misc_feature (424)..(424): n is a, c, t, g, unknown, or other
  misc_feature (507)..(507): n is a, c, t, g, unknown, or other
  misc_feature (528)..(528): n is a, c, t, g, unknown, or other
  misc_feature (556)..(556): n is a, c, t, g, unknown, or other
  misc_feature (593)..(593): n is a, c, t, g, unknown, or other
  misc_feature (621)..(621): n is a, c, t, g, unknown, or other
  misc_feature (622)..(622): n is a, c, t, g, unknown, or other
  misc_feature (624)..(624): n is a, c, t, g, unknown, or other
cgcggtggcggccgctctagaactagtggatcccccgggctgcaggaattcgcacgagaccattacctagaacatcctaatcgaaaaaatgcggcgcctccactttgcgatgcccgcgtcctcgctcccctccccatcctcctcatctaccgtgctctccattccccacccgctcccaccgccgctcgcagatgccgcccaaggtggtcgccgtcgccgcgggcgaggcccacacactcgccctcacgggtgacgggcaggtgtactcctggggcagggggccgttcggtcgcctcgggaacggccgcgaggacgacaagctggtccccaccgcggtggcgcccgcggtctctgccagcgggacacccgcggcccaggnttcgtcngccgtcgcggctggtgcctaccacagccttgcgctggnacgatgaaggttcactctgggtcatggggttacaatctctatggtcaacttgggctatggggaccagaattccctttttccantgtttcgttgagcaattcccnggggatttaggttctcctgaaacatggnaatgatgaagaccagaacacacgtggtcgcacttggntttgaagctgtcttctgtcacagctggnngncattgatgtccttgccataaaaacagtttggggagccttttggagggtggg

SEQ ID NO: 33712 - protein, 79 aa, Zea mays
  misc_feature: Ceres CLONE 1411802-F
  misc_feature (21)..(77): Pfam Name: RCC1 Pfam Description: Regulator of chromosome condensation (RCC1)
  misc_feature: SWISSPROT Homolog: EC 2.7.11.1 Non-specific serine/threonine protein kinase
  misc_feature (63)..(63): Xaa is any aa, unknown, or other
  misc_feature (78)..(78): Xaa is any aa, unknown, or other
MPPKVVAVAAGEAHTLALTGDGQVYSWGRGPFGRLGNGREDDKLVPTAVAPAVSASGTPAAQXSSAVAAGAYHSLALXR

SEQ ID NO: 33713 - DNA, 670 bp, Zea mays
  misc_feature: Ceres CLONE 1411807-F
  misc_feature (168)..(168): n is a, c, t, g, unknown, or other
aaagctggagctcaccgcggtggcggccgctctatcacctacctgcatcccccgccctgcaggaattctcaccagaccattacctagaacatcctaatcgaaaaacctaccgctgacttgtcaattcctgtctgtgcgcgcgcgcgcgtgtggcgcctccccagaggntgttgatctgacgactgtccccatgaacaccgatccgctgcagatgctgctgctaccgatgatggccctttccctcatcacgcttatcttataagaggtctcaagaggccccttcctgatccaggactcaatccccacgaccgtggtcccgctgataacgatgctcttgttgatcggcatactagtcgtttggtctatcccccacgcactggtcacggagaagttcgtatcgtcgtttccttaccaactccaggtacctggaatgacctgtacgcctgtctgacgcccccccgtgactcttcctcgtgagggttctccccgtgactatgcgtgagattctcaaaagcgatgaagccgaagctgttattgaaaaacctcctctccatggacctgttgacgatgacgacgacgacccgttctctgacggtgctcgctctcacaaacggagtcacctacctcaactaacgtggactcttgatgctccggctaaaaagagtgaaac

SEQ ID NO: 33714 - DNA, 646 bp, Zea mays
  misc_feature: Ceres CLONE 1411808-F
  misc_feature: Encodes the peptide sequence at SEQ ID NO. 33715
  misc_feature (427)..(427): n is a, c, t, g, unknown, or other
  misc_feature (455)..(455): n is a, c, t, g, unknown, or other
  misc_feature (469)..(469): n is a, c, t, g, unknown, or other
  misc_feature (491)..(491): n is a, c, t, g, unknown, or other
  misc_feature (574)..(574): n is a, c, t, g, unknown, or other
cgctctagaactagtggatcccccgggctgcaggaattcgcacgagaccattacctagaacatcctaaaaaaaaaaataggccgcaccgcatttcgaaaggccacgccaccgccacctccacctcctcgaagccgccgcgaccgatcgagcgaagcgtcccttcccgcgccgacgccgaaaccctagctcctcttacgccatggccaccgtgtcgctcactccgcaggcggtcttctccaccgagtccggcggcgccctggcttctgccaccatcctccgcttcccgccaaacttcgtacgccagctcagcaccaaggcacgacgcaactgcagcaacatcggcgtcgcgcagatcgtcgccgccgcgtggtccgactgcctcgctgcccgccgcctccgcggcggcggatgtcagcgcaattcctnaacgctaagggttgcgcagcccgtccgnccgtcgtattgggncgaagcgtaaactgggtcgggntcccgacgcccaggctcggcccgttccaagcgcgggggaaaaaaggcctggggaaaaaaaaaaagtaaaccccccccccccgnggggggtgttttttattatacccccgccccgcggggggagtgaggagaaaacaaaactcggtgcgcctctct

SEQ ID NO: 33715 - protein, 92 aa, Zea mays
  misc_feature: Ceres CLONE 1411808-F
  misc_feature: SWISSPROT Homolog: EC 2.5.1.48 Cystathionine gamma-synthase
  misc_feature (76)..(76): Xaa is any aa, unknown, or other
  misc_feature (90)..(90): Xaa is any aa, unknown, or other
MATVSLTPQAVFSTESGGALASATILRFPPNFVRQLSTKARRNCSNIGVAQIVAAAWSDCLAARRLRGGGCQRNSXTLRVAQPVRPSYWXEA

SEQ ID NO: 33716 - DNA, 708 bp, Zea mays
  misc_feature: Ceres CLONE 1411809-F
  misc_feature: Encodes the peptide sequence at SEQ ID NO. 33717
gcggtggcggccgctctagaactagtggatcccccgggctgcaggaattcgcacgagaccattacctagaacatcctaatcgaaaaattacggctgaagggagtcgctcgccgccgcgttcgaggcgttccctcgtcgcgctcgcgccgtcgaccttcaccgctcgctgtcaggtctgcccgccacgacctcgccggccacactcgcagctcgccctcgctcctacgcctcgccggcgaggccttctgccttttcgcgccctctatctgctgcgatctttggagcatcgttctcttctctcacttgagatccagacccctaaaccctagagctcgccgcttccgctcgctcgctccgcgctggcggcgacaatggaggacgaggagatggagaagaaggtgcagcagtacttgcagcgcaagggtttccgcctcactgagcttgcgctccaggaggagtgcaaccgcctctccacctccgccatctccgacgttgcgcttgcacggtctgacaatgatccagcgagatactacgatggatatagcagattaagaacatgggcatacggttctcttgatcaatataagcacgaattacttcgcgtcctttatccagttttcatccatagcttcatggatctagtggcagaaggacatatgcaggaagctcggtcatttttccatacatttcgggaagatcatgaggtga

SEQ ID NO: 33717 - protein, 112 aa, Zea mays
  misc_feature: Ceres CLONE 1411809-F
  misc_feature (34)..(111): Pfam Name: TFIID_90kDa Pfam Description: WD40 associated region in TFIID subunit
MEDEEMEKKVQQYLQRKGFRLTELALQEECNRLSTSAISDVALARSDNDPARYYDGYSRLRTWAYGSLDQYKHELLRVLYPVFIHSFMDLVAEGHMQEARSFFHTFREDHEV

SEQ ID NO: 33718 - DNA, 641 bp, Zea mays
  misc_feature: Ceres CLONE 1411814-R
  misc_feature (641)..(641): n is a, c, t, g, unknown, or other
ccgggccccccctcgaggtcgacggtatcgatattttttttttttttttttgttcctcgaacaagcaggcacatgtgtttacatacaattggtggaacaggcgcagtacaaccaaaccaatctttcagggatgtctggacacatttattttcgacgtacagagcacggatgcggggtagcaaattcttaccgctccaaggagggaagattttgcggcatgcagtcacttcaataagaatgacatgtattatcgggatggccagagccttgtgtttatttgcatggtgcgtgtttgttcaggtactccatggccacggcggcgtgcaacgcggctccgacggggagcgcggcctcgtcgatgtccaggtgcggtgagtgcacgtggtggaccttccccgtcgcctcgtcgcggacgccgacgctgaagaaggccgccgggatccgctgcgcgtagaagccgaagtcctccgccgccatgaactgggggcacagcatcacgctggcctcgcccagcatgctctccgccaccgccttggcgtgggagtacatggcctcgtcgttcacggtggccgggtacggcctcatcctctcctccatcaagtccaccgtagcggcgcagcggctcacggcggcttgtcctn

SEQ ID NO: 33719 - DNA, 722 bp, Zea mays
  misc_feature: Ceres CLONE 1411814-F
  misc_feature: Encodes the peptide sequence at SEQ ID NO. 33720
ggcggccgctctttcacagtggatcccccgggctgcaggatttcgcacgagaccattacctagaacatcctaaaaaaaaaaataggacaagccccagcagtttgccactcccacgcgaaacagaagccccagcagggcggcactcccgacgcgacgcccctgcttgccggccgggaggctcactcgactctgcctccacttcctcgtctgtccgttggagcacggcgccgatggcggcggcgccagcgctcgcgcgggagctgctggacgcggcgcgggagccggagttcgcggagtggcagcgcggcgtgcggcgccggatccaccagcacccggagctggccttccaggagcaccgcaccagcgcgctcgtgcgcgccgagctcgacgcgatcggcgtcccgtacgcctggcccgtcgcgcagacgggcgtcgtggccaccatcaccggccccgccgcgggccccgtgttcgcgctccgcgccgacatggacgcgctccccatccaggaaatggtagaatgggagttcaagagcaaggaagacgggaagatgcatgcgtgcggccatgacgcccacgtggcgatgcttcttggagcagctaggttgcttcagtctcggagggacgatttagaggtactgatagttttgttggctggctttttttgccagagatatttcagtaatccgttctactacgtacagttgtgaagcttaatttgg

SEQ ID NO: 33720 - protein, 159 aa, Zea mays
  misc_feature: Ceres CLONE 1411814-F
  misc_feature: SWISSPROT Homolog: EC 3.5.1.14 Aminoacylase
MAAAPALARELLDAAREPEFAEWQRGVRRRIHQHPELAFQEHRTSALVRAELDAIGVPYAWPVAQTGVVATITGPAAGPVFALRADMDALPIQEMVEWEFKSKEDGKMHACGHDAHVAMLLGAARLLQSRRDDLEVLIVLLAGFFCQRYFSNPFYYVQL

SEQ ID NO: 33721 - DNA, 671 bp, Zea mays
  misc_feature: Ceres CLONE 1411817-F
  misc_feature: Encodes the peptide sequence at SEQ ID NO. 33722
  misc_feature (594)..(594): n is a, c, t, g, unknown, or other
  misc_feature (595)..(595): n is a, c, t, g, unknown, or other
  misc_feature (608)..(608): n is a, c, t, g, unknown, or other
aagctggagctccccgcggtggcggccgctctagaactagtggatcccccgggctgcaggaattcgcacgagaccattacctagaacatcctaatcgaaaaatgaatagagaaaaatgaaatagaatggcagaaaacctaaacgtgaggttggcgaaaagagaaaagaactagagcatcccgtggagagaaggcggcggcagcgcctgtgggagatgtcaatcctgtgggagaagagcgcgggttggcgatggctggttcggcggacgcgtgactcgaagcccttctttttcacgttcgcggcgctgtgcggcgtcgtccccggcgtaatcggctacggcgtgatgcagctcaccggctcccgcaacgagcagctcgaggcccaccttcgctccacggcccgtcccgagaccacgatgatggggcaagtgaacagggagaggctggcggagtttctcggcgagctgcaacggaaagaggacacgaacgacaggtacggggcccgcgcttgaggggggagaccctgaccaggaagcgctacgagcgcatccagcccttgcctgccgccaacgcgcaagcgagccaggagatgcgnnaccccaacggcgnaggaggagaggcccaaggcaaagtgagtcatcagcgagacgtgcctcagtcaatttttacttg

SEQ ID NO: 33722 - protein, 98 aa, Zea mays
  misc_feature: Ceres CLONE 1411817-F
MSILWEKSAGWRWLVRRTRDSKPFFFTFAALCGVVPGVIGYGVMQLTGSRNEQLEAHLRSTARPETTMMGQVNRERLAEFLGELQRKEDTNDRYGARA

SEQ ID NO: 33723 - DNA, 645 bp, Zea mays
  misc_feature: Ceres CLONE 1411823-F
  misc_feature: Translation starting site: 96
  misc_feature: Pfam Name: CH Pfam Description: Calponin homology (CH) domain
  misc_feature (517)..(517): n is a, c, t, g, unknown, or other
cgcggtggcggccgctctagaactagtggatcccccgggctgcaggaattcgcacgagaccattacctagaacatcctaatcgaaaaagatttggatgtggactagatgcttaaggtgtgaacgtgaaagtggggtccccagatcatcacgaagggtgataatgtcagctgaagcacactacctttcatttgggaagttccttgaacttagtttttcaagccactcaaccgctagaaggctgccaatatgcgggcattcactcaatacggattgtctgcgctttttttgggttgggctccaaagttgcaatgttccagtattcctcagtcgaaatttacaatgcctgcaaaccacagcctactcttgagattcacaaccccgatatgcacaaagatgccccaaggttgctggccctcgtgtttcgtgctctggattgttgagtcttcaatgagagctgattccgtttatatagaggtgaacaagcttttgattatttcttttgttaatttggtgaancatatagaggtgaacaagcttattaaaggaagatccttgtacaatcaagagttcatacaatagatgaaacgatattgtgattctctcaatgctggcttcatgagcaagcaatcattcaccttgttcac

SEQ ID NO: 33724 - DNA, 686 bp, Zea mays
  misc_feature: Ceres CLONE 1411830-F
  misc_feature: Encodes the peptide sequence at SEQ ID NO. 33725
  misc_feature (661)..(661): n is a, c, t, g, unknown, or other
  misc_feature (663)..(663): n is a, c, t, g, unknown, or other
  misc_feature (664)..(664): n is a, c, t, g, unknown, or other
  misc_feature (667)..(667): n is a, c, t, g, unknown, or other
  misc_feature (668)..(668): n is a, c, t, g, unknown, or other
tccccgcggtggcggccgctctagaactagtggatcccccgggctgcaggaattcgcacgagaccattacctagaacatcctaatcgaaaagtgctgccgccagatctaaccaaaccccgcgccctcctcaccgtccggcgagctacggactcagcagatcaccgtcgctcgagttgtacctgaaggcgcgcccgtggaaccggccgcgagataacggcggcgggaaggcgggcgacgatgccggtggcagcgtcggccatctacttcctcaaccttcgcggggacgtcctcatcaaccgcctctaccgtgatgatgttgggggaaatatggttgatgcgttcagaatgcatatcatgcaaacaaaagaacttggcacatgccctgttcgtcaaataggaggctgctccttcctttatatgaggatcagtaatgtttacattgtgatcgtagttagcagcaatgctaatgttgcatgtgctttcaaatttgttggtcgaggcggtggcttctcttcaagtcctacttcgggtggagctttttgatgaagacgctatcaggaattaactttgttttgatatatgaactttcttgatggatcaatgggggattttggttatcctcaaaacctttcactggaaaattttttgagttgaaaactncnnccnnaaagagaggtgttccgcc

SEQ ID NO: 33725 - protein, 101 aa, Zea mays
  misc_feature: Ceres CLONE 1411830-F
MPVAASAIYFLNLRGDVLINRLYRDDVGGNMVDAFRMHIMQTKELGTCPVRQIGGCSFLYMRISNVYIVIVVSSNANVACAFKFVGRGGGFSSSPTSGGAF

SEQ ID NO: 33726 - DNA, 716 bp, Zea mays
  misc_feature: Ceres CLONE 1411835-F
  misc_feature: Encodes the peptide sequence at SEQ ID NO. 33727
  misc_feature (330)..(330): n is a, c, t, g, unknown, or other
  misc_feature (386)..(386): n is a, c, t, g, unknown, or other
tccccgcggtggcggccgctctagaactagtggatcccccgggctgcaggaattcgcacgagaccattacctagaacatcctaatcgaaaacttctgcaagcaaacctaaccaagcctctgcggctcttcttcgaatccaactcctccccgatccccaaaatcgaacccaagtcgaaaccctaacctcggccttctcgatgtcggccgccacaaccgccccaacccctgcggtggccaccccgatggcgccgcctccgtcgtacccggcctcctccacgatctccgcctccgtggccgcgtcggtcgaggaagaggacgacctctatggncgcctcaagtcgctccagcgccacatggagttcgtcgagatccaggaggagtacgntaaagacgaacagaagaacctcaagcgcggactcctccgtgcgcaggaggaggtcaagcggattcaggtcggaacggttcggtattgggcaggtttatggaaaaagggccaaggcaaaaaaggaatccggggtttctaatagggggagaaacaaaaatggggggggtccttaaaaacaaaaaccgggaggtggtaaaagggggaaaaatttggggggggggatcccccccccaagctttttaaaaaaaggggggggccccccaagggacacccaaaattcctttgtgggggggaccccgcaaaaaaccccccgccccccaagcggtgttg

SEQ ID NO: 33727 - protein, 108 aa, Zea mays
  misc_feature: Ceres CLONE 1411835-F
  misc_feature (63)..(63): Xaa is any aa, unknown, or other
MSAATTAPTPAVATPMAPPPSYPASSTISASVAASVEEEDDLYGRLKSLQRHMEFVEIQEEYXKDEQKNLKRGLLRAQEEVKRIQVGTVRYWAGLWKKGQGKKGIRGF

SEQ ID NO: 33728 - DNA, 630 bp, Zea mays
  misc_feature: Ceres CLONE 1411836-F
  misc_feature: Encodes the peptide sequence at SEQ ID NO. 33729
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (376)..(376): n is a, c, t, g, unknown, or other
  misc_feature (399)..(399): n is a, c, t, g, unknown, or other
  misc_feature (400)..(400): n is a, c, t, g, unknown, or other
  misc_feature (406)..(406): n is a, c, t, g, unknown, or other
  misc_feature (408)..(408): n is a, c, t, g, unknown, or other
  misc_feature (409)..(409): n is a, c, t, g, unknown, or other
  misc_feature (475)..(475): n is a, c, t, g, unknown, or other
  misc_feature (487)..(487): n is a, c, t, g, unknown, or other
  misc_feature (488)..(488): n is a, c, t, g, unknown, or other
  misc_feature (513)..(513): n is a, c, t, g, unknown, or other
tggagctccccgcggtggcggccgctctagaactagtggatcccccgggctgcaggaattcgcacgagaccattacctagaacatcctaatcgaaaacccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcacctagtcacgagagagggaggaggctctgcttctgctgccgcttcttcttctcctgctgctcttccggagataagcagggggccgggacagctgactagctgagaggcatgggggatgggacgcccggcgggnnnggnaagctgccgtacagctacgccgnncagcangnnacgcggaagctggtgaagagcgtcagccgcgtggaagcgcgcaagttcggcctgggccttcgtggngggttcctcgtnngtacctggggctacttttccaccgncaagtcgaacccttccgattgccatgaccaggcgacccgttcccggaatggcggtgggggccgaaccgctccctgggagagggggcccccccccccaaaactctcaagcctccggag

SEQ ID NO: 33729 - protein, 94 aa, Zea mays
  misc_feature: Ceres CLONE 1411836-F
  misc_feature (9)..(9): Xaa is any aa, unknown, or other
  misc_feature (18)..(18): Xaa is any aa, unknown, or other
  misc_feature (20)..(20): Xaa is any aa, unknown, or other
  misc_feature (21)..(21): Xaa is any aa, unknown, or other
  misc_feature (48)..(48): Xaa is any aa, unknown, or other
  misc_feature (56)..(56): Xaa is any aa, unknown, or other
MGDGTPGGXGKLPYSYAXQXXTRKLVKSVSRVEARKFGLGLRGGFLVXTWGYFSTXKSNPSDCHDQATRSRNGGGGRTAPWERGPPPPKLSSLR

SEQ ID NO: 33730 - DNA, 683 bp, Zea mays
  misc_feature: Ceres CLONE 1411837-F
  misc_feature: Encodes the peptide sequence at SEQ ID NO. 33731
  misc_feature (613)..(613): n is a, c, t, g, unknown, or other
  misc_feature (639)..(639): n is a, c, t, g, unknown, or other
  misc_feature (656)..(656): n is a, c, t, g, unknown, or other
  misc_feature (660)..(660): n is a, c, t, g, unknown, or other
  misc_feature (675)..(675): n is a, c, t, g, unknown, or other
  misc_feature (676)..(676): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
tccccgcggtggcggccgctctagaactagtggatcccccgggctgcaggaattcgcacgagaccattacctagaacatcctaatcaaaaatcggatccatggtctcttttctcagccctctcagtctcacacaccacaccagagcagcgcagccgagcatgcactcatcacatcagctcctcgtctcctagctttcctattcctgccttgataattggccaattgttcgatctccttctttactaccccctttgctttcgttgctgctactactactgttccatctcctaggtttcgttgttgtccctgcaggccgccactgagtgatttgttagcagataagatttagatctcccagataaaaaaaagaggttgagaggagagctagcactaggcactagcaatcctgctgtgaggtgaatatggatccagtcgcagcatccatacacggtcatcatcttcctccaccgttcaacacccgggacttccatcaccatctccagcaacagcagcagcagctcaagaccgaggacgaccacggcagcggcgcgcgaaggccgtgatgcttctcggagatgtcgcagccgctggcacctccatgacggcggcccnggagcgtggttggcgctgtccctcgntgatgatgatgggcggnctcnggccttgttctggcnnaaannnc

SEQ ID NO: 33731 - protein, 46 aa, Zea mays; identical to SEQ ID NO: 32429
  misc_feature: Ceres CLONE 1411837-F

SEQ ID NO: 33732 - DNA, 675 bp, Zea mays
  misc_feature: Ceres CLONE 1411838-F
  misc_feature: Encodes the peptide sequence at SEQ ID NO. 33733
  misc_feature (518)..(518): n is a, c, t, g, unknown, or other
  misc_feature (523)..(523): n is a, c, t, g, unknown, or other
  misc_feature (603)..(603): n is a, c, t, g, unknown, or other
  misc_feature (613)..(613): n is a, c, t, g, unknown, or other
  misc_feature (636)..(636): n is a, c, t, g, unknown, or other
ggagctccccgcggtggcggccgctctagaactagtggatcccccgggctgcaggaattcgcacgagaccattacctagaacatcctaatcgaaaaatcgatctgtacgccctccccaccggtgggtcgcgcacctccaccaacctaccttcccgccccgcccgtcgccgtcgatgactcgccgtccgtttccgccctccaaaaccctactacctcttaccttccagccccgcgtcctccatggccaccaacggcagctctccgagggttcgggacacggagagcagtctggagaaggtgaagcggcagctgtcatcggggtctgggaggtacctgctgcaggggcccctgctcaagcgatctgagacgttacggaaatggaatgagcgttgggtcatattggacccgacatcagggaagatggaatacaaactccggagaaatgaactgccattaaggggaccattctgtttgacgcctcgagcaccattactttatctcctgtgaacttttcaggnatgcnaaatataatggctgctgcttctacatcggaactcctcaaaagaaagattactttctttgtgctgaactcctggtgctgcnaaagcttggntatctacatacatgcaactcagntagtctacgagctcataagagcagtaatttctttgggct

SEQ ID NO: 33733 - protein, 88 aa, Zea mays
  misc_feature: Ceres CLONE 1411838-F
MATNGSSPRVRDTESSLEKVKRQLSSGSGRYLLQGPLLKRSETLRKWNERWVILDPTSGKMEYKLRRNELPLRGPFCLTPRAPLLYLL

SEQ ID NO: 33734 - DNA, 724 bp, Zea mays
  misc_feature: Ceres CLONE 1411839-F
  misc_feature: Encodes the peptide sequence at SEQ ID NO. 33735
ggagctccccgcggtggcggccgctctataactagtggatcccccgggctgcaggaattcgcacgagaccattacctagaacatcctaatcgaaaaccggaatggtatcgtgcgacctgtagtcgtcgccagccacctcgctccctcctagacgacacccagctagtgctcccttccacacccaggaaccagccacctaaccccgcccgccatggcgggcctcgccgcctccgagaactcgcccccggggccggcggcgccgccgcgccggctctcgtccccgctacccgggcgcgcgtcgtggaccccgtcaacgtgcgcctcaccgcgcgctcccccccggaagagctcgccctctcccgccccccttaacccgcggggggcgaaagactcgcttggaaggccctgatctgacgcccctcgtgaccaagggacggggcgaaaagcccatgaacacccgagctccgggcccgacgcccgccccctcccaccatggcacattccgccaacaactccgccgccacggtggactccatattaaaacccgccaaggggcccccacgagttcttggctccgggaggatgccccccccactttcttccggccggccgcgaaagggggggggctccggggggacacagaggtgggatgggcctgccggtagtccgtgaaccgggcggcggcccgtgtaaacaatttacacgcccgccctgacgcgcaggc

SEQ ID NO: 33735 - protein, 65 aa, Zea mays
  misc_feature: Ceres CLONE 1411839-F
MAGLAASENSPPGPAAPPRRLSSPLPGRASWTPSTCASPRAPPRKSSPSPAPLNPRGAKDSLGRP

SEQ ID NO: 33736 - DNA, 770 bp, Zea mays
  misc_feature: Ceres CLONE 1411841-F
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (32)..(32): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (770)..(770): n is a, c, t, g, unknown, or other
gtgccccccccccccccccnnnntttcgactnggtttccacccnnnnnaaaaagctggcgctccaccgcggtggcggccgctctagaactagtggatcccccgggctgcaggaattcgcacgagaccattacctagaacatcctaatcgaaaaaccatcccggaggtaatcttgcgccgattcggtgccgatttgcgccatccgcgaccggaggctccgccgggtcttgtgttcttgcggggcgggggctcaggacaacctggcctctgcttgattggattcggggcgttcggcgcctccagctcgcgatctttcctgccggtttcgtcgaccgctggtcaacctggccggtcgggcccgggggctcttcacctccgtgctgcctgccaccgtcgctttagtcaagtcttggccaagattttagctatctccggccaaaaggctttaccgattctcggattggtggcttccttggggagagaagccgggttcctgtttccgtctcttgggctccagcatgttctgtagcacaccgggttcccttctccagtgggagcgggcccgtggtgccccttggcttttgagcccccccggatccccccccccgccatggtactctttggcccccccccccccctgcgccacccagctcctacgcgatttggggcccggggcggcaacgacaaacacatggaaaatgggctctgcagccaatatacacaaacaccaacccgagatcagagcgcgagcgcgaccgccagacccacccn

SEQ ID NO: 33737 - DNA, 672 bp, Zea mays
  misc_feature: Ceres CLONE 1411845-F
  misc_feature: Encodes the peptide sequence at SEQ ID NO. 33738
  misc_feature (505)..(505): n is a, c, t, g, unknown, or other
  misc_feature (623)..(623): n is a, c, t, g, unknown, or other
  misc_feature (624)..(624): n is a, c, t, g, unknown, or other
  misc_feature (665)..(665): n is a, c, t, g, unknown, or other
aaagctggagctccccgcggtggcggccgctctagaactagtggatcccccgggctgcaggaattcgcacgagaccattacctagaacatcctaatcgaaaaatcacaggtctcccggactcccgtgcgctattctctatcaacttacccagcacacaggacacactctaatctccacacgacccaatagatatgcggggctgaaggatgaaccttacagcaaaagggatcggcctcctgcttctccttgtcttgcttgctctttgctccaccattgaagtcggccaggtaagaagaggcaagcattggaggtcgtcgaggagctcaccgggctcatcccagctcaagaaagacaagggaaagaagagcagctcccgccggctgaacagcgccaaccggccaggtccgaagccaccggtcagctcgacaccgagctctggtgctgccaaggtaaatcatcataatccttaccaaccaagcccaagtccaagcccgaatgcccctngacatccctcctatgccgagccctgcccatgatagcaggcattccactcccgagacgccggctccagcctggtgggaagggtcagcagcagccatcacagtcgccgcagggatctcgnnaggcgcaggattcaaaggtaggttgatctggagccaggggntgaggaa

SEQ ID NO: 33738 - protein, 109 aa, Zea mays
  misc_feature: Ceres CLONE 1411845-F
  misc_feature (100)..(100): Xaa is any aa, unknown, or other
MNLTAKGIGLLLLLVLLALCSTIEVGQVRRGKHWRSSRSSPGSSQLKKDKGKKSSSRRLNSANRPGPKPPVSSTPSSGAAKVNHHNPYQPSPSPSPNAPXHPSYAEPCP

SEQ ID NO: 33739 - DNA, 694 bp, Zea mays
  misc_feature: Ceres CLONE 1411846-F
  misc_feature: Encodes the peptide sequence at SEQ ID NO. 33740
  misc_feature (517)..(517): n is a, c, t, g, unknown, or other
  misc_feature (527)..(527): n is a, c, t, g, unknown, or other
tggagctccccgcggtggcggccgctctagaactagtggatcccccgggctgcaggaattcgcacgagaccattacctagaacatcctaatcgaaaaagctaggttcctatgcccaaagtcacacagcttcttctccttctacttctccttcctcctctcctcaccggcaccttgatctaatctcttccatcctagcttgctcgccgctgccagtctctcctccgcctgcaacgactcccatgtctcagtcttctcctctcttctccgtcgcccgagcgcacgccggagcaggagggcgagccgtggcagccgctctcctgctccgtcgtcgccccattgcacagctgccgcacagcatccatggcctacggtgtctctctccagccagagcgacaccttccaagacgctcctcagcctcccccgcgccacgctgtcctccttcgccgaccccgacggcgacggcggctccagcgcgaaagccagcgacggcggcgccaaggccggcgcccggcggngaagaagcangggtcgggaatgcgagattgtcggaattgggccagggcgttccactctcgcaggggggttggcgacgtccatctccgggggacgatcgcgttcgccgcctcaccccgtgccgctggcgatggcgcctcgctggtctgccacggaacctttcagatgaaccgcgctgg

SEQ ID NO: 33740 - protein, 147 aa, Zea mays
  misc_feature: Ceres CLONE 1411846-F
  misc_feature (93)..(93): Xaa is any aa, unknown, or other
  misc_feature (96)..(96): Xaa is any aa, unknown, or other
MSQSSPLFSVARAHAGAGGRAVAAALLLRRRPIAQLPHSIHGLRCLSPARATPSKTLLSLPRATLSSFADPDGDGGSSAKASDGGAKAGARRXRSXGRECEIVGIGPGRSTLAGGLATSISGGRSRSPPHPVPLAMAPRWSATEPFR

SEQ ID NO: 33741 - DNA, 682 bp, Zea mays
  misc_feature: Ceres CLONE 1411856-F
  misc_feature (579)..(579): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (595)..(595): n is a, c, t, g, unknown, or other
  misc_feature (599)..(599): n is a, c, t, g, unknown, or other
  misc_feature (600)..(600): n is a, c, t, g, unknown, or other
  misc_feature (608)..(608): n is a, c, t, g, unknown, or other
  misc_feature (639)..(639): n is a, c, t, g, unknown, or other
tccccgcggtggcggccgctctagaactagtggatcccccgggctgcaggaattcgcacgagaccattacctagaacatcctaatcgaaaagaaaggtagatattttttcccgtctcgctcaatgattcaccccatcgcagccatcgatcagaaaatttacggctcataattctcgtctgcttatccgctcccttctctccctcaacttcagcaagttccccgcaaaaccgcagccggaggtcgccggtcgccaccaccaatggggccacccgccatggcgttccaagccctcaccctcacgccactccccttctcactccacagctcgagccgccgcgtccgcgtgcttgccgttgcggccgaccagactcctccgcccgcccccccttcggagccggcgaacagccctagccgcctccttcgcgagctcgcgcagcggaagaaggccgtatcccctaagaagaagcatccgccgcgtcgcttcatcctgaagccacctctcgatgacgaggcttttaacccggcggttcctcagcaggcccgcagctgtcgctcaaggcgctcccgctgctctcttnctggctcnnnctcgcngcgnntctcacgngaaggggacctgggatggacgagactccccnagggcagcaaaggggggcttcggaacccgtcgcgggcctcgag

SEQ ID NO: 33742 - DNA, 711 bp, Zea mays
  misc_feature: Ceres CLONE 1411860-F
  misc_feature: Encodes the peptide sequence at SEQ ID NO. 33743
gctctagaactagtggatcccccgggctgcaggaattcgcacgagaccattacctagaacatcctaatcaaaaaaccatcaccgcctcgtgtgcagcgtgctcgcccacctcctctgtcgacactcagggtactgacgcaccaccccgaagccctcccgccgcgctcgcagggtgttcgacccttcgcccgcgcgccctcacgacatgcctcctccgtctccgccgccgccaaggccgccgcggcgttcgcgcacaaggtccagaaggagctggccgcgccggcgcagcgccgcgcgggcttgacccgccggaccaagccgtgcagcgtgcgcgccgtcgcttcgcccgcgcgcgccctgtcgtccaccggctcggtgaagagcgcgatgacgatgacggagaagatactggcgcgggcgtcggagcgcgcggcgctggagcccggggagaacgtgtgggtcgacgtcgacgtgctcatgacgcacgacgtctgcgggcccggcgccttcgacatcttcaagaaggagtttcggggaggacgccagggtctgggaccgcgagaagctcgtcgtcatcccggaccactacatcttcaccaggcgacggccggggccaaacgcaaccgtcgaccatcctccggggacttctgtggcggagcagaacattcaagtacttcctatgacaataaaggaacctcagcgattttcagg

SEQ ID NO: 33743 - protein, 108 aa, Zea mays
  misc_feature: Ceres CLONE 1411860-F
  misc_feature: SWISSPROT Homolog: EC 4.2.1.33 3-isopropylmalate dehydratase
MTMTEKILARASERAALEPGENVWVDVDVLMTHDVCGPGAFDIFKKEFRGGRQGLGPREARRHPGPLHLHQATAGAKRNRRPSSGDFCGGAEHSSTSYDNKGTSAIFR

SEQ ID NO: 33744 - DNA, 746 bp, Zea mays
  misc_feature: Ceres CLONE 1411861-F
  misc_feature: Encodes the peptide sequence at SEQ ID NO. 33745
  misc_feature (717)..(717): n is a, c, t, g, unknown, or other
  misc_feature (746)..(746): n is a, c, t, g, unknown, or other
tccccgcggtggcggccgctctagaactagtggatcccccgggctgcaggaattcgcacgagaccattacctagaacatcctaatcgaaaaaaaaccataggcgtgtcaggaacggtggagagcggcgaccactactcgccttcgtctcggtcctcgcgcgctcctgggctgcctcttcgtgctagaaaccctcgcgtcgcgggagcttggttgcgactgcaagcgccaagctgctgtgccgtgggtggcggcggcgggagtggaagtggaaccgcagccgccagccggtgctgtgatggacgcgcagcagcagctggatttggtcatgcgtcaccagagcatggccaccgtctgcgagagcgaggacgcgctggggtcgtcggagtcggatcccgcgaggccggcgcgcccgcgcggcaagaggagccgcgccgccgaggtgcacaacctctccgagaagaggaggaggagcaggatcaacgagaagatgaaggcgctgcagaccctcatacccaactcgagcaagacggacaaggcttccatgcttgatgatgccattgagtacctgaagcatcttcagctccaggtgcagatgttgtctatgaggaatgccctctatctgcccccaggaaacctgtctggagcacccgagactctggcaccccttagaaatgtgcgcagcactttaaccaaagtggtgccaagcatcaaaattncccggcgttggtcgttctacctggaaacn

SEQ ID NO: 33745 - protein, 150 aa, Zea mays
  misc_feature: Ceres CLONE 1411861-F
  misc_feature (46)..(95): Pfam Name: HLH Pfam Description: Helix-loop-helix DNA-binding domain
  misc_feature: The sequence is a functional homolog of SEQ ID NO 1245 in the 10/412,699 US patent application
  misc_feature: The sequence is a functional homolog of SEQ ID NO 966 in the 10/374,780 US patent application
  misc_feature: The sequence is a functional homolog of SEQ ID NO 1246 in the 10/412,699 US patent application
  misc_feature: The sequence is a functional homolog of SEQ ID NO 967 in the 10/374,780 US patent application
  misc_feature: The sequence is a functional homolog of SEQ ID NO 120 in the 10/374,780 US patent application
  misc_feature: The sequence is a functional homolog of SEQ ID NO 388 in the 10/412,699 US patent application
  misc_feature: The sequence is a functional homolog of SEQ ID NO 494 in the 11/435,388 US patent application
  misc_feature: The sequence is a functional homolog of SEQ ID NO 890 in the 10/225,066 US patent application
  misc_feature: The sequence is a functional homolog of SEQ ID NO 905 in the 11/479,226 US patent application
  misc_feature (141)..(141): Xaa is any aa, unknown, or other
MDAQQQLDLVMRHQSMATVCESEDALGSSESDPARPARPRGKRSRAAEVHNLSEKRRRSRINEKMKALQTLIPNSSKTDKASMLDDAIEYLKHLQLQVQMLSMRNALYLPPGNLSGAPETLAPLRNVRSTLTKVVPSIKIXRRWSFYLET

SEQ ID NO: 33746 - DNA, 602 bp, Zea mays
  misc_feature: Ceres CLONE 1411863-F
  misc_feature (320)..(320): n is a, c, t, g, unknown, or other
  misc_feature (365)..(365): n is a, c, t, g, unknown, or other
  misc_feature (371)..(371): n is a, c, t, g, unknown, or other
  misc_feature (376)..(376): n is a, c, t, g, unknown, or other
  misc_feature (382)..(382): n is a, c, t, g, unknown, or other
  misc_feature (393)..(393): n is a, c, t, g, unknown, or other
  misc_feature (400)..(400): n is a, c, t, g, unknown, or other
  misc_feature (420)..(420): n is a, c, t, g, unknown, or other
  misc_feature (516)..(516): n is a, c, t, g, unknown, or other
tggagctcaccgcggtggcggccgctctagaactagtggatcccccgggctgcaggaattcgcacgagaccattacctagaacatcctaatcgaaaaaaatcaacaaactactacaaagccacttcctgctctcgctccgccgccgccgcctccctccccagtcgatcaccaaacctcagtccaaactccaaacccccgccgcatcagaaaaaaaaccctaggccatggacgccgcggcgctggagtcgctcatcctggacctcacgccatcgaggtgtgaagctgggctccttcacgctcaagtccggcatcaaatcgncccatctactcgacctccgcggggtcgtctccacccggggctggntctcgncggtngctcgnttcttcagggntcccggncaggggccctaagggctcgnctggggggtccctaaacggggtccccatcggcggggtccttttcggaaacgttaattcccatggttatgggccaaaaggaggcaaaggcccccggncccgccccaggcccatgagggttccctttccccggggaaaccggccctaatatagaggaccccccccccggggggcccccgggcga

SEQ ID NO: 33747 - DNA, 640 bp, Zea mays
  misc_feature: Ceres CLONE 1411865-F
  misc_feature: Encodes the peptide sequence at SEQ ID NO. 33748
  misc_feature (447)..(447): n is a, c, t, g, unknown, or other
  misc_feature (448)..(448): n is a, c, t, g, unknown, or other
  misc_feature (480)..(480): n is a, c, t, g, unknown, or other
  misc_feature (512)..(512): n is a, c, t, g, unknown, or other
  misc_feature (536)..(536): n is a, c, t, g, unknown, or other
gctcaaaactagtggatcccccgggctgcaggaattcgcacgagaccattacctagaacatcctaatcgaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccggnnacgaaggagttcatggaagccctttgctgcgncgctgatgtgtcatggattggcccagttcggnggtcgggtttctactctggctaanctcgtcgcccgaaaaaagttggtcgggacccccagggcacacggttgcccggcaggtcccgggggggaattcccaagggggggggggtctggttcccgggtatt

SEQ ID NO: 33748 - protein, 114 aa, Zea mays
  misc_feature: Ceres CLONE 1411865-F
  misc_feature (103)..(103): Xaa is any aa, unknown, or other
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGXEGVHGSPLLRR

SEQ ID NO: 33749 - DNA, 743 bp, Zea mays
  misc_feature: Ceres CLONE 1411866-F
  misc_feature: Encodes the peptide sequence at SEQ ID NO. 33750
  misc_feature (581)..(581): n is a, c, t, g, unknown, or other
  misc_feature (646)..(646): n is a, c, t, g, unknown, or other
aaagctggagctccccgcggtggcggccgctctagaactagtggatcccccgggctgcaggaattcgcacgagaccattacctagaacatcctaatcgaaaagtactcccgtgcgctagtgcgctcggcgctgcccccgtccgcccgcagtccgtccccgctcgccgcccatgcgctcgccggccgcccctcggcgctcccccatctcctcccgctccgcccccgccctccgtctggtagtccgtcgccgctcctcccgcacgccagcacgacctagtagacggctcgaagcgaagacggtcccatttccagtctccgtggtcaagatggatttagaggtatccgagggttcaggtactaatgccacctcggatgaccaatcggtgcaaacgctgcctagaagggcaaagcttttggagtattttcaaccggagttagttgaggtcaatggcgtgatgaaggctatttgcaaatattgcggggcgatgttgaggagttcaagcacaaatagccttagaaaccacgttgcggatacatgtcctaaaaattcagttgaggaccgcaagcaattcattgctacnatgggaaaagaccagcggaagcttcatttgtgtttgactctcaaaaggctcgtgagtgtattggntaagtgtgcatccagtgcccgagtcgcattcaacaagtttgacgatcctttctttgctcagtggtatggagtcatgcagcatcatttcagcggtggt

SEQ ID NO: 33750 - protein, 139 aa, Zea mays
  misc_feature: Ceres CLONE 1411866-F
  misc_feature (27)..(72): Pfam Name: zf-BED Pfam Description: BED zinc finger
  misc_feature (107)..(107): Xaa is any aa, unknown, or other
MDLEVSEGSGTNATSDDQSVQTLPRRAKLLEYFQPELVEVNGVMKAICKYCGAMLRSSSTNSLRNHVADTCPKNSVEDRKQFIATMGKDQRKLHLCLTLKRLVSVLXKCASSARVAFNKFDDPFFAQWYGVMQHHFSGG

SEQ ID NO: 33751 - DNA, 604 bp, Zea mays
  misc_feature: Ceres CLONE 1411871-F
  misc_feature: Encodes the peptide sequence at SEQ ID NO. 33752
  misc_feature (321)..(321): n is a, c, t, g, unknown, or other
  misc_feature (345)..(345): n is a, c, t, g, unknown, or other
  misc_feature (353)..(353): n is a, c, t, g, unknown, or other
  misc_feature (532)..(532): n is a, c, t, g, unknown, or other
  misc_feature (551)..(551): n is a, c, t, g, unknown, or other
ggagctccccgcggtggcggccgctctagaactagtggatcccccgggctgcaggaattcgcacgagaccattacctagaacatcctaatcgaaaaaaggcttcgttctgctctccggctctcccgcatccaccccgtctcatccccaatccgaccacctcatccctcgcctccatggccctacccctcgcgtcaccggcgggggcatgagccggtgactgctcacgcggcctcgtctgtctgcgcacgcgcgcggggtcggcgagtgagcattgcggcggtccgcgatcgcccgtgggggagcatggcgtcggcggcggngtcggccggcggggccggcgcggngtctggcnggctgaagactacttcagacccccgaggggcggcacaagctgcagtatgagaagacgcactcccccgccgtcgtgcactacagccacagcgggaagaccgtctcccagatgacagtggcatatttgaaggagaaagcagcaggccagggttccacgcctttcacaccaagtgctggtantggggaatgcggtctgcanctggaagaacttctcggaactgggaatggggagcccgggcactttaactccgg

SEQ ID NO: 33752 - protein, 47 aa, Zea mays
  misc_feature: Ceres CLONE 1411871-F
  misc_feature (24)..(24): Xaa is any aa, unknown, or other
  misc_feature (30)..(30): Xaa is any aa, unknown, or other
MTVAYLKEKAAGQGSTPFTPSAGXGECGLXLEELLGTGNGEPGHFNS

SEQ ID NO: 33753 - DNA, 701 bp, Zea mays
  misc_feature: Ceres CLONE 1411873-F
  misc_feature: Encodes the peptide sequence at SEQ ID NO. 33754
  misc_feature (405)..(405): n is a, c, t, g, unknown, or other
  misc_feature (427)..(427): n is a, c, t, g, unknown, or other
  misc_feature (451)..(451): n is a, c, t, g, unknown, or other
  misc_feature (469)..(469): n is a, c, t, g, unknown, or other
  misc_feature (476)..(476): n is a, c, t, g, unknown, or other
ggagctccccgcggtggcggccgctctagaactagtggatcccccgggctgcaggaattcgcacgagaccattacctagaacatcctaaaaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacgggcttcgtgtggctccggcagcgccgcaaggtggaccactacttcgccaaggccggccgccacgtgtcctacggncgccgaggtgggccggcggggnccgaacaagggccggctcaagagnaatcacgggcgtcagggncaagaanatgccttggctgtgggtccccctccacgagatctgggcgtcgacgacccgcccccacgggtaagctccactgcagggggcatccggcggcctgtccgcagctttccccccgcgagggcccttcaaaaggccaagaagccgcgcgcgggaaaacacccggggtggtctccacgggggggaggggggggagggcgagtgggtccgccgctcagtcgggccgggagtg

SEQ ID NO: 33754 - protein, 177 aa, Zea mays
  misc_feature: Ceres CLONE 1411873-F
  misc_feature (87)..(87): Xaa is any aa, unknown, or other
  misc_feature (95)..(95): Xaa is any aa, unknown, or other
  misc_feature (101)..(101): Xaa is any aa, unknown, or other
  misc_feature (103)..(103): Xaa is any aa, unknown, or other
MTLTIPDEVRAKAEVYVGDAAGQEKTRLLLQETGLPSGLLPLRDIIECGYVEETGFVWLRQRRKVDHYFAKAGRHVSYGRRGGPAGXEQGPAQEXSRASGXRXCLGCGSPSTRSGRRRPAPTGKLHCRGHPAACPQLSPREGPSKGQEAARGKTPGVVSTGGRGGRASGSAAQSGRE

SEQ ID NO: 33755 - DNA, 629 bp, Zea mays
  misc_feature: Ceres CLONE 1411875-F
  misc_feature (153)..(153): n is a, c, t, g, unknown, or other
  misc_feature (165)..(165): n is a, c, t, g, unknown, or other
  misc_feature (176)..(176): n is a, c, t, g, unknown, or other
  misc_feature (314)..(314): n is a, c, t, g, unknown, or other
ggagctccccgcggtggcggccgctctagaactagtggatcccccgggctgcaggaattcgcacgagaccattacctagaacatcctaatcgaaaagaagaggaaaaaagaaaaaagaaaacaggggagagcccaagcctggagacgaacacngaagaagcaagngagcgaagcangacacgagcgagcccatcccaagttcccaacccacacgaagctgcagcagcaggcagccgcctcgccacgcgcccgagcaacgccgccgagagagccgcccgcccgccggtgagcagcgagggcaattcgtctacggntggtccccgtccggctccggcccgcaaaccccaattgctcccctctcggagtcagctcaattcctgctgttcctcgattcgattcggttgcacggggggggtcggctcccctcgcggagaatccagcagggactaactcgcctggggcccgaggatttggcccttgggcccagggggtttggggggggaaaacccaattggggtccccagggccccgggccccaatggtttgtgtcgggggctggcgggcgcttcccgggagattctccggggggggtgggggggcgccccgcgggtggtaaagaatcccccctg

SEQ ID NO: 33756 - DNA, 722 bp, Zea mays
  misc_feature: Ceres CLONE 1411880-F
  misc_feature: Encodes the peptide sequence at SEQ ID NO. 33757
  misc_feature (437)..(437): n is a, c, t, g, unknown, or other
  misc_feature (438)..(438): n is a, c, t, g, unknown, or other
  misc_feature (453)..(453): n is a, c, t, g, unknown, or other
  misc_feature (467)..(467): n is a, c, t, g, unknown, or other
  misc_feature (468)..(468): n is a, c, t, g, unknown, or other
  misc_feature (529)..(529): n is a, c, t, g, unknown, or other
  misc_feature (654)..(654): n is a, c, t, g, unknown, or other
  misc_feature (701)..(701): n is a, c, t, g, unknown, or other
tggagctccccgcggtggcggccgctctagaactagtggatcccccgggctgcaggaattcgcacgagaccattacctagaacatcctaatcgaaaaacggcgggcgtttgagctgttcgccacctacccctccctccttcctttcatttttctggaagacttcttcggcctcacgcatctcctcctcctcctccaatccaattcacaaacacacacgggcaatcaattagcagaacccgcgccacccccccttcctcggagtcggagcgagtcgaggaacggctcgtctgcctctcccgttctccttcctctcctccccagaagatctgatccatcatcgaggactcgccgggaagaatcaaggatatatagataataaacaaacaaaggttcctccagagcccagaaaggagggaagtcaccggccgtcggcggnngagggagatgtcggnacggcgcgggctcnncggacggggcgtcgcctggcgcgtgggggcctctcggccacccttcgtcgggtggccatcngtcatctgcaacaagtacctcatcagcactctagggcttctttctttgccgacgaacgctgacgagctggcaaccctcatggtgacctttcttcacggcctgaacgtttggcgcaagcggctgcngcttcttcgagcccaaagccgaatcggacggcgcggaccggtcatcntcctttcgccctggctcacgg

SEQ ID NO: 33757 - protein, 92 aa, Zea mays
  misc_feature: Ceres CLONE 1411880-F
  misc_feature (3)..(3): Xaa is any aa, unknown, or other
  misc_feature (8)..(8): Xaa is any aa, unknown, or other
  misc_feature (70)..(70): Xaa is any aa, unknown, or other
  misc_feature (86)..(86): Xaa is any aa, unknown, or other
MSXRRGLXGRGVAWRVGASRPPFVGWPSVICNKYLISTLGLLSLPTNADELATLMVTFLHGLNVWRKRLXLLRAQSRIGRRGPVIXLSPWLT

SEQ ID NO: 33758 - DNA, 737 bp, Zea mays
  misc_feature: Ceres CLONE 1411881-F
  misc_feature: Encodes the peptide sequence at SEQ ID NO. 33759
  misc_feature (536)..(536): n is a, c, t, g, unknown, or other
  misc_feature (651)..(651): n is a, c, t, g, unknown, or other
aaagtggagctccccgcggtggcggccgctctagaactagtggatcccccgggctgcaggaattcgcacgagaccattacctagaacatcctaatcgaaaaaccagctttccccttctctccggtccgggaatcggaagctcagggcagaagccatggggcagacgcatcttttgttgctcgcttgtttctgggtcctgtcaacatgctccttgctacttgatgcttcctccgatggactgttaagaatcaacctgaacaagaagagactggacaaggaagctttgactgctgcgaaattggcgaagaaggagagccaccttcgaaggtctgtgggtgctgaccagtatctcagtgcctcaactgatgacatagtccctttggacaactacctggacacccagtactttggacagatcagcatcggcacgccaccacagaacttcacagtgatattcgacactggaagctccaacttgtgggttccctcatccaagtgctacttttcgatagcgtgctacttacaccacagatacnagtcaaccaagtcgaagacttacacaaagaatggagaatcttgtacgataacatatggttctgggcaaatcgctggcttcttcagtgaggacaatgtgtttggtggtaaccttgntgtgcaaatcagaaattattgagacactcgagaaacagcctacttcttcattgggaagttgatggaatcttggtctcgattcctga

SEQ ID NO: 33759 - protein, 172 aa, Zea mays
  misc_feature: Ceres CLONE 1411881-F
  misc_feature: SWISSPROT Homolog: EC 3.4.23.40 Phytepsin
  misc_feature (128)..(128): Xaa is any aa, unknown, or other
  misc_feature (166)..(166): Xaa is any aa, unknown, or other
MGQTHLLLLACFWVLSTCSLLLDASSDGLLRINLNKKRLDKEALTAAKLAKKESHLRRSVGADQYLSASTDDIVPLDNYLDTQYFGQISIGTPPQNFTVIFDTGSSNLWVPSSKCYFSIACYLHHRYXSTKSKTYTKNGESCTITYGSGQIAGFFSEDNVFGGNLXVQIRNY

SEQ ID NO: 33760 - DNA, 678 bp, Zea mays
  misc_feature: Ceres CLONE 1411883-F
  misc_feature: Encodes the peptide sequence at SEQ ID NO. 33761
  misc_feature (458)..(458): n is a, c, t, g, unknown, or other
  misc_feature (491)..(491): n is a, c, t, g, unknown, or other
  misc_feature (556)..(556): n is a, c, t, g, unknown, or other
  misc_feature (564)..(564): n is a, c, t, g, unknown, or other
  misc_feature (593)..(593): n is a, c, t, g, unknown, or other
  misc_feature (669)..(669): n is a, c, t, g, unknown, or other
  misc_feature (670)..(670): n is a, c, t, g, unknown, or other
aagctggagctccccgcggtggcggccgctctagaactagtggatcccccgggctgcaggaattcgcacgagaccattacctagaacatcctaatcaaaaaaaagcgatgcgcagctccgtaaccacttcgtcctcacttctcagtccaccttcccaccgcaaccacttcaccacctcctcacagtcccagcaatggagctagtagcgtggctcgtcatcgtgtcctcagtatccctcgctgggctcctgccagtggtctcggcgtcgacgacgacaccgcagcagcaatgtggcggcaataatgtcggacctgccggagtgagagcaggctactggtcgccgtcctcgaaccgctactccgcggtcggcagcatcgacgcgtccctgtacacgcacctctactacagcgcggtgaccatcgacgagacgaagctgcgcggtcgcgccgcctccgcgnacggccgaaggcgcctcgctgctcgccgcctcntctggcgcggtcaagtccgcgagcccgtccaccaggaccgtggctgtccgttggcacggacgagntacagggntgggcgagtcgaacgccgcttctccgggnatggcggttcggacgcgggcccttcccgggccgggtgttcatcaaactccctccctggggactggccccgcgccanncggctttc

SEQ ID NO: 33761 - protein, 161 aa, Zea mays
  misc_feature: Ceres CLONE 1411883-F
  misc_feature (89)..(89): Xaa is any aa, unknown, or other
  misc_feature (100)..(100): Xaa is any aa, unknown, or other
  misc_feature (121)..(121): Xaa is any aa, unknown, or other
  misc_feature (124)..(124): Xaa is any aa, unknown, or other
  misc_feature (134)..(134): Xaa is any aa, unknown, or other
  misc_feature (159)..(159): Xaa is any aa, unknown, or other
MELVAWLVIVSSVSLAGLLPVVSASTTTPQQQCGGNNVGPAGVRAGYWSPSSNRYSAVGSIDASLYTHLYYSAVTIDETKLRGRAASAXGRRRLAARRLXWRGQVREPVHQDRGCPLARTXYRXGRVERRFSGXGGSDAGPSRAGCSSNSLPGDWPRAXRL

SEQ ID NO: 33762 - DNA, 675 bp, Zea mays
  misc_feature: Ceres CLONE 1411888-F
  misc_feature: Encodes the peptide sequence at SEQ ID NO. 33763
  misc_feature (291)..(291): n is a, c, t, g, unknown, or other
  misc_feature (325)..(325): n is a, c, t, g, unknown, or other
  misc_feature (390)..(390): n is a, c, t, g, unknown, or other
aagctggagctccccgcggtggcggccgctctagaactagtggatcccccgggctgcaggaattcgcacgagaccattacctagaacatcctaatcgaaaactcctctcgctcgcgtccgcacaaatcccgtgctcccccgtctgaaaaccctccccacctccggcggcggcggcggcgctggcgaccgggtgtcttctccggcgagtctcccccctagtaacaagaaaatatggatgtacctgttgatgaccctgtggagaacctcactgggagtcctagtacccttggncatgaggaagaagccactacttatgctaatgtgncagatcagtccaaggaagaaacagaaaagctttacgaggaacccaaagacccaatggcagacgangtgggtaaccaagggcatgtgagcatgaacaatgaagatgtgggaggccagaacaaagtggaccaagctacccccacagagcacggcgaggaagctggggtgaagcagcatgatgctacagttcctgatgacagaaatggcctggttgcctggaaagagggtggtccgtatacggtttctacaaaaaggggggtgccgtcatgggcggcaaggggatttcttcaagaaatgggggaggatcaaggacccgcatcagggtcttgagggacaccatctgggccaaaa

SEQ ID NO: 33763 - protein, 140 aa, Zea mays
  misc_feature: Ceres CLONE 1411888-F
  misc_feature (32)..(32): Xaa is any aa, unknown, or other
  misc_feature (53)..(53): Xaa is any aa, unknown, or other
MDVPVDDPVENLTGSPSTLGHEEEATTYANVXDQSKEETEKLYEEPKDPMADXVGNQGHVSMNNEDVGGQNKVDQATPTEHGEEAGVKQHDATVPDDRNGLVAWKEGGPYTVSTKRGVPSWAARGFLQEMGEDQGPASGS

SEQ ID NO: 33764 - DNA, 677 bp, Zea mays
  misc_feature: Ceres CLONE 1411889-F
tccccgcggtggcggccgctctacaactagttgatcccccgggctgcaggaattcgcacgagaccattacctagaactcctaatcgaaaaatcaaaaaacaaggggaaaaaacaacacagcatgaactgcttgaagaactcgcgttctgtcctctcgcgactccttcgccacaggccccacgtagccgcgccaccgccgccgacgccggcgacggcgccgcggccaccggcttcacggtactactactacgcctcccgcgtcaagccagccgtctcccgaccgccgccccagttgccgagatctaggcactactacacatccccgcggcggcagcaggtcgtccacttcaaccgccgccgcggcgggtcccggtggtaccacgaccagcggaagctcacggcggcggtcttaatcagcggcggcggggcggtcgcgttctacttcggtcatttggagaccgtgccctacaccaaccgctcccacctcgtcgtcctctcgccgaagttcgagcgccagctcggcgaggcccagtttgcccagctcaagaaggagttcgggcccaagatcctggcaccgctccccctaaagtatccgtgtccgcctcatccgctctaaaataaaacagtcgcgcccgtggtatttactcccctatgtacaacttctccaccggcgccgg

SEQ ID NO: 33765 - DNA, 643 bp, Zea mays
  misc_feature: Ceres CLONE 1411890-F
  misc_feature: Encodes the peptide sequence at SEQ ID NO. 33766
  misc_feature (300)..(300): n is a, c, t, g, unknown, or other
  misc_feature (496)..(496): n is a, c, t, g, unknown, or other
  misc_feature (522)..(522): n is a, c, t, g, unknown, or other
  misc_feature (622)..(622): n is a, c, t, g, unknown, or other
ggagctccccgcggtggcggccgctctagaactagtggatcccccgggctgcaggaattcgcacgagaccattacctagaacatcctatcgaaaagttgtttcgtctccaccgccgctctcctttccagtctccaccaccgctcgtctccccgtaccgcccgcaacccccctcccctgcgagatccggggcgcgatgtggcgcagctgcgtctcgcggggcctctccagggccaaggcctccgcctccaggctcctctccacggcgtcgtcgtcctacacggtggtcgaccacacctacnacgcagtggtggtgggggccggcggcgcggggctccgggcggcgatcggcctctccgagcacggcttcaacaccgcgtgcatcaccaagctcttccccacgcgctcgcacaccgtcgcggttcagggaggcataaatgctgcacttgggaacatgagtgaagatgactggaggtggcatatgcatgacactgttangggaagcgattggctgggtgaccagnattctattcagtatatgtgcagagaggcaccaaaagctgttatagagcttgagaactatggactaccatttttcagaactgagaggggaagatataccancgtgcctttggaggcagagct

SEQ ID NO: 33766 - protein, 149 aa, Zea mays
  misc_feature: Ceres CLONE 1411890-F
  misc_feature: SWISSPROT Homolog: EC 1.3.5.1 Succinate dehydrogenase (ubiquinone)
  misc_feature (36)..(36): Xaa is any aa, unknown, or other
  misc_feature (101)..(101): Xaa is any aa, unknown, or other
  misc_feature (110)..(110): Xaa is any aa, unknown, or other
  misc_feature (143)..(143): Xaa is any aa, unknown, or other
MWRSCVSRGLSRAKASASRLLSTASSSYTVVDHTYXAVVVGAGGAGLRAAIGLSEHGFNTACITKLFPTRSHTVAVQGGINAALGNMSEDDWRWHMHDTVXGSDWLGDQXSIQYMCREAPKAVIELENYGLPFFRTERGRYTXVPLEAE

SEQ ID NO: 33767 - DNA, 677 bp, Zea mays
  misc_feature: Ceres CLONE 1411891-R
tcgaggtcgacggtatcgataagcttttttttttttttttttaaatcactcgaatcaagggttcattaatagcctaaagctgaagaaaatcatcgtcaatgaagaacacagatgtgcatgttaagcatttctagacttacaatgggatggcaaaccccatttcggaaattgggggagggggaagagactaataatgtctttggattggatagctgcaacaatcagagtgagaaaatgggcagagtgcaacgggcattgctaccaaaatgaatcctcaatgtcaatgggatcacatcaggcgttactgattttcaacgccgcattactgtagggcggaccatcacttgcgtgggcgtcctctttttcctctgcccgaggttcctccggctttctgagcaaaactctcggttttcttggggcggctgctgccccttccagatggctttgcctcaggggtcgccttttttgcctcccctgcctctccctctattagcgggattaagggccactcctgccccttttactctttctcccccaccatttttcatcggtctctcgcttttcatcctcattaattgaccactcttccccctttcgggatttccgaattccagaaaaccattcctttccattttgtctttgcccctttggttgggcaaccttagaaattttttttt

SEQ ID NO: 33768 - DNA, 705 bp, Zea mays
  misc_feature: Ceres CLONE 1411894-F
  misc_feature: Encodes the peptide sequence at SEQ ID NO. 33769
  misc_feature (598)..(598): n is a, c, t, g, unknown, or other
  misc_feature (631)..(631): n is a, c, t, g, unknown, or other
  misc_feature (647)..(647): n is a, c, t, g, unknown, or other
aaagctggagctccccgcggtggcggccgctctagaactagtggatcccccgggctgcaggaattcgcacgagaccattacctagaacatcctaatcgaaaaaatcctgccttcggaagccactgctaaccgctttctctgcccttctctacctacataagcgcgagggagcacgcctcccggcctctcctcatccaattcctatgccctgcacccgcagacggggagctcgcgtcttccttcggatggtggatgcatgcatgcatggtagacacgccggcccaaccagaattgacaagtggaagcgtatgggtattaccagcaacgacgcggcccctcgtgccgtcctcctccgcttcttgtttctgctctgcataggctgcaaatgcctggcatcagaggtagaggccacccagacggcgaccctcgcggtggacgcctcgccgcagcttgctcggaagatccctgatacactgttcgggatcttctttgaggagatcaaccatgcaggggctggtggcatatgggctgaacttgttagtaacagagggtttgaagctggaggcctccatactccatcaaacattgacccatggtnccatcattggagacgactccctctgtatttgtnggagaccgatcgcacnttcatgtttcagtcgaaacatcgttgcttcctaaggatggaggtcctttgcgatactg

SEQ ID NO: 33769 - protein, 153 aa, Zea mays
  misc_feature: Ceres CLONE 1411894-F
  misc_feature: SWISSPROT Homolog: EC 3.2.1.55 Alpha-N-arabinofuranosidase
  misc_feature (118)..(118): Xaa is any aa, unknown, or other
  misc_feature (129)..(129): Xaa is any aa, unknown, or other
MVDACMHGRHAGPTRIDKWKRMGITSNDAAPRAVLLRFLFLLCIGCKCLASEVEATQTATLAVDASPQLARKIPDTLFGIFFEEINHAGAGGIWAELVSNRGFEAGGLHTPSNIDPWXHHWRRLPLYLXETDRTFMFQSKHRCFLRMEVLCDT

SEQ ID NO: 33770 - DNA, 556 bp, Zea mays
  misc_feature: Ceres CLONE 1411900-F
  misc_feature (86)..(86): n is a, c, t, g, unknown, or other
  misc_feature (121)..(121): n is a, c, t, g, unknown, or other
  misc_feature (142)..(142): n is a, c, t, g, unknown, or other
  misc_feature (150)..(150): n is a, c, t, g, unknown, or other
  misc_feature (301)..(301): n is a, c, t, g, unknown, or other
  misc_feature (315)..(315): n is a, c, t, g, unknown, or other
  misc_feature (316)..(316): n is a, c, t, g, unknown, or other
  misc_feature (333)..(333): n is a, c, t, g, unknown, or other
aaagctggagctccccgcggtggcggccgctctagaactagtggatcccccgggctgcaggaattcgcacgagaccattacctaangaacatcctaatcgaaaagcgaaacagaagcacgngcaatctccgatctcgttcgnttcccctngagcggcagtcagtggcgagcgagcgcgcacacagacaactcatcctctcccctctctctctcacacacacacattccatcatcccatccctgtgacgggcgatccgagggcctaccgacgatggtgtccgccgtggctccggaccatccntcgtgacgggcggnncgccgggtacatcgggnaggccaaaacggtggcttgcaacttgctgcaaaaaggggtttcccggggtcggttcgtttttaaaaaaaaccttgaaaaaaaggcccccgggggggccgcccctcccccccggggttccccaaaaatttttccgggggaaaaaaaagggggcccaacccctgtgtttttttaaaaaaggtggtgttgcccttgcccgagaggggaccctgggtttgtggggac

SEQ ID NO: 33771 - DNA, 744 bp, Zea mays
  misc_feature: Ceres CLONE 1411902-F
  misc_feature: Encodes the peptide sequence at SEQ ID NO. 33772
  misc_feature (688)..(688): n is a, c, t, g, unknown, or other
  misc_feature (713)..(713): n is a, c, t, g, unknown, or other
aaagctggagctccccgcggtggcggccgctctagaactagtggatcccccgggctgcaggaattcgcacgagaccattacctagaacatcctaatcgaaaaaaaaccgaaaaggaggacaaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgatctccggcgaggtgccggacgagccggtcgtgtcgaagaagtcggggctactcttcgagcggcggctcatcgagcgctacattgaggaccatggcaagtgtcccgccaccaaggaggacctcaccatggatgatatcgtgccggtcaagaccaacacgatcgtgaagcccaggcctttgcaggctgcaagcattccaggactccttgggatttttcagaacgagtgggatgctctcatgctttctaattttgctttggagcagcagcttcacacagcaagacaagaacttagtcatgcactctaccagcatgacgctgcctgccgtgttatagccagattaaagaaaggaagagatgacgctagagcacttttggctcangctgagagaagattcctgcgtcagntgcaggagctgctcctgcagctggtgtttcc

SEQ ID NO: 33772 - protein, 149 aa, Zea mays
  misc_feature: Ceres CLONE 1411902-F
  misc_feature (64)..(133): Pfam Name: Prp19 Pfam Description: Prp19/Pso4-like
  misc_feature (131)..(131): Xaa is any aa, unknown, or other
  misc_feature (140)..(140): Xaa is any aa, unknown, or other
MICAISGEVPDEPVVSKKSGLLFERRLIERYIEDHGKCPATKEDLTMDDIVPVKTNTIVKPRPLQAASIPGLLGIFQNEWDALMLSNFALEQQLHTARQELSHALYQHDAACRVIARLKKGRDDARALLAXAERRFLRQXQELLLQLVF

SEQ ID NO: 33773 - DNA, 734 bp, Zea mays
  misc_feature: Ceres CLONE 1411904-F
  misc_feature: Encodes the peptide sequence at SEQ ID NO. 33774
  misc_feature (471)..(471): n is a, c, t, g, unknown, or other
  misc_feature (501)..(501): n is a, c, t, g, unknown, or other
  misc_feature (734)..(734): n is a, c, t, g, unknown, or other
aagctggagctccccgcggtggcggccgctctatcctagtggatcccccgggctgcaggaattcgcacgagaccattacctagaacatcctaatcgaaaaaagccccccattcccattctaccaccgacccgtcccgtcccactgcctgccagcgtctcccccgctccctctcctcgagagatctcgcgctccggcgatcgggcgcggcgggcggagggtcgcgaagtgccctgcccacccccgatgctcttcccgaagcgcatcaactacgtggccccgatgctcgcctccgccgccatcctgctcctcctcctctcgggctacttcgagctcccctccatctccaccccggcgccgctcctcgcgggcgcagcgcgcttccccaccgcgctcgactccgtcggatcgcgcgaccgcgaccccttcacctcgctcctcgaggccttcgcgtcctgggacgccgccgtcgnctgcccccgcgtctgcgccaagctcgccgncgcggagttggggctggcccccccccccgacccctgcgtcccagtaacaaagtccgcggtccccggtacactatatcaccctacgttacgccacccccaagaccacatcccggcctcgcctgcccatcacgccccgcccctctccccgcacaccacgctattgtctaacgccagtttccccgccccccctacgccgcctcccaccacggttgaacactcacccctctctacan

SEQ ID NO: 33774 - protein, 163 aa, Zea mays
  misc_feature: Ceres CLONE 1411904-F
  misc_feature (76)..(76): Xaa is any aa, unknown, or other
  misc_feature (86)..(86): Xaa is any aa, unknown, or other
MLFPKRINYVAPMLASAAILLLLLSGYFELPSISTPAPLLAGAARFPTALDSVGSRDRDPFTSLLEAFASWDAAVXCPRVCAKLAXAELGLAPPPDPCVPVTKSAVPGTLYHPTLRHPQDHIPASPAHHAPPLSPHTTLLSNASFPAPPTPPPTTVEHSPLST

SEQ ID NO: 33775 - DNA, 738 bp, Zea mays
  misc_feature: Ceres CLONE 1411908-F
  misc_feature: Encodes the peptide sequence at SEQ ID NO. 33776
  misc_feature (495)..(495): n is a, c, t, g, unknown, or other
  misc_feature (511)..(511): n is a, c, t, g, unknown, or other
  misc_feature (555)..(555): n is a, c, t, g, unknown, or other
  misc_feature (629)..(629): n is a, c, t, g, unknown, or other
aaagctggagctccccgcggtggcggccgctctagaactagtggatcccccgggctgcaggaattcgcacgagaccattacctagaacatcctaatcgaaaaagtcggtctctctcactctctcttgtctccaagtttgtaaccctagccgccaagcttgaagctccagccgtgctcgtgtagggccgcaggccatccgggctccggcttccagcatctaccaggcgtccttagaatacggtgcagcgagcagcaagtcgccgagcagccgagccaccgccgaacacagggcgccgccgagcagccgagccgccgccgagcgccgagtcttctctcagtgacttcggtacagacgacaaactttctccacacataccgcgccactccgccactcactgtgctgacggatggggtggtgctccccgtccacttcccggcagcttctctcccacgactcactctttcacttttcgcgcggtctccttacctttcggnatcacctctcctacgntcacatcgagccccagggcgctcgcacgctcgctcggggaccanttcgtccgtgactacctccgccagaagcacgaacagtagcccgcctttctgcgtcccagggtgatgctttgganccggagacgatgggcctggccccatcgaggtcgaaagggaggctgaatcccggagtgggaatgaatgccggcccaaccaaacgaaaaagggggggggtacggttgttga

SEQ ID NO: 33776 - protein, 52 aa, Zea mays
  misc_feature: Ceres CLONE 1411908-F
  misc_feature (30)..(30): Xaa is any aa, unknown, or other
  misc_feature (35)..(35): Xaa is any aa, unknown, or other
  misc_feature (50)..(50): Xaa is any aa, unknown, or other
MGWCSPSTSRQLLSHDSLFHFSRGLLTFRXHLSYXHIEPQGARTLARGPXRP

SEQ ID NO: 33777 - DNA, 681 bp, Zea mays
  misc_feature: Ceres CLONE 1411910-F
  misc_feature (512)..(512): n is a, c, t, g, unknown, or other
  misc_feature (552)..(552): n is a, c, t, g, unknown, or other
agagctggagctccccgcggtggcggccgctctacaactagtggatcccccgggctgcaggaattcgcacgagaccattacctagaacatcctaatcaaaaaactgattgtccacccaccactctacgcaagcaatccttcggacttcggtgggggaaatggaggccgccgccgccgccgagacggggctcgcccagaaaccggttgtgctgtacccttcgccggggatgggccacctggtctccatgatcgagcttggcaagatcctcggcgcgcggggactgtccgtaataattgtcgtcgtcgagcctcccttcaacacgggcgctacgtcgccttttcctcgccggcgtctccgcggccaacccgtccatctccttccaccgcctgcccaaagtcgagcgcctcccgcccgtcaagaccaagcaccagggaggcgtcaacctttcgaggtcacccgcgtctccaacccgcaccttccgcgagtttctggtccgcggcgtccccagccngggttcggcgtcgaacttcttctgcagcatcgcccctggnacggggcgggaagaacttccccgggggcccgccctaatttcttttttccctcggggggggcgaggggccttgggctttttttcgggaaccctcccggggaaccccagaaggggacccgccccgagattt

SEQ ID NO: 33778 - DNA, 679 bp, Zea mays
  misc_feature: Ceres CLONE 1411911-F
  misc_feature: Encodes the peptide sequence at SEQ ID NO. 33779
  misc_feature (209)..(209): n is a, c, t, g, unknown, or other
  misc_feature (282)..(282): n is a, c, t, g, unknown, or other
  misc_feature (285)..(285): n is a, c, t, g, unknown, or other
  misc_feature (386)..(386): n is a, c, t, g, unknown, or other
  misc_feature (569)..(569): n is a, c, t, g, unknown, or other
  misc_feature (576)..(576): n is a, c, t, g, unknown, or other
acccgcggtggcggccgctctagaactagtggatcccccgggctgcaggaattcgcacgagaccattacctagaacatcctaatcaaaaaactacaatactgctgcgcgctagcggtagcgctcgcactcgcaccacgccaccgctgctgcctgctcctcacagtcctccccgcgctcgcattgcgattcgcgacctagcgcgagggtnaccgggggggtggtgcgcgcgcgtgctcggtgatccgggaagcgccgcgagatggccgggggttgaaaggcgncgntgccgcgccgaagcacgacgacttcacgccgcaccccgtcaaggaccagctccctggggtctcctactgcatcaccagccctcccccgtggcctgaagccngttcttcttgggttccaacattatctggtcatgcttggtaccactgtgatcataccaactgcacttgttccacaaatgggaggaaacaatgaggacaaagcagtggttatcaagacattgctggttcgttgcaggtatcaacaccctcctgcagagtttctttggtaccatgttgcctgcagntgatcgncgggtcatacacctttgttctgcctaccatttcgatcatccttggctggacgttatgctaatgaacctaatccacatattaaatttctccgcatcatgcgtgg

SEQ ID NO: 33779 - protein, 50 aa, Zea mays
  misc_feature: Ceres CLONE 1411911-F
MLGTTVIIPTALVPQMGGNNEDKAVVIKTLLVRCRYQHPPAEFLWYHVAC

SEQ ID NO: 33780 - DNA, 660 bp, Zea mays
  misc_feature: Ceres CLONE 1411912-F
  misc_feature: Encodes the peptide sequence at SEQ ID NO. 33781
  misc_feature (287)..(287): n is a, c, t, g, unknown, or other
  misc_feature (293)..(293): n is a, c, t, g, unknown, or other
aaagctggagctccccgcggtggcggccgctctagaactagtggatcccccgggctgcaggaattcgcacgagaccattacctagaacatcctaatcgaaaagaaccctctcgcgcttggcttgctttcactctccagggccccactcccacctcgccgccgcagccatggcgatcacagcgccaactcccgacatcctcggcgagcgccagtccggccaggacgtccgcacgcagaacgtgatggcttggcgaggcgtggccaacatcgtcaaatcctcgctcggnccccgntggtcttcgacagatgctagtggacgatattggtgatggtaccatcactaatggtgggagaaccatacttaagatggtgggagttgagcatcccggcggccaaggtcctggttgagttggtgaggtccaagaacgggagggaagagaagggaacaacttccgggtggctcaaaagggcgaaggttcctccaaaagggggatgggttttttgggaaaaaaaaaatccctcccccccctctatatccacggggtacaagggtttggtaagccgggaaaccctgcaaaaaaagggtagggaaaaatttaaacagcccaggggttacaaaacattgggaaaaaaaaatcctttaaacaacctctggggaaa

SEQ ID NO: 33781 - protein, 53 aa, Zea mays
  misc_feature: Ceres CLONE 1411912-F
MAITAPTPDILGERQSGQDVRTQNVMAWRGVANIVKSSLGPRWSSTDASGRYW

SEQ ID NO: 33782 - DNA, 677 bp, Zea mays
  misc_feature: Ceres CLONE 1411916-F
  misc_feature: Encodes the peptide sequence at SEQ ID NO. 33783
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
gctctagaactagtggatcccccgggctgcaggaattcgcacgagaccattacctacaacatcttaatccaaaaatttttcaaacgccgccgaccccagtccgcgatccgaagctgtgcctcataccatttccatccaaaggtgcccaggctgaatttgacaacttccatgaagggcgcttcaagaactcacacgtaccagcgccgagatctgtggttcatctgggccaaaaacggaggacccttccccaaaggcgaccaggccgttgtcgtcgggtaacccaagatctactcagccgatcatcctgagcccagcgatttcagcatacgcaagcactaaacctaccatgatcacagtcgagcatgcacgcctgatatgtctgatgatcctcctcgcatagagattcatgcacatatacagcgctgtcatctccacttatcgtaactagtctggtccttatatgctggcactgcgagatcaattgacccccctggaatccccccccccgtgggaaaaaaaaaaaaaccgcgggggggttttttttttttttttttttttttccctctagggggggggaggttctcttttttttttttttttttttttggtgtgggtgggnnnnnnnngnnnngggggggggggggggggggagaaaaaaaaaaaaaattctatttttt

SEQ ID NO: 33783 - protein, 36 aa, Zea mays
  misc_feature: Ceres CLONE 1411916-F
MKGASRTHTYQRRDLWFIWAKNGGPFPKGDQAVVVG

SEQ ID NO: 33784 - DNA, 754 bp, Zea mays
  misc_feature: Ceres CLONE 1411922-F
  misc_feature: Encodes the peptide sequence at SEQ ID NO. 33785
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (638)..(638): n is a, c, t, g, unknown, or other
  misc_feature (660)..(660): n is a, c, t, g, unknown, or other
  misc_feature (661)..(661): n is a, c, t, g, unknown, or other
  misc_feature (723)..(723): n is a, c, t, g, unknown, or other
aagctggagctccccgcggtggcggccgctctagaactagtggatcccccgggctgcaggaattcgcacgagaccattacctagaacatcctaatcgaaaagcattgcattgcataaacctctcgtgggaagtgcaaacaccaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggcaccgtccccttctacccgtccgcggagtccgccgccgccgcgcactgcgacggcacgctgtacccggagctctgcctgtcgacactcgcggacatcccggacctacacaagaagccgctcccggacgtcatctgcgcggccgtgaaccgcaccgaggacgtggtggtcgccacgtccagcaactgctcgtactacctgcaggacaggtccctggtcggcgcgggaccgcctggccatcaacgactgcctgggagctgctgtccaccacgatggacgagctccgcgccagcaccgccgacctggcgtccccgnnncgncagggggtcgggcgtcggcggnncgtgtcgcagggcgccaggcgcgcgacgatgggagcacgtgatgacggtggctttcggcggncatcaccaaccagtacccctgcctcgaacgg

SEQ ID NO: 33785 - protein, 172 aa, Zea mays
  misc_feature: Ceres CLONE 1411922-F
  misc_feature (133)..(133): Xaa is any aa, unknown, or other
  misc_feature (134)..(134): Xaa is any aa, unknown, or other
  misc_feature (142)..(142): Xaa is any aa, unknown, or other
MPPIPKRGEHLLVLLIVACAATAATAAGTVPFYPSAESAAAAHCDGTLYPELCLSTLADIPDLHKKPLPDVICAAVNRTEDVVVATSSNCSYYLQDRSLVGAGPPGHQRLPGSCCPPRWTSSAPAPPTWRPRXXRGSGVGGXCRRAPGARRWEHVMTVAFGGHHQPVPLPRT

SEQ ID NO: 33786 - DNA, 701 bp, Zea mays
  misc_feature: Ceres CLONE 1411923-F
  misc_feature: Encodes the peptide sequence at SEQ ID NO. 33787
aaagctggagctccccgcggtggcggccgctctagaactagtggatcccccgggctgcaggaattcgcacgagaccattacctagaacatcctaatcgaaaaaatgaccattgcgtgatagatcgcaccggtctcggtctccgtgtctcactctcaagttgcagcagccagtcatttcgttggcaaccagggcagaaataaatatccgtggataagagctgcgctgtgtgctgctgagatatcaagaacggtagggtggaagacaaggccccgttctcgattaacccaagccaaagagtcagagggagagagagagagagagtcgtattggtcgtcacctgtcgaaggttttcggtgtctcctgagccacagctgctgctgctgctggaaccatggagatggaggccgtggagtcgcacggcggcgccggtcgccggacgcccaagagggatcgcggcatctcctgggcctgcgtcttcatcctggcgagtaactgcttccagttcatcgcctacttcgccgtgtcgacgaacctggtgaactacctcaaggaccgcctgcaccagggcagcaaagccgccgcgaacggcgtcaccaactggatgggcacgagcgccatcacgccgctcgtcgccgccttcctcgccgacgccttcctcggcagatactggaccatcgcgctcttcctggtcatctccgtc

SEQ ID NO: 33787 - protein, 103 aa, Zea mays
  misc_feature: Ceres CLONE 1411923-F
MEMEAVESHGGAGRRTPKRDRGISWACVFILASNCFQFIAYFAVSTNLVNYLKDRLHQGSKAAANGVTNWMGTSAITPLVAAFLADAFLGRYWTIALFLVISV

SEQ ID NO: 33788 - DNA, 668 bp, Zea mays
  misc_feature: Ceres CLONE 1411928-F
  misc_feature: Translation starting site: 137
  misc_feature: Pfam Name: SRP19 Pfam Description: SRP19 protein
  misc_feature (565)..(565): n is a, c, t, g, unknown, or other
  misc_feature (596)..(596): n is a, c, t, g, unknown, or other
  misc_feature (660)..(660): n is a, c, t, g, unknown, or other
gctctagaactagtggatcccccgggctgcaggaattcgcacgagaccattacctagaacatcctaatcgaaaagtctcttttccagttccagacctgaagaaactccgaccggtggcggcaggatctgtgccgcgatggcgacgtcgaacaccgctcggatggaggacggcggcggtgacctgcggagcaccatcaagaagtggaacatcatctaccctgtctacctcaactccaagaagacggtcgccgagggccgccgcatcgccgctgccaaggcctgcccggaccccacctgcatcgagatcgctgactgctgttcgcacctcaagatcccccacgccatcgagttggataaggcgtaccctcgggatttcttccaggtggggagggtcagggtgcagcttaagaaagatgacggctcccccgtcaatcctgctattaaaacaaagaagcagctgatgatccaagtagcagagctagttccccagcatcacggaaggacaaagaagcaagagttcaatttgaggaaccctcatccttccactatgatttgcttctcttangcttcctgacgtttatgtgtggccttattgntatccctccatcaaatggtgtcattccccacatcaccatgcacacgaagagtttggctactctncagcatca

SEQ ID NO: 33789 - DNA, 593 bp, Zea mays
  misc_feature: Ceres CLONE 1411933-F
  misc_feature (365)..(365): n is a, c, t, g, unknown, or other
  misc_feature (366)..(366): n is a, c, t, g, unknown, or other
  misc_feature (386)..(386): n is a, c, t, g, unknown, or other
  misc_feature (390)..(390): n is a, c, t, g, unknown, or other
  misc_feature (396)..(396): n is a, c, t, g, unknown, or other
  misc_feature (401)..(401): n is a, c, t, g, unknown, or other
aaagctggagctccccgcggtggcggccgctctacaactagtggatcccccgggctgcaggaattcgcacgagaccattacctagaacatcctaatcgaaaaaaaaaataaaaaaattgggtgtttacaacgaattttaggtcttggccccttgggctcttggtccaagcgattttttttctgtgggccgttgggtccgtggaacatatccgttgcagaagactacagattgcagaagcgctcgctcgctgttgttgctgctgccaactgaagggatgcgagccacggccaccgcaggaggccgtgcggtgttccacctccaacacctctgcccgcgcccgccatggcgagctcttcctcctggnntgcacacgcactctcccggntcgngccagngaggngagccgaccaccgttgcctccccaaggtttcttatcaactttagaaccgaggattcaggaggctcttggggcggcgggctcctgcaacgtgagctattctttggatgacagttaccggaaaaggtaatgttcccggggaaaaaggggaaggtagaaacggtgggggggttcaaaaaaaccagggggagggcg

SEQ ID NO: 33790 - DNA, 666 bp, Zea mays
  misc_feature: Ceres CLONE 1411935-F
  misc_feature: Encodes the peptide sequence at SEQ ID NO. 33791
  misc_feature (428)..(428): n is a, c, t, g, unknown, or other
  misc_feature (434)..(434): n is a, c, t, g, unknown, or other
  misc_feature (435)..(435): n is a, c, t, g, unknown, or other
  misc_feature (441)..(441): n is a, c, t, g, unknown, or other
  misc_feature (455)..(455): n is a, c, t, g, unknown, or other
  misc_feature (456)..(456): n is a, c, t, g, unknown, or other
  misc_feature (508)..(508): n is a, c, t, g, unknown, or other
  misc_feature (509)..(509): n is a, c, t, g, unknown, or other
  misc_feature (520)..(520): n is a, c, t, g, unknown, or other
  misc_feature (535)..(535): n is a, c, t, g, unknown, or other
  misc_feature (538)..(538): n is a, c, t, g, unknown, or other
  misc_feature (542)..(542): n is a, c, t, g, unknown, or other
  misc_feature (546)..(546): n is a, c, t, g, unknown, or other
  misc_feature (564)..(564): n is a, c, t, g, unknown, or other
tggagctccccgcggtggcggccgctctagaactagtggatcccccgggctgcaggaattcgcacgagaccattacctagaacatcctaatcgaaaaacagcgaaccacccatggccctcgccaccactgccgtctccctccaccttttcctcacccggcccgcctccgtgctccgcgtaggccgcggcctcccatgcctcctcctccgagccacttcgtccacctccgcctccccggacttcaacatcaccttcgcggagcccgcgccgtccaaaaaggccccgtccgcgcagccgctggtcccgtggatcgtccgcggggaggacgagaagccccgcctcagcacctccccgccgccggacgtaatccaggccatcgcgctcgcggatgcggaggccaagaaggccgtccagaatgaaaccctcangggcannaatggncgcagtgcccgcgnncgcgcggttgcttccaatgccagcgtcaagggcaaggaaaggaagcccgccnncgaccgtgcgnccaaagtctccaggnagncagnaggnttttacatgagatatcanggaacgggagccgcacgggtcgccaggtcctggccgcgcaggagtgcatccagaggaccagggaagagtcacttccaaggaaggggatggcaaaagggtcaa

SEQ ID NO: 33791 - protein, 185 aa, Zea mays
  misc_feature: Ceres CLONE 1411935-F
  misc_feature (106)..(106): Xaa is any aa, unknown, or other
  misc_feature (108)..(108): Xaa is any aa, unknown, or other
  misc_feature (115)..(115): Xaa is any aa, unknown, or other
  misc_feature (133)..(133): Xaa is any aa, unknown, or other
  misc_feature (137)..(137): Xaa is any aa, unknown, or other
  misc_feature (142)..(142): Xaa is any aa, unknown, or other
  misc_feature (143)..(143): Xaa is any aa, unknown, or other
  misc_feature (144)..(144): Xaa is any aa, unknown, or other
  misc_feature (151)..(151): Xaa is any aa, unknown, or other
MALATTAVSLHLFLTRPASVLRVGRGLPCLLLRATSSTSASPDFNITFAEPAPSKKAPSAQPLVPWIVRGEDEKPRLSTSPPPDVIQAIALADAEAKKAVQNETLXGXNGRSARXRAVASNASVKGKERKPAXDRAXKVSRXXXGFYMRYXGTGAARVARSWPRRSASRGPGKSHFQGRGWQKGQ

SEQ ID NO: 33792 - DNA, 672 bp, Zea mays
  misc_feature: Ceres CLONE 1411938-F
  misc_feature (450)..(450): n is a, c, t, g, unknown, or other
  misc_feature (462)..(462): n is a, c, t, g, unknown, or other
  misc_feature (472)..(472): n is a, c, t, g, unknown, or other
aaagctggagctccccgcggtggcggccgctctagaactagtggatcccccgggctgcaggaattcgcacgagaccattacctagaacatcctaatcgaaaacccaagggtcggttaggtctaggtgttctccaagctttccgcctttccacgccaccattctccccacccgtgcgcctcatgaatccacatccagcatcgccgtttcgccgcgggaccgacacctcgccgggcatgggcgcgtcgctcctcgactggcaacccgtccccagaggcacacgagcagcgggagcaggagactctcgcctccgccggcctctccctcccgctcctccgcgccgccttctcccgctccgccgccaacgcgactgccggatgccctcgcgccgccgcccgcctcctttcgtctgcccggatccccggcgccgccgccgccgcacttcccggaantcctcggggggntcgagcccgncatcgcctcccaattcttcggacacggaagctgccgaggtgaaggacgtcttcccccggaaggggtccgattgatcagggggtttcaaccgctggagtggccccctcgactggctactcgatcggtttgaaatggttcctccgggggaaaggcttaacgacagatgtcgtttcggcaaaataccctgggtgggttcatat

SEQ ID NO: 33793 - DNA, 687 bp, Zea mays
  misc_feature: Ceres CLONE 1411939-F
  misc_feature: Encodes the peptide sequence at SEQ ID NO. 33794
tccccgcggtggcggccgctctagaactagtggatcccccgggctgcaggaattcgcacgagaccattacctagaacatcctaatcgaaaaacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggttagtggggtttattcggatgataataaccttcagcttgaggccaccacacagttccgcaaattgctctctatagagaggagtccccccatcgaagaagttatcaaaacaggtgtagttccaagatttgtgcagtctctcaccagagaggatttcccccagctgcagtttgaagctgcatgggctctcacaaatattgcttctggcacttcaaa

SEQ ID NO: 33794 - protein, 145 aa, Zea mays
  misc_feature: Ceres CLONE 1411939-F
  misc_feature (4)..(92): Pfam Name: IBB Pfam Description: Importin beta binding domain
  misc_feature (101)..(142): Pfam Name: Arm Pfam Description: Armadillo/beta-catenin-like repeat
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPIEEVIKTGVVPRFVQSLTREDFPQLQFEAAWALTNIASGTS

SEQ ID NO: 33795 - DNA, 679 bp, Zea mays
  misc_feature: Ceres CLONE 1411940-F
  misc_feature: Encodes the peptide sequence at SEQ ID NO. 33796
  misc_feature (519)..(519): n is a, c, t, g, unknown, or other
  misc_feature (520)..(520): n is a, c, t, g, unknown, or other
  misc_feature (526)..(526): n is a, c, t, g, unknown, or other
  misc_feature (527)..(527): n is a, c, t, g, unknown, or other
  misc_feature (642)..(642): n is a, c, t, g, unknown, or other
aagctggagctccccgcggtggcggccgctctagaactagtggatcccccgggctgcaggaattcgcacgagaccattacctagaacatcctaatcgaaaaagctaggttcctatgcccaaagtcacacagcttcttctccttctacttctccttcctcctctcctcaccggcaccttgatctaatctcttccatcctagcttgctcgccgctgccagtctctcctccgcctgcaacgactcccatgtctcagtcttctcctctcttctccgtcgcccgagcgcacgccggagcaggagggcgagccgtggcagccgctctcctgctccgtcgtcgccccattgcacagctgccgcacagcatccatggcctacggtgtctctctccagccagagcgacaccttccaagacgctcctcagcctcccccgcgccacgctgtcctccttcgccgaccccgacggcgacggcggctccagcgcgaaagccagcgacggcggcgccaaaggcggcgccgtcgnngagtanncagtccgggaatgcgagatgtcggagatggccagggccgttcacatcctcgcacgggtgggggacgtccatctccctgaacaatcgcggtcgccgccctcaccgtgcccgctggnaatgcgctcgctggtctgccacggaaccctcaagaag

SEQ ID NO: 33796 - protein, 145 aa, Zea mays
  misc_feature: Ceres CLONE 1411940-F
  misc_feature (92)..(92): Xaa is any aa, unknown, or other
  misc_feature (94)..(94): Xaa is any aa, unknown, or other
  misc_feature (95)..(95): Xaa is any aa, unknown, or other
  misc_feature (133)..(133): Xaa is any aa, unknown, or other
MSQSSPLFSVARAHAGAGGRAVAAALLLRRRPIAQLPHSIHGLRCLSPARATPSKTLLSLPRATLSSFADPDGDGGSSAKASDGGAKGGAVXEXXVRECEMSEMARAVHILARVGDVHLPEQSRSPPSPCPLXMRSLVCHGTLKK

SEQ ID NO: 33797 - DNA, 725 bp, Zea mays
  misc_feature: Ceres CLONE 1411942-F
  misc_feature: Encodes the peptide sequence at SEQ ID NO. 33798
  misc_feature (566)..(566): n is a, c, t, g, unknown, or other
  misc_feature (573)..(573): n is a, c, t, g, unknown, or other
  misc_feature (574)..(574): n is a, c, t, g, unknown, or other
  misc_feature (603)..(603): n is a, c, t, g, unknown, or other
  misc_feature (616)..(616): n is a, c, t, g, unknown, or other
  misc_feature (617)..(617): n is a, c, t, g, unknown, or other
  misc_feature (710)..(710): n is a, c, t, g, unknown, or other
cgctcttgaactagtggatcccccgggctgcaggaattcgcacgagaccattacctagaacatcctattgaaaaaaaccctaacaacgcatttcgctccccacagcggctcggccacaacccacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacaagctccgccaggttgctgtgtgaagtccaaggttgtcacatggattcagcacaagatttccaacccaggacattctctataaagttgtggccaccaactgaaagcacacggatcatgcttgttgacaggatgacaaacaatctgtccacagagtccattttctctcgcaaatatcgccttttgggaaagcaagaggctcatgagaatgcaaaaacgattgaagaactttgctttgccttggctgatgagcatttcagagaggagcagatggntgatggnnagttctgctgtccagctatatgcaaaggnacgagcaaagggnnttgttgggagttctgaaaaaagggcccaggactactgcagaactggaggcacctgtagctgacacacctcttgtgtctgctgaactgactaanatatatctgggtgca

SEQ ID NO: 33798 - protein, 99 aa, Zea mays
  misc_feature: Ceres CLONE 1411942-F
  misc_feature (78)..(78): Xaa is any aa, unknown, or other
  misc_feature (81)..(81): Xaa is any aa, unknown, or other
  misc_feature (95)..(95): Xaa is any aa, unknown, or other
MDSAQDFQPRTFSIKLWPPTESTRIMLVDRMTNNLSTESIFSRKYRLLGKQEAHENAKTIEELCFALADEHFREEQMXDGXFCCPAICKGTSKGXCWEF

SEQ ID NO: 33799 - DNA, 753 bp, Zea mays
  misc_feature: Ceres CLONE 1411948-F
  misc_feature: Encodes the peptide sequence at SEQ ID NO. 33800
  misc_feature (529)..(529): n is a, c, t, g, unknown, or other
  misc_feature (539)..(539): n is a, c, t, g, unknown, or other
  misc_feature (629)..(629): n is a, c, t, g, unknown, or other
  misc_feature (630)..(630): n is a, c, t, g, unknown, or other
  misc_feature (641)..(641): n is a, c, t, g, unknown, or other
aaagctggagctccccgcggtggcggccgctctagaactagtggatcccccgggctgcaggaattcgcacgagaccattacctagaacatcctaatcgaaaaatcattcctctcgagtagtcgatcggagtcaggagatgggcgcgtctggtggtgaaaagcttggtactcttgtgtgtgttcttgcacatgtatcgttattattggtgctcgtgctagcaccgtgtgtgtgcaaggcgactggtggtgactacggcggcctctccaacgaccactacaccgagtcctgcccggagctggagaccatcgtcaagaagtccctggcgccgatcttcgccgtggacatcacctcgccggccgccctcctccgcctgctcttccacgactgccaagtccacggatgtgacggctccatattgctcaactccgacgagcgccggcacataacctcggaactgggctcacgcaagaacctcgggatccggcacgtcggcaccgtcgggctcgtgaaggcggccgtggaagcggnctgccctggncgggtctcctgcgccgacatcgtcgtcctgggcgcgagggaagccgtggcgcacaccggcggcccgcgcgtcgccagcgtgcctcttggnncggaaggacgncacgactaccagcacgcaggcccgcgatgcgcagcttccgccctgttttctcgggatcgacggggcgctcgacatctttaccagcccgcgcatgaccgtcgaagagacagtc

SEQ ID NO: 33800 - protein, 205 aa, Zea mays
  misc_feature: Ceres CLONE 1411948-F
  misc_feature (58)..(205): Pfam Name: peroxidase Pfam Description: Peroxidase
  misc_feature: SWISSPROT Homolog: EC 1.11.1.7 Peroxidase
  misc_feature (131)..(131): Xaa is any aa, unknown, or other
  misc_feature (165)..(165): Xaa is any aa, unknown, or other
MGASGGEKLGTLVCVLAHVSLLLVLVLAPCVCKATGGDYGGLSNDHYTESCPELETIVKKSLAPIFAVDITSPAALLRLLFHDCQVHGCDGSILLNSDERRHITSELGSRKNLGIRHVGTVGLVKAAVEAXCPGRVSCADIVVLGAREAVAHTGGPRVASVPLGXEGRHDYQHAGPRCAASALFSRDRRGARHLYQPAHDRRRDS

SEQ ID NO: 33801 - DNA, 759 bp, Zea mays
  misc_feature: Ceres CLONE 1411951-F
  misc_feature: Encodes the peptide sequence at SEQ ID NO. 33802
  misc_feature (449)..(449): n is a, c, t, g, unknown, or other
  misc_feature (450)..(450): n is a, c, t, g, unknown, or other
  misc_feature (494)..(494): n is a, c, t, g, unknown, or other
  misc_feature (538)..(538): n is a, c, t, g, unknown, or other
aaagctggagctccccgcggtggcggccgctctagaactagtggatcccccgggctgcaggaattcgcacgagaccattacctagaacatcttaatcgaaaaataaactagacgagaagagagagagagggagagaggggaaagttgattctctctctgacccgcccactccctccttccctgctccggtcgcactccgtcgttcctccgcgcacgtacgtacagcagccagacacgagatcgagtggtacagggcccgccagaaacctcacgagctagctggttcctgatcggcggcctgtgccgcgcgccgatccacgcatggcgccgccgctcctgcccgcgcgcttcgtcgccgcctccgtcgcgctgctcgccgtcgccttctcctcctctctaacgcgtccgtcaggtgcatacgatccgctcgatccgaacggggacataanncatcagtgggacgtgatacagtggactgcggatggctatgtggncgtcgtttcgctatacaactaccagcaagtacgccacatccagncgcccgggtgggagctaggctgggtgtgggcgaaaaaaggaagtgattctgggcgatgacccgcgggcaggccaccgaagcaggcggactggctccgggttaaggccaggggcctccccactgggtgaagaggggaccccgggagggggggggaccgggtggccgggatctcccacaaaaggaaaaccgcattggttgtaggggaaagaaagggccccctc

SEQ ID NO: 33802 - protein, 91 aa, Zea mays
  misc_feature: Ceres CLONE 1411951-F
  misc_feature (43)..(43): Xaa is any aa, unknown, or other
  misc_feature (58)..(58): Xaa is any aa, unknown, or other
  misc_feature (73)..(73): Xaa is any aa, unknown, or other
MAPPLLPARFVAASVALLAVAFSSSLTRPSGAYDPLDPNGDIXHQWDVIQWTADGYVXVVSLYNYQQVRHIQXPGWELGWVWAKKGSDSGR

SEQ ID NO: 33803 - DNA, 676 bp, Zea mays
  misc_feature: Ceres CLONE 1411952-F
  misc_feature (232)..(232): n is a, c, t, g, unknown, or other
  misc_feature (266)..(266): n is a, c, t, g, unknown, or other
tccccgcggtggcggccgctctagaactagtggatcccccgggctgcaggaattcgcacgagaccattacctaaacatcctaatcgaaaaaccaacccttgtagtctcagtcaatctgtagattgagactacgatgagcctgtcaccgctcgactcctcctccccgccggccgcggctgcggctgcttgctacggaggtgcccctcgccccgggcttccgcttccaccccancgacgaggagctcgtctcctacaacctccggcgncgcgttctcgggcggcggctccgcgtcgaacgcattggcgagatcgacctccaccgcctcgaggcctgggaacttcccctccttttccggatccgaaagcggaagggccaggggtaatttttttgcccgttttaaacgaaaggtccccggggtgggggcccggggcccgggggggtccccggaaaaaggagcaacccgggctttccccagggggggtttgggaaaacccccggcaaggggccccgagggggacccccccggggaagcccccccgggaaaaaaaaaaaacctctcccttcccccccggggggggggccttaaggggggagggagccccctgggtggtgggagaagaaacccccctcccctagggagaggggaccccccagattgtggggggggggttaaaa

SEQ ID NO: 33804 - DNA, 779 bp, Zea mays
  misc_feature: Ceres CLONE 1411953-F
  misc_feature: Encodes the peptide sequence at SEQ ID NO. 33805
  misc_feature (17)..(17): n is a, c, t, g, unknown, or other
  misc_feature (20)..(20): n is a, c, t, g, unknown, or other
ccccccaatttttccanccntatcgggggttttactcctccttcctccccccgctggagctccccgcggtggcggccgctctagaactagtggatcccccgggctgcaggaattcgcacgagaccattacctagaacatcctaatcgaaaaactaggaaaaacctagacacgaagtccaacccaaatctcaatatcccaaccctccgatccccatttccatccactccgacaccaatcctccgctccgaccaccgccggagaaatggggcggcgccgccggttcgcgcagctggacgatgacgacgacgacgacgaagacgtgcccatcaatttcaagccctcgggtggcgcctcctcctcggacgccaaacccaggaagccccagccgccgccgcagcagcgccgcggagtctccgatgacgacgacgaggacgtggaggaagtggaactttgaggaggaggaggacgaccagaaggatctcgaggcaatgcgacgggccgaggaggaggagggccgcgagcagaaggccgagacggagactcgccgcggcgggggacggtccaaggcgccgccgcgacccggggaagcgaggatgagggagcccgaagcagctataagctggaaaaaggaagggacccccggggagaggagaagatccacgggaggcgggtggcccggaagcctgtcagggggacaccggtccaagatcaccctggctaaaggggggaatgaaagaggaaaggaaacccacctatgcggttgcctttcgaaaggacc

SEQ ID NO: 33805 - protein, 120 aa, Zea mays
  misc_feature: Ceres CLONE 1411953-F
MTTTRTWRKWNFEEEEDDQKDLEAMRRAEEEEGREQKAETETRRGGGRSKAPPRPGEARMREPEAAISWKKEGTPGERRRSTGGGWPGSLSGGHRSKITLAKGGNERGKETHLCGCLSKG

SEQ ID NO: 33806 - DNA, 719 bp, Zea mays
  misc_feature: Ceres CLONE 1411954-F
  misc_feature: Encodes the peptide sequence at SEQ ID NO. 33807
  misc_feature (522)..(522): n is a, c, t, g, unknown, or other
aaagctggagctccccgcggtggcggccgctctagaactagtggatcccccgggctgcaggaattcgcacgagaccattacctagaacatcctaatcgaaaaatgcagattcccaagtggagttgcggcggctggttatcatttatcatcaccttcgcctcacaccttccggccgcccattccgatccgatccccggccggccacctaccaccggtcagccccatcaatctctgaggcagcgtcagccatcaggcctccctcgtcgatctccccgccgccgccgctgctaataccagataatggaggccggcgccgccgctgctgccactgccatctaccctctgcaccatgcaaaaccatacacctggtgaggcatgcccaaggtgtccacaacgtggaaggcgacacggatcacagcgcctacatgaaacccgacttcttcgacgcgagcatcactcccttgggctggaaccaggttgacctcctgcgagagcatgtgaaggaatctgggcttgcagaanagattgagctggttatttgttctcctttgtcgagaccatgcagactgcagtggggagtttttgttggcgaagctgcagtaatggggtgtgagtgtgctccactgatggtgagaaatgctgaaacgtccggaagtttcaagttttgactgcccaccatttctttgctgttgaggcctgcaggaaaacccctttgggtg

SEQ ID NO: 33807 - protein, 80 aa, Zea mays
  misc_feature: Ceres CLONE 1411954-F
  misc_feature (33)..(33): Xaa is any aa, unknown, or other
MKPDFFDASITPLGWNQVDLLREHVKESGLAEXIELVICSPLSRPCRLQWGVFVGEAAVMGCECAPLMVRNAETSGSFKF

SEQ ID NO: 33808 - DNA, 744 bp, Zea mays
  misc_feature: Ceres CLONE 1411955-F
  misc_feature: Encodes the peptide sequence at SEQ ID NO. 33809
cgcggtggcggccgctctagaactagtggatcccccgggctgcaggaattcgcacgagaccattacctagaacatcctaatcaaaacctttcgggcagaaagagccagagagagagagagagagaggtcgtcgctggagagcacacacccatcacccatggcctgactgacctccggactctccctgcttccgtcgccgccgcggaccgcccaagtgactgctcctgccctccgcccgccctccattgcgtccgtcaagctcggctccaagcctgacgccttcaagcggcaaggccaggcatggttctgcacaacaggacttcctagcgatgtcaccgttgaggttggggatatgtctttccaccttcacaagttccctttactttcaaaaagtgcctttcttgaacggtcaattgaagaaaattctgaccaagaagaatgcatcatcaaactaaatgacattcctgggggtgccaagtcatttgagctagttgcaaggttctatggtgtgaaaatagagctttcacctgcaaatgttgtctacctacggtgtgcctcagagcatctagaaaggactgaagaagtacctgaggaaaacctgattgcacaggcacaaattgtccttaacccaaggggttctccgaaaatggaaaaattcctttggcaacattggaaaacatgtgaagaactactcccccatggttgaaaacctcccaaattggggaacagaaggcatcaattcat

SEQ ID NO: 33809 - protein, 117 aa, Zea mays
  misc_feature: Ceres CLONE 1411955-F
MSFHLHKFPLLSKSAFLERSIEENSDQEECIIKLNDIPGGAKSFELVARFYGVKIELSPANVVYLRCASEHLERTEEVPEENLIAQAQIVLNPRGSPKMEKFLWQHWKTCEELLPHG

SEQ ID NO: 33810 - DNA, 693 bp, Zea mays
  misc_feature: Ceres CLONE 1411961-F
  misc_feature: Encodes the peptide sequence at SEQ ID NO. 33811
cgctctagaactagtgggtcccccgggctgcaggaattcgcacgagaccattacctagaacatcctaatcgaaaacgagccagtggtactggccgcgacggagcggtcagaagctgcggcggccggcgcggtttcggtttcggtttcctggctggcccgaggagtttgactcctctcctgatttgtgaaagtggagaaataagatacacagtggaagatgagatcagttgttcggtcacttcgccagcttcgccgtttcactcagcaccatgcagaggggcactcacaagcaaccagattgttcgggcagcagaacgctttaatcatgtgcggttcgacatctggttcactgagcacgttacgttgtaatggtgaaattagcagatttgcaagccctggcgtcgagttgatgaggtccatgttctctactgtagtgactgatccgatcaaagatattgggaagaggtggtccaatggtggaatatgagaggagaatagcatcaggagagctagtagacggtgatagctttcaggttgatacaattcaacaattacaaaggctctatgaggagttgattgagaatgaagaagactgtcagctggatagatataaatcatctgagaaatcaggccggagtcgatggctatggtcccgcctcattactcagccttctacgtatgctcctattaagg

SEQ ID NO: 33811 - protein, 73 aa, Zea mays
  misc_feature: Ceres CLONE 1411961-F
MVEYERRIASGELVDGDSFQVDTIQQLQRLYEELIENEEDCQLDRYKSSEKSGRSRWLWSRLITQPSTYAPIK

SEQ ID NO: 33812 - DNA, 707 bp, Zea mays
  misc_feature: Ceres CLONE 1411962-F
  misc_feature: Encodes the peptide sequence at SEQ ID NO. 33813
aaagctggagctccccgcggtggcggccgctctagaactagtggatcccccgggctgcaggaattcgcacgagaccattacctagaacatcctaatcgaaaaattatcgatcccagccccaggccatggcgacgaggtggaggaggtcgctgctctgggtcgccgtcgtccagttcctgaccctgtgcgtcgccgagcatctcgtagtggaagcatacaaaaagtcctacattgtgtatctgggatcacatgcatatggccgtgatgcgtcggcggaggagcatgctcgcgcaacccagtctcaccaccacctcctggcatcgatcctcggcggcgacgacgaccaccaccatgagacggcgcggcagtccatcttctactcctacaccaagagcagcatcaatggcttcgcggcgcacctggaggagtcggtcgcgcagcagatcgcggagcaccctgaggtggtggcggtgctggagagcaagatgctcaagctgcacaccacgcggtcctgggacttcatggacctggagcgcgacggtcacgtcctccctggctccatctggaaccacgctaggttcggacaggacgtcatcatcgccagtctcgacagcggagtggggcccgagtcccacagcttccaagacgacgccggcccagtgcccgctcgctggaagggctttctgtccgacacctggttattactg

SEQ ID NO: 33813 - protein, 194 aa, Zea mays
  misc_feature: Ceres CLONE 1411962-F
  misc_feature (33)..(125): Pfam Name: Subtilisin_N Pfam Description: Subtilisin N-terminal Region
  misc_feature: SWISSPROT Homolog: EC 3.4.21.25 Cucumisin
MATRWRRSLLWVAVVQFLTLCVAEHLVVEAYKKSYIVYLGSHAYGRDASAEEHARATQSHHHLLASILGGDDDHHHETARQSIFYSYTKSSINGFAAHLEESVAQQIAEHPEVVAVLESKMLKLHTTRSWDFMDLERDGHVLPGSIWNHARFGQDVIIASLDSGVGPESHSFQDDAGPVPARWKGFLSDTWLLL

SEQ ID NO: 33814 - DNA, 658 bp, Zea mays
  misc_feature: Ceres CLONE 1411966-F
  misc_feature: Encodes the peptide sequence at SEQ ID NO. 33815
aaagctggagctccccgcggtggcggccgctctcgaactagtggatcccccgggctgcaggaattcgcacgagaccattacctagaacatcctaatcgaaaaagagcttgcaaacaccaccagcgaaaacgtcgtggccagccatcccggtgtcgtcccgcgttctacagccaccgctgtcgtcgccgtcctagactcctagatccgtcagcttaacgagctccattccttcgaggccagccatcccggtgtctcagcagcggcggcggcggcgtcgagctcttgctttctgtgggaggacgcatggcgatgtctgcggggcgtgggctcttggtcctcttcttctctgccgccgtagtggctgagctcgcctctgccgcgaacggtccttttcctggtccgatagccgtctttccagtccgagggggccggatcttaaaggggaggggggttgtgctggcggcccaaaaaaatggcccttgggaactttggtttcaaaaatcacacatctttcaaagaaaggggcaaggggcccaaattttctcccccccccatgggtgggggcggaacaaaaagaaactcggggcccctttttaaattattttccttggcgctggggaaatgtaggggggctcgaacaatgtcgccgtcacactac

SEQ ID NO: 33815 - protein, 97 aa, Zea mays
  misc_feature: Ceres CLONE 1411966-F
MAMSAGRGLLVLFFSAAVVAELASAANGPFPGPIAVFPVRGGRILKGRGVVLAAQKNGPWELWFQKSHIFQRKGQGAQIFSPPHGWGRNKKKLGAPF

SEQ ID NO: 33816 - DNA, 708 bp, Zea mays
  misc_feature: Ceres CLONE 1411967-F
  misc_feature: Translation starting site: 141
  misc_feature (634)..(634): n is a, c, t, g, unknown, or other
aaagctggagctccccgcggtggcggccgctctagaactagtggatcccccgggctgcaggaattcgcacgagaccattacctagacatcctaaaaaaaactgaggcgagggagagagagagagagtgagtgagtgagtaatgggcggttcatcaggccttgtggactggagaggacggccggtgaacaccaagaagcatggaggagtgagagcttcaattttcattcatgcgctggtgctgctcagcaacgtagccaacattgccagtatactgaatcttgtaagctatctgcgcgaggagaggcacatggatgtcgcgagggcgacgacgatggcgagcaatttctttgccgcgctgcaaatgttctccatcccagcagccttccttgctgactcctacatcaagcgtttctacactgtcctcatctttggcccaattgaaatactgggctactccctgctcgcggtccaagcacatgtcccatccctgcacccaccaccgtgcgtccctggacaagagacaagtacgtgtgagtccgtgaagcggttcgatcctgagcctgctcctcctgggtctctacctgatccccatcggcgatgggggcggctcgggcatgcctcccggctctcggnggggggagcagttcgacaggtcggatccccgtagagcagaggcaggagtcgagcttcttcaactggaacacctt

SEQ ID NO: 33817 - DNA, 736 bp, Zea mays
  misc_feature: Ceres CLONE 1411968-F
  misc_feature: Encodes the peptide sequence at SEQ ID NO. 33818
  misc_feature (631)..(631): n is a, c, t, g, unknown, or other
  misc_feature (632)..(632): n is a, c, t, g, unknown, or other
  misc_feature (673)..(673): n is a, c, t, g, unknown, or other
  misc_feature (703)..(703): n is a, c, t, g, unknown, or other
aaagctggagctccccgcggtggcggccgctctagaactagtggatcccccgggctgcaggaattcgcacgagaccattacctagaacatcctaatcgaaaaacatccgtcttcctcctgtaaccagatctgaacccgcggcgacagaaacaaacgctcgctcgctcgttcgttgtccgttcattgtcttcgccggcgccgagggaccctgagagggcaggcgggcgagatggcgggcggcggcgttgaggacgtgtacggcgaggaccgcgctaccgaggagcagctgatcacgccgtgggccttctccgtcgcaagcggctacaccctgctgcgcgacccgcggcacaacaagggcctggccttctcggaggcggagcgcgacgcgcactacctccggggcctgctgccgccggcgctggcgtcgcaggagctgcaggagaagaagctcatgcagaacctgcgccggtacgagcagccgctgcaccgctacatcgccatgatggacctgcaggagcgcaacgagaggctcttctacaagctcctcatcgacaacgtcgaggagctgctccccgtcgtctacacgcccaccggtcggcgaggcatgccagaagtacggcagcatctacgnncgcccggcaggggctgtacatcagccctcaggacaaggaanaaaatcctcgaggtgctcaagaactggccngagaggagcatcagggtcatcgtcgtcacccga

SEQ ID NO: 33818 - protein, 169 aa, Zea mays
  misc_feature: Ceres CLONE 1411968-F
  misc_feature: SWISSPROT Homolog: EC 1.1.1.40 Malate dehydrogenase (oxaloacetate-decarboxylating) (NADP(+))
  misc_feature (135)..(135): Xaa is any aa, unknown, or other
  misc_feature (148)..(148): Xaa is any aa, unknown, or other
MAGGGVEDVYGEDRATEEQLITPWAFSVASGYTLLRDPRHNKGLAFSEAERDAHYLRGLLPPALASQELQEKKLMQNLRRYEQPLHRYIAMMDLQERNERLFYKLLIDNVEELLPVVYTPTGRRGMPEVRQHLRXPGRGCTSALRTRXKILEVLKNWPERSIRVIVVTR

SEQ ID NO: 33819 - DNA, 649 bp, Zea mays
  misc_feature: Ceres CLONE 1411970-F
  misc_feature: Encodes the peptide sequence at SEQ ID NO. 33820
  misc_feature (482)..(482): n is a, c, t, g, unknown, or other
  misc_feature (593)..(593): n is a, c, t, g, unknown, or other
gctctcgaactagtggatcccccgggctgcaggaattcgcacgagaccattacctagaacatcctaatcgaaaaattaattaacaaagagaagacttcttccttcctcgtcggctccagacgattgcaattcttgattccttcgccccgccatccactactcctctaatccttcccacctcctcgtcatccagttcaccacctccacgcgcaatggacaacgggtaggcgaaacacaccagattacaaggattcgtttcatcacgacagcgaagttctcgagcctccatgggcagctacgcgtacaagtactgtatgtgcttcacgcgcaagttccgatccccggacgcccaggcgccgccggacgtccgagccgcccacctctccttcgcctctgacgcccatgccctccgccgcttcgtcgccggcgtccagggcgagccacccgtcgacgtcgaccgcatcctcgccatgctctccggnggccacagccatggaatcgcccgcctcgtcacaaggtcgtcggcggcatccacgcccacgctcgaagacttcttcgccttcgtcttctcggccgactcgaccacccatcgngcagcaggttcaccaggacatgtcagcgccgttctctcacttatttcgtggtcacg

SEQ ID NO: 33820 - protein, 120 aa, Zea mays
  misc_feature: Ceres CLONE 1411970-F
MGSYAYKYCMCFTRKFRSPDAQAPPDVRAAHLSFASDAHALRRFVAGVQGEPPVDVDRILAMLSGGHSHGIARLVTRSSAASTPTLEDFFAFVFSADSTTHRAAGSPGHVSAVLSLISWS

SEQ ID NO: 33821 - DNA, 723 bp, Zea mays
  misc_feature: Ceres CLONE 1411971-F
  misc_feature (723)..(723): n is a, c, t, g, unknown, or other
ggcggccgctcttttcctagtggatcccccgggctgcaggaattcgcacgagaccattacctagaacatcctaatcgaaaactctctcgcgcgtccgtttccgcgcccgcggcctcgttcaatccgccagcgctcccccgccccccggcggtagcgtcctctacgggagagctcctctccggatcccctgcgctccgcgtcttcatctgtggaggacgacgctccgtcggtgtctcctcggacggagcgaggggagataaggttccgtttcatgctccggatcggagagatctacggtctcgatttccgggtgattgtactgggaaactgctggtgatattgtaagacaatgaaagctcatcagcagcaaggtaatggatctgcggcagggagcaagaccaaatctttttttgataaaaaacaaagcctggaaggtggtgggaatatccaaaaatcatccggcaatggtggtgcaaaaggtagaaagggctctcctttttgaatccctacccacagcaaaataaaatcaaaaaagggcagtcttatggaaaaccccaaaaagagaaggctaaaagtggctgcgccgggcccccataatcccccgggaaaaatacaaatttaagattttttccccttatttgggaacccttttcacacgatttttaaccgaaaaaaaacaacccttccttttaccctgaaatggaatttagccgcgcccctccn

SEQ ID NO: 33822 - DNA, 677 bp, Zea mays
  misc_feature: Ceres CLONE 1411974-F
  misc_feature: Encodes the peptide sequence at SEQ ID NO. 33823
  misc_feature (569)..(569): n is a, c, t, g, unknown, or other
  misc_feature (650)..(650): n is a, c, t, g, unknown, or other
aaagctggagctccccgcggtggcggccgctctagaactagtggatcccccgggctgcaggaattcgcacgagaccattacctagaacatcctaatcgaaaaatcgatcccagccccaggccatggcgacgaggtggaggaggtcgctgctctgggtcgccgtcgtccagttcctgaccctgtgcgtcgccgagcatctcgtagtggaagcatacaaaaagtcctacattgtgtatctgggatcacatgcatatggccgtgatgcgtcggcggaggagcatgctcgcgcaacccagtctcaccaccacctcctggcatcgatcctcggcggcgacgaccaccaccaccatgagacggcgcggcagtccatcttctactcctacaccaagagcagcatcaatggcttcgcggcgcacctggaggagtcggtcgcgcagcagatcgcggagcaccctgaggtggtggcggtgctggagagcaagatgctcaagctgcacaccacgcggtcctgggacttcatggacctggagcgcgacggtcacgtcctccctggctccatctggaccacngctaggttcgggacaggacgtcatcatcgccagctcgacaaggcggagtgtggcccgagtcccacagcttccaagacgacnggcggccagtggcgcttttcgctggaa

SEQ ID NO: 33823 - protein, 185 aa, Zea mays
  misc_feature: Ceres CLONE 1411974-F
  misc_feature (33)..(125): Pfam Name: Subtilisin_N Pfam Description: Subtilisin N-terminal Region
  misc_feature: SWISSPROT Homolog: EC 3.4.21.25 Cucumisin
MATRWRRSLLWVAVVQFLTLCVAEHLVVEAYKKSYIVYLGSHAYGRDASAEEHARATQSHHHLLASILGGDDHHHHETARQSIFYSYTKSSINGFAAHLEESVAQQIAEHPEVVAVLESKMLKLHTTRSWDFMDLERDGHVLPGSIWTTARFGTGRHHRQLDKAECGPSPTASKTTGGQWRFSLE

SEQ ID NO: 33824 - DNA, 659 bp, Zea mays
  misc_feature: Ceres CLONE 1411977-F
  misc_feature: Encodes the peptide sequence at SEQ ID NO. 33825
  misc_feature (638)..(638): n is a, c, t, g, unknown, or other
tggcggccgctctagaactagtggatcccccgggctgcaggaattcgcacgagaccattacctagaacatcctaatcgaaaaaagtcatagggacattgcattggggaactacagaaaagggtccgaatcgaatccgtggtgcactgccccttcctcccccacaagccgccgccgccgccgtgaggactccggcgaatggcgtcccgcgtcgcctcgggcctcctccgccgccgcgccggcgccacactaggcctcctaaggagttatgcacatgtcagaagctacaacagtcaactttcagctttggtttctgctacatctgaatgctcaaatctgccgagaagatgctattacttacctaatccctctccataccaagttttgggagtaggtcatttgcttcagacaacggagaacagttttggagggctgtttgtgccctttcatggggtggaatcttgtaacttgaaggggaactcccttgggttaacttttctttaaaaaaaaacccgggaaaaaaaaagaaacccaaggggggtggtaaaaacaacaataagggcgcgagaaataatagaacactctctgttaggggggggccccttataaaaaaattatggggggccgcggcgaccaccgnctctggacgcgccagggcggg

SEQ ID NO: 33825 - protein, 101 aa, Zea mays
  misc_feature: Ceres CLONE 1411977-F
MASRVASGLLRRRAGATLGLLRSYAHVRSYNSQLSALVSATSECSNLPRRCYYLPNPSPYQVLGVGHLLQTTENSFGGLFVPFHGVESCNLKGNSLGLTFL

SEQ ID NO: 33826 - DNA, 679 bp, Zea mays
  misc_feature: Ceres CLONE 1411978-F
  misc_feature: Encodes the peptide sequence at SEQ ID NO. 33827
  misc_feature (538)..(538): n is a, c, t, g, unknown, or other
  misc_feature (562)..(562): n is a, c, t, g, unknown, or other
cgcggtggcggccgctctagaactagtggatcccccgggctgcaggaattcgcacgagaccattacctagaacatcctaatcgaaaaagaatcttctgccactgcccttccatctcgtcccttagctacaagtcatctcgccgcaaccggaacccgcagccatggggacggaggcggagcagccggacatggacagccaccgaaacgacggcgtcgtggtggtgccagcgccgcgcccgcgtaaggggctcgcctcctgggcgcttgacctgctcgagtccctcgccgtgcgcctcggccacgacaagaccaagccgctccactggctctccggcaacttcgcccccgtcgtcgaggagaccccgccggccccaaaccttagcgtccgcggacacctcccggagtgcttgaatggagagtttgtcagggttgggcctaatccgaagtttgctcctgttgcggggtatcactggtttgatggagacgggatgattcatgccatgcgtattaaggatggaaaagctacctatgtatcaangatatgtgaagactgcccgcctcnacaagagggaaggattttggtgggagcaaagttttatgaagattggaaccttaaggggattttttttggaaattgtttatggtccaaatgcagcaacttcgaaaaaaaatcaaaggg

SEQ ID NO: 33827 - protein, 172 aa, Zea mays
  misc_feature: Ceres CLONE 1411978-F
  misc_feature: SWISSPROT Homolog: EC 1.13.11.51 9-cis-epoxycarotenoid dioxygenase
  misc_feature (126)..(126): Xaa is any aa, unknown, or other
  misc_feature (134)..(134): Xaa is any aa, unknown, or other
MGTEAEQPDMDSHRNDGVVVVPAPRPRKGLASWALDLLESLAVRLGHDKTKPLHWLSGNFAPVVEETPPAPNLSVRGHLPECLNGEFVRVGPNPKFAPVAGYHWFDGDGMIHAMRIKDGKATYVSXICEDCPPXQEGRILVGAKFYEDWNLKGIFFGNCLWSKCSNFEKKSK

SEQ ID NO: 33828 - DNA, 708 bp, Zea mays
  misc_feature: Ceres CLONE 1411981-F
gctctgaatagtggtcccccgggctgcaggaattcgacgagaccattacctagaaatcctaatcgaaaagattttcttcacccgtccacctcgtcttgcgctcctctgtctcggcgacgactgtgctaccgccgccgccgccgcaagacttcgtcgggcactttgccggcgacgatttcccaccagcccaacaggatcagaggaggtgatggcgaggagtgacagctgcctggcgcgcgtgggtgccggaattgctatcggtggcgcggtcggcggagccgtcggtaaccttcgtccctaaacccctaaacactaggcttgcagcatcaatccgtccgtgcgagccgcttcacccgtcggtgtttttttttttgggtggaagtagattagtgtgcgatttcggaattctcctcagctagctagtagctacatccctggtttgggtgggtagctaaggggcagatgaaataactagggggcttttggtaaaaggttactaagggctaagggacaatcatctgggggggggaaaaaatccaaggctccgagtggggagtttggtttgcccccaatggttgggggccaaagggggtgggggggattccgccggcggggggttggggaaaattccccgggggggggtaaaaaatgggggggggaaaaggggaaaaattttggattttgcctcctgtaatggaaggggaagag

SEQ ID NO: 33829 - DNA, 677 bp, Zea mays
  misc_feature: Ceres CLONE 1411982-F
  misc_feature: Encodes the peptide sequence at SEQ ID NO. 33830
  misc_feature (525)..(525): n is a, c, t, g, unknown, or other
  misc_feature (637)..(637): n is a, c, t, g, unknown, or other
  misc_feature (675)..(675): n is a, c, t, g, unknown, or other
  misc_feature (676)..(676): n is a, c, t, g, unknown, or other
aaagctggagctcaccgcggtggcggccgctctagaactagtggatcccccgggctgcaggaattcgcacgagaccattacctagaacatcctaatcaaaaaaggaaaccctaggccgctacgcccttggccccttctctctcttcgtcgcgccgccgtagcacgactccgactcggccatggcgacacccccagctctcctattcccttcgccctcttcggcatcttctccgccgtcatccgcgcaggtagaggcggtggtcctcttcaacgtctgcgacagcaacgagagcggaccggacaaggcagaagtgacattcgcaccctctgttggatcactagtcgccgatggcaccggtcatttttcgcccccccctaaggagggcgcgagagctcggccatatgaacgaggtgaccacccaggcgaacagactacctcacgagaacctcggatatctccttctggacagaacaaacaagatatgcctctcaagtggaggggacgcgacacccgctccacgcggnagcccagccaaaggcccatcactgctggtcgggcgccggagaacccccctcccccacgggcaacgccccacagaccacccttgcccaaacctcaggaacagaagacgcaggntggccctacctccccccttccttaaccccccaaacacnng

SEQ ID NO: 33830 - protein, 160 aa, Zea mays
  misc_feature: Ceres CLONE 1411982-F
  misc_feature (116)..(116): Xaa is any aa, unknown, or other
  misc_feature (153)..(153): Xaa is any aa, unknown, or other
MATPPALLFPSPSSASSPPSSAQVEAVVLFNVCDSNESGPDKAEVTFAPSVGSLVADGTGHFSPPPKEGARARPYERGDHPGEQTTSREPRISPSGQNKQDMPLKWRGRDTRSTRXPSQRPITAGRAPENPPPPRATPHRPPLPKPQEQKTQXGPTSPLP

SEQ ID NO: 33831 - DNA, 680 bp, Zea mays
  misc_feature: Ceres CLONE 1411983-F
  misc_feature: Encodes the peptide sequence at SEQ ID NO. 33832
  misc_feature (288)..(288): n is a, c, t, g, unknown, or other
  misc_feature (318)..(318): n is a, c, t, g, unknown, or other
  misc_feature (421)..(421): n is a, c, t, g, unknown, or other
  misc_feature (437)..(437): n is a, c, t, g, unknown, or other
  misc_feature (453)..(453): n is a, c, t, g, unknown, or other
  misc_feature (455)..(455): n is a, c, t, g, unknown, or other
  misc_feature (512)..(512): n is a, c, t, g, unknown, or other
  misc_feature (513)..(513): n is a, c, t, g, unknown, or other
  misc_feature (523)..(523): n is a, c, t, g, unknown, or other
  misc_feature (553)..(553): n is a, c, t, g, unknown, or other
  misc_feature (606)..(606): n is a, c, t, g, unknown, or other
aaagctggagctcaccgcggtggcggccgctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggnggcgtcggtgctcctcgaccggcggggtcnacggcctcccgccggggccttccggttggccggcggtggggaacctgccccccgggttccggcgccgacggcccttctgggcggggggcgcacccccccgggnagtgcgggccctgctncccctgcggagggggncnccctccccctcccggggtcaggtcggtggaacctccacctcaagccagtttataaannccgccccccnggaagaaaaccgggccgaagtatgacccgnccgggcttttctccgttcctgggaaggggcccctaaaaactcgaccctaacgncccccgagggggatgttctgctctccacggtgcacgcggaggccgccgcccaaccatcaaaggggggctttccc
